United States Patent 12,397,048 (BUNYAVIRALES VACCINE) - sequence listing, part 9

SEQ ID NO: 10917 - RNA, 4305 nt, synthetic construct
  misc_feature 1..4305: note = derived and/or modified CDS sequence (opt3) from MAGV__AY286443.1__GP
  source 1..4305: mol_type = other RNA
atggagctgctcatcattatacttctgttgggcagcgccgcttcctctcccatctcaaccagatgcttccacgggggacagttaattgcagaaagtaagagcgccacatccatctctgagttttgtctgaaagacgatgtgtcgatgattaagtcagaagtcacttacatcaaaaacgacacgggtatatatggccataataaggttttcaggagctggaccatcaaagattggaagctatgcaaccctattccaacagctgggggaagtatcaatgtgattgaggtaaactccgacctctctctggcgactcgggcctacgtgtgtagccgcgattgcaccatcacaatagacaaggaagatgcacaaattatctttcagaccgacaaacttaatcacttcgaggtctccggcactacactgtcaagtggttggtttaagaccaaagccagcgtgacgttggatcgaacttgtgagcatattaaggttacctgcgggaaaaagtctctccagttccacgcttgttttaagcatcacatgtcctgcatccgtttctttcaccatacaatcctgccgggaactatggtgtcaagcatgtgtcagaacattgaactgataatcattatcggcctcaccttagtcatattcattctgatggtgatccttacaaaaacctatatctgctacttgctgatgcccgtatttatgcctgttgcatatatttacggctgggcctataataagagttgtaaaaagtgcaactgctgtgggctagcttaccacccattcacgaattgcggatctcattgtgtgtgcggtctcaaatttgaggcctccgacagaatgaggctgcaccgggaaagcggcctttgtcaagggtacaagtcgctgcgcatcgcgagaatgttgtgcaaatctaagggatcctcactcgtcattagtggcctgttaagcatgctgctcctttccttcataactcccatcgagggtacactgaccaactatcctaatgagaagcagtacactttggaagagattgcagatgtggtggaagggatcatcacagagcagcacctaaaagaatatgtcgttttctacacctctctgtttggaggcctcattctgcttctgacgttgatactcagcatcaccattaacaaggtgacagacctgttagcctcaactaatgtaatctattgtgaggagtgcagtatgtaccattccaaaaagggcattaaatataacggggatttcaccaataagtgtggattttgcacatgtagcgaacaggaggacgtggaaggtgtcatcatacacaaggtgtctaggaaatgcacttacaagtaccaactgaaatgggttcgggtgatcatgattatcctagctctcctgcttaccattcagaacacagtcttgatcgtggccgcagaggtagactgctggaccaagaaatcaatagaaattgattgtatcggcccactgctcaacattgggagttgcactgacaagagctcccgcacgtatgagacagaggttaataagctggtgcgacagtctaaagtcacccatgctgatgccgaacagatctcgatacttggaagcactctggacaacgcgatcaaggccgtgagatcccagaaaacctacgagacaatgcacttcttggaaaccgtctttctcatgaagaattgtgattattacaactcattcgagcataatagtggctattctcaaactaaatggaggctgattgcaaagacaagccactttgacatctgctcccggcactcaacgcatcacttctgtcgttgcgtgaacgaaggtaccaagtgtcagaatggggattgggactttgctggcgagatgaacgatacttacaatagcaaaaacgacttctatttacatgatctggacctattttacacactcctggagaatgccttccccggaaccacagaatctcttttctaccaattgctgcagaagaaaaacactaccggcgcttccaagctcctggggaaattaattacgaagtatggaaataacaatatgttcgttgagatctggaaattcggtcagtacctgcttaagttgccttatataaacgacaccgaactcagtacagatcgcaagagcactattatcaaatctcagcaagtgctgtccagatcacagaccggcaggcaggagagtctaagctcggccacaccagggactgcaaccaaggagtgctccaacgccaaagacatcggatgtatttctccgcggtttggcatccccattggtaatctgacggcttgcggggatagccctaactacaaggtatataaaacaccagaaaagatatacaagtcaaataaccgaggcgaggtctggtgtagtgacgatgtgcactgcctcaccgacttcgaacccgcggaggaagaggttgtgaatcgcatcaaacagatgacttgctttctgacagatgtcaccactaagaccgacgtgttctccgtagcaatttctacatgtaaaatggtggataagggagtttgcacggtcaacgacgccaaatggaatatccttaagtgtaacagcggcttgtattactttaccgatcacagagggggacaagacactggtaatgatttcggcgagtactgcatttcccattcatgtaacacagaaaggtttcctatcaatccagacgtgctgaaggactgcatatgggagtatcacagccggaaaagtaagtacatctctaccgtgtccttagaaagcctcgatgagttccgcagagctatgtcggacaaactgtcacatacacttatgatttataactttaagcccactgccaatctgccgcacatcaaacctacctacaagttcattacggcaaacgggatcgaaaattctgatggaatagacagtgcctatattttgtccagcatccccgctctcggcggtatgtctgtcgggtacaacatccagacaaaggataactttccactgctagacattatagttttcatcaaaagcgccattatcaagaccacttataatcatatttacgataccggccctacaatcggaataaacactcagcacgacgagcactgtaccggcccctgcccaacactgatcccccataaagagaattggctcacgttttcccaggaaaggacctcacgttgggggtgtgaggaatttggatgcctggcaattaacactggctgtgtgttcggtagttgccaagatatcattcaccctgaggcgaaggtgtaccggaaagctatcgaagaggaggtagtccttacagtgtgcataacctttccagggaatacttattgtacagaaattaacgccatcgagccgaagatcaccgacgaaattgagttgcagttcaaaacggttgatactaagaccctgcccaatttactcatggtgcagaaccataagctgtacagcggacagatcaatgaccttggctctttttcccaaggttgcggcaacgtccagaaaacaaatcagtcagtgataggggcaggaaccgccaagttcgattatgtttgtcacggcgctagtcgaaaagacgtgattgtaagaaggtgctacaacaataactatgagagctgtaagctgctaaaagaagagacttccctcatctttgccgacaatcatgaaacactggaggtcgcaaacaccaagcacttgattggggaactgcaattcaagatcatgttaggagatatacgctacaaatcttttgctgagtcgcctgagctcgaagtggacgccaagtgcgtgggctgtccaagctgcttcgagtcatattcctgtaactttcagattgtcacaaatatcgatactgtttgcagtgtggacggtccctgtaccctgttccacaaccggcttatcatttctgcgacgaaacagagctacgggtttaagatgtcctgccctagaaaaccagaacccacagaggagttccagatctgcaataggaagtacaacgtactgttcaccactattgataagaatgacaaaatagaaatcaacaccggagatcaaacatcatatatttacgagaaggacaatcgctgtaaaacttggttgtgccgagtgcgggatgaaggcatctctgtcatctttgagccgctcaaggccttctttggtagctatttcagtattatattttacgtggttgtgggcatcattgtcctgttcctaaccatctatatttttctgcctatgttctttaaacttcgtgacatcctcaagagaaacgaatacctgtatttgcaggagctgaagcataaatga

SEQ ID NO: 10918 - RNA, 4305 nt, synthetic construct
  misc_feature 1..4305: note = derived and/or modified CDS sequence (opt3) from MAGV(ts8)__AY286444.1__GP
  source 1..4305: mol_type = other RNA
atggagctgctcatcattatacttctgttgggcagcgccgcttcctctcccatctcaaccagatgcttccacgggggacagttaattgcagaaagtaagagcgccacatccatctctgagttttgtctgaaagacgatgtgtcgatgattaagtcagaagtcacttacatcaaaaacgacacgggtatatatggccataataaggttttcaggagctggaccatcaaagattggaagctatgcaaccctattccaacagctgggggaagtatcaatgtgattgaggtaaactccgacctctctctggcgactcgggcctacgtgtgtagccgcgattgcaccatcacaatagacaaggaagatgcacaaattatctttcagaccgacaaacttaatcacttcgaggtctccggcactacactgtcaagtggttggtttaagaccaaagccagcgtgacgttggatcgaacttgtgagcatattaaggttacctgcgggaaaaagtctctccagttccacgcttgttttaagcatcacatgtcctgcatccgtttctttcaccatacaatcctgccgggaactatggtgtcaagcatgtgtcagaacattgaactgataatcattatcggcctcaccttagtcatattcattctgatggtgatccttacaaaaacctatatctgctacttgctgatgcccgtatttatgcctgttgcatatatttacggctgggcctataataagagttgtaaaaagtgcaactgctgtgggctagcttaccacccattcacgaattgcggatctcattgtgtgtgcggtctcaaatttgaggcctccgacagaatgaggctgcaccgggaaagcggcctttgtcaagggtacaagtcgctgcgcatcgcgagaatgttgtgcaaatctaagggatcctcactcgtcattagtggcctgttaagcatgctgctcctttccttcataactcccatcgagggtacactgaccaactatcctaatgagaagcagtacactttggaagagattgcagatgtggtggaagggatcatcacagagcagcacctaaaagaatatgtcgttttctacacctctctgtttggaggcctcattctgcttctgacgttgatactcagcatcaccattaacaaggtgacagacctgttagcctcaactaatgtaatctattgtgaggagtgcagtatgtaccattccaaaaagggcattaaatataacggggatttcaccaataagtgtggattttgcacatgtagcgaacaggaggacgtggaaggtgtcatcatacacaaggtgtctaggaaatgcacttacaagtaccaactgaaatgggttcgggtgatcatgattatcctagctctcctgcttaccattcagaacacagtcttgatcgtggccgcagaggtagactgctggaccaagaaatcaatagaaattgattgtatcggcccactgctcaacattgggagttgcactgacaagagctcccgcacgtatgagacagaggttaataagctggtgcgacagtctaaagtcacccatgctgatgccgaacagatctcgatacttggaagcactctggacaacgcgatcaaggccgtgagatcccaaaagacctacgagacaatgcacttcttggaaaccgtctttctcatgaagaattgtgattattacaactcattcgagcataatagtggctattctcagactaaatggaggctgattgcaaagacaagccactttgacatctgctcccggcactcaacgcatcacttctgtcgttgcgtgaacgaaggtaccaagtgtcagaatggggattgggactttgctggcgagatgaacgatacttacaatagcaaaaacgacttctatttacatgatctggacctattttacacactcctggagaatgccttccccggaaccacagaatctcttttctaccaattgctgcagaagaaaaacactaccggcgcttccaagctcctggggaaattaattacgaagtatggaaataacaatatgttcgttgagatctggaaattcggtcagtacctgcttaagttgccttatataaacgacaccgaactcagtacagatcgcaagagcactattatcaaatctcagcaagtgctgtccagatcacagaccggcaggcaggagagtctaagctcggccacaccagggactgcaaccaaggagtgctccaacgccaaagacatcggatgtatttctccgcggtttggcatccccattggtaatctgacggcttgcggggatagccctaactacaaggtatataaaacaccagaaaagatatacaagtcaaataaccgaggcgaggtctggtgtagtgacgatgtgcactgcctcaccgacttcgaacccgcggaggaagaggttgtgaatcgcatcaaacagatgacttgctttctgacagatgtcaccactaagaccgacgtgttctccgtagcaatttctacatgtaaaatggtggataagggagtttgcacggtcaacgacgccaaatggaatatccttaagtgtaacagcggcttgtattactttaccgatcacagagacgggcaagatactggaaatgacttcggtgagtactgcatttcccattcatgtaacacagaaaggtttcctatcaatccagacgtgctgaaggattgcatatgggagtatcacagccggaaaagtaagtacatctctaccgtgtccttagaaagcctcgacgagttccgcagagctatgtcggataaactgtcacatacacttatgatttataactttaagcccactgccaatctgccgcacatcaaacctacctacaagttcattacggcaaacggcatcgaaaattctgacgggatagatagtgcctatattttgtccagcatccccgctctcggaggcatgtctgtcggttacaacatccagacaaaggacaactttccactgctagatattatagttttcatcaaaagcgccattatcaagaccacttataatcatatttacgacaccgggcctacaatcggcataaacactcagcacgatgagcactgtaccggaccctgcccaacactgatcctccataaagagaattggctgacgttttcccaggaaaggacctcacgttggggctgtgaggaatttgggtgccttgcaattaacactggatgtgtgttcggcagttgccaagacatcattcaccccgaggcgaaggtgtaccggaaagctatcgaagaggaggtagtcttgacagtgtgcataacctttcctggtaatacttattgtacagaaattaacgccatcgagccaaagatcaccgatgaaattgagctgcagttcaaaacggttgacactaagaccttaccgaatctcctgatggtgcagaaccataaactttacagcgggcagatcgatgacctgggatctttttcccaaggctgcggtaatgtccagaaaacaaaccagtcagtgataggcgcagggaccgccaagttcgactatgtttgtcacggagctagtcgaaaagatgtgattgtaagaaggtgctacaataacaattatgagagctgtaagctactcaaagaagagacttccctgatctttgccgacaaccatgaaacattggaggtcgcaaataccaagcacctgattggcgaattacaattcaagatcatgctcggggatatacgctacaaatcttttgctgagtcgcccgagctggaagtggacgccaagtgcgtgggatgtcctagctgcttcgagtcatattcctgtaactttcagattgtcacaaacatcgatactgtttgcagtgtggacggcccatgtacccttttccacaatcggctgatcatttctgcgacgaaacagagctacggttttaagatgtcctgccccagaaaacctgaaccaacagaggagttccagatctgcaacaggaagtacaatgtattgttcaccactattgataagaacgacaaaatagaaatcaataccggggatcaaacatcatatatttacgagaaggacaaccgctgtaaaacttggctctgccgagtgcgggatgaaggaatctctgtcatctttgagcccctgaaggccttctttggcagctatttcagtattatattttacgtggttgtgggtatcattgtcctattcctgaccatctatatttttcttccgatgttctttaaactccgtgacatcctgaagagaaatgaatacttgtatctgcaggagttaaagcataaatga

SEQ ID NO: 10919 - RNA, 4311 nt, synthetic construct
  misc_feature 1..4311: note = derived and/or modified CDS sequence (opt3) from MAGV(AG83-1746)__KX100113.1__GP
  source 1..4311: mol_type = other RNA
atgaagatgatcctgctcattataatcctttgcgtgaacctggccgctgcaaatcccgtcgccaccagatgtttccacggcgggcagttgattgcggagacaaggagcgctacttccatctctgaattttgcttaaaagacgatgtttcaatgattaagagtgagatcacgtacaccaaaaacgacacaggaatattcggtcatagcaagatctataaatcctggctgattaaggattggaagctatgtaatcctgtgccaactgccggcgggtctatcaacgtaattgaagttaattcggacctctcactgaccacaaaagcatacgtctgcagccgggattgtaccatcactatagacaaggaggaagcccaaattatctttcagacagataaacttaaccacttcgaggtgagtggaaccacgctgtcctctggctggtttaagactaaagctagcgttaccttggaccgcacatgcgagcatattaaggtgacttgtggtaagaaaaccctccagttccacgcatgctttcgacatcacatgtcctgtgtccgtttctttcacaatacaatcctgccggggaccatggtgaactcaatgtgccagaatatcgaactgattataatcctcggattaacgctgattatcttcactcttatggtaatattgacaaagacctatatttgttacatcctgatgcccctatttatgcctatcgcctatgcttacggctgggcctataacaaaagttgcaagaaatgcaattgttgcggcctcgcgtaccatccattcactaactgtgggagccactgcgtttgtggactgaagtttgaggcatctgatagaatgaggattcatcgggaatccggtctttgccaaggctacaaatcactgcgcatcgccagattgctctgtaagagcaaggggagttctctgattatatccacattactgagcatgctccttctgtcgttcatcacccccattgagggaacgatgaccaattatcctgagacaaggcagtactctttggaagagatcgctgacgtggtcgaaggcctactgtccgagcagaacatcaaagaatatgtggtgttctacacttcactctttggtagtctgattcttctgttggccttcatactcagcatcaccctgacaaaggtcactaatgcattagctaaaaccaacgttatttattgcgaggagtgttccatgtaccacgccaagaaagggatcaagtataacggagattttacaaataagtgcggcttctgtacctgcgacgaacaggaggatgaagagggcattatcatacacaaagtgtctaagaaatgcacttaccggtaccaactgcagtgggcgaagatcattatgatcattctagtaatgctcctgatgatgcagaacacgatccttatagtggccgcagaaacagactgttggaccaaaaatagcttggagctggactgcattgggccactcctgactatctcagattgtagtaacaaggagtccaagaattatgaagaggaagctgccaaacttgtcagccagtctaagattacccaagctgacgccgaacaggtgacaatcctgggaaacaccatagatactgcattgaaagccatccgctcacagaagacataccaaacgatgcatctcctggaaagtgtgtttttaatgaaaaattgcgactattacagctccttcgagcacaactctggttattcgcaggctaagtggcgactgattgcgaagaccagccattttgatatctgttccagacactcaatgcatcacttctgtaggtgcgtggcagacggcactaaatgccagaatgggaactgggattttgccggagagatgaataacacatacagtaccaagaatgacttctatctacacgatctcaacctgtttttcacacttcatgaaactgcttttcccggcaccacggagtctttgttctaccagctgattgccaaaaagaataccacaggtgcaagcaaactcctggggaagttaatcactaaatacggcaacaacaagctgttcgtcggaatatggaagtttggccaatatcttttgaccctcccttacgtgaatacaactgaactgtccaaaacccggaaggagacgattctaaaaccacaccagatcctgacacgttcacaagggggacgcccggagagcatgtcttccgccgaagtaggtcagaccgctaaggagtgtgccaacgcaaagaatgttggctgcatcagtcccagattcggggtgcctattggaaacctcactgcgtgtggcaatagcccaaactataagatctacaagacacccaataaaatttataagtctaacaataggggtgaagtctggtgctccgaggacgtgcattgcctggctgattttgaacctgccgacaccgaggtcgtgaacaaagttaagaaaatgacttgtttcctttcagacgtgaatacccgggcagatatatttagtatcgccattagcgcttgccgaatggtagacaagggggtctgtacagtgaacggcgccaagtggaatatcttgaaatgcgagtcgggactgtactatttcacggatcaccgcgaaggccaggacaccgggaacgattttggagagtactgtatttcccactcttgcaatactgaaagatacccaatcaaccccgacatattaaaggagtgtatctgggaatatcatagcaggaaatcaaagtacattagtacaatcaacctcgagtccctggaggagttcaaacgggcaatgtctgataaacttagccacaccctgatggtttataattttaagccgacagctaacttgcctcatattaaaccctcctacaagttcatcactgccaatggtatagagaactcagacggcctcgaaagcgcgtatattctgagttctatcccagccatcgggggaatgtccattggctacaatatacagaccaaagataactttcctctactggacctcatcgtgttcgtcaagagcgctgtgattaaaacgacatataatcacatctacgataccggtcccactattgggatcaacaccaatcatgacgagcactgcacaggcccatgtcccactataatccctcacaaggaaaactggctgaccttttcgcaggagcgcacatcaagatggggatgcgaggagttcggctgtcttgcaattaatacggggtgcgtattcggatcttgccaggatgtgatccatccagaaaccaaaatttacaggaaggccgttgaagaggaggtcgtgttgactgtgtgtatcaactttccgggcaatacattctgcaccgaaataaacgctattgagcccaagatcactgacgaaatcgagctgcaatttaaaacagtcgacaccaagacgttacctaatctcctggccgttcagaaccacaaactttatagtggtcagattaacgatctggggtccttcagccagggatgtggcaatgtgcaaaagactaaccagtctatcctaggtgcaggcaccgtgaaatttgactacgtatgccatggggcgagccgtaaggatataattgtccggcgatgttatacaaataactacgactcctgcaagctcctgaaagaagagagatcattgatcttcgccgataatcacgagaccctggaagtggctaacactaggcatttaattggagagctccagtttaagatcatgctgggcgacatacgctataaagccttcgcagaaaagccagagcttgaaattgatgctaaatgtgttgggtgccccagttgttttgagagctactcttgctccttccaaatcgtgacatcaatcgacaccgtctgtagtgtggagggaccttgcacactgtttcacaatcggattatcattactgccgcaaagcagagctatggcgttaagatgtcctgcaaaaccaagccaggtcccgtggaagagttcagaatatgtaacaggaattaccgcgtatctttcgccacgatcgataaaaacgacaagattgaaatcaatacaggggatcagacctcgtacatcgtcgagaaagacagccgatgcaagacttggttgtgtcgggtgcgtgatgaaggaatttcagtgatatttgagccgctcaaggctttctttggctcctatttcagtgtcgcgttttacatcattatcggtattgccgcactgttcctaatcatatatatctttctgcctatgttctttaaacttagagacgttctcaagaaaaacgagtacctgtatttgcaggaactgaagcacaaatga

SEQ ID NO: 10920 - RNA, 4305 nt, synthetic construct
  misc_feature 1..4305: note = derived and/or modified CDS sequence (opt3) from MAGV(BeAr 7272)__KX100104.1__GP
  source 1..4305: mol_type = other RNA
atggagctgctcatcattatacttctgttgggcagcgccgcttcctctcccatctcaaccagatgcttccacgggggacagttaattgcagaaagtaagagcgccacatccatctctgagttttgtctgaaagacgatgtgtcgatgattaagtcagaagtcacttacatcaaaaacgacacgggtatatatggccataataaggttttcaggagctggaccatcaaagattggaagctatgcaaccctattccaacagctgggggaagtatcaatgtgattgaggtaaactccgacctctctctggcgactcgggcctacgtgtgtagccgcgattgcaccatcacaatagacaaggaagatgcacaaattatctttcagaccgacaaacttaatcacttcgaggtctccggcactacactgtcaagtggttggtttaagaccaaagccagcgtgacgttggatcgaacttgtgagcatattaaggttacctgcgggaaaaagtctctccagttccacgcttgttttaagcatcacatgtcctgcatccgtttctttcaccatacaatcctgccgggaactatggtgtcaagcatgtgtcagaacattgaactgataatcattatcggcctcaccttagtcatattcattctgatggtgatccttacaaaaacctatatctgctacttgctgatgcccgtatttatgcctgttgcatatatttacggctgggcctataataagagttgtaaaaagtgcaactgctgtgggctagcttaccacccattcacgaattgcggatctcattgtgtgtgcggtctcaaatttgaggcctccgacagaatgaggctgcaccgggaaagcggcctttgtcaagggtacaagtcgctgcgcatcgcgagaatgttgtgcaaatctaagggatcctcactcgtcattagtggcctgttaagcatgctgctcctttccttcataactcccatcgagggtacactgaccaactatcctaatgagaagcagtacactttggaagagattgcagatgtggtggaagggatcatcacagagcagcacctaaaagaatatgtcgttttctacacctctctgtttggaggcctcattctgcttctgacgttgatactcagcatcaccattaacaaggtgacagacctgttagcctcaactaatgtaatctattgtgaggagtgcagtatgtaccattccaaaaagggcattaaatataacggggatttcaccaataagtgtggattttgcacatgtagcgaacaggaggacgtggaaggtgtcatcatacacaaggtgtctaggaaatgcacttacaagtaccaactgaaatgggttcgggtgatcatgattatcctagctctcctgcttaccattcagaacacagtcttgatcgtggccgcagaggtagactgctggaccaagaaatcaatagaaattgattgtatcggcccactgctcaacattgggagttgcactgacaagagctcccgcacgtatgagacagaggttaataagctggtgcgacagtctaaagtcacccatgctgatgccgaacagatctcgatacttggaagcactctggacaacgcgatcaaggccgtgagatcccagaaaacctacgagacaatgcacttcttggaaaccgtctttctcatgaagaattgtgattattacaactcattcgagcataatagtggctattctcaaactaaatggaggctgattgcaaagacaagccactttgacatctgctcccggcactcaacgcatcacttctgtcgttgcgtgaacgaaggtaccaagtgtcagaatggggattgggactttgctggcgagatgaacgatacttacaatagcaaaaacgacttctatttacatgatctggacctattttacacactcctggagaatgccttccccggaaccacagaatctcttttctaccaattgctgcagaagaaaaacactaccggcgcttccaagctcctggggaaattaattacgaagtatggaaataacaatatgttcgttgagatctggaaattcggtcagtacctgcttaagttgccttatataaacgacaccgaactcagtacagatcgcaagagcactattatcaaatctcagcaagtgctgtccagatcacagaccggcaggcaggagagtctaagctcggccacaccagggactgcaaccaaggagtgctccaacgccaaagacatcggatgtatttctccgcggtttggcatccccattggtaatctgacggcttgcggggatagccctaactacaaggtatataaaacaccagaaaagatatacaagtcaaataaccgaggcgaggtctggtgtagtgacgatgtgcactgcctcaccgacttcgaacccgcggaggaagaggttgtgaatcgcatcaaacagatgacttgctttctgacagatgtcaccactaagaccgacgtgttctccgtagcaatttctacatgtaaaatggtggataagggagtttgcacggtcaacgacgccaaatggaatatccttaagtgtaacagcggcttgtattactttaccgatcacagagacgggcaagatactggaaatgacttcggtgagtactgcatttcccattcatgtaacacagaaaggtttcctatcaatccagacgtgctgaaggattgcatatgggagtatcacagccggaaaagtaagtacatctctaccgtgtccttagaaagcctcgacgagttccgcagagctatgtcggataaactgtcacatacacttatgatttataactttaagcccactgccaatctgccgcacatcaaacctacctacaagttcattacggcaaacggcatcgaaaattctgacgggatagatagtgcctatattttgtccagcatccccgctctcggaggcatgtctgtcggttacaacatccagacaaaggacaactttccactgctagatattatagttttcatcaaaagcgccattatcaagaccacttataatcatatttacgacaccgggcctacaatcggcataaacactcagcacgatgagcactgtaccggaccctgcccaacactgatcccccataaagagaattggctcacgttttcccaggaaaggacctcacgttggggctgtgaggaatttgggtgcctggcaattaacactggatgtgtgttcggcagttgccaagacatcattcaccctgaggcgaaggtgtaccggaaagctatcgaagaggaggtagtccttacagtgtgcataacctttccaggtaatacttattgtacagaaattaacgccatcgagccgaagatcaccgatgaaattgagttgcagttcaaaacggttgacactaagaccctgcccaatttactcatggtgcagaaccataagctgtacagcgggcagatcaatgatcttggatctttttcccaaggctgcggtaacgtccagaaaacaaatcagtcagtgataggcgcagggaccgccaagttcgactatgtttgtcacggagctagtcgaaaagacgtgattgtaagaaggtgctacaacaataactatgagagctgtaagctgctaaaagaagagacttccctcatctttgccgataatcatgaaacactggaggtcgcaaacaccaagcacttgattggcgaactgcaattcaagatcatgttaggggacatacgctacaaatcttttgctgagtcgcctgagctcgaagtggatgccaagtgcgtgggatgtccaagctgcttcgagtcatattcctgtaactttcagattgtcacaaatatcgacactgtttgcagtgtggatggcccctgtaccctgttccacaaccggcttatcatttctgcgacgaaacagagctacggttttaagatgtcctgccctagaaaaccagaacccacagaggagttccagatctgcaataggaagtacaacgtactgttcaccactattgacaagaatgataaaatagaaatcaacaccggggaccaaacatcatatatttacgagaaggataatcgctgtaaaacttggttgtgccgagtgcgggacgaaggaatctctgtcatctttgagccgctcaaggccttctttggcagctatttcagtattatattttacgtggttgtgggtatcattgtcctgttcctaaccatctatatttttctgcctatgttctttaaacttcgtgatatcctcaagagaaacgaatacctgtatttgcaggagctgaagcataaatga

SEQ ID NO: 10921 - RNA, 4311 nt, synthetic construct
  misc_feature 1..4311: note = derived and/or modified CDS sequence (opt3) from MAGV(CbaAr 426)__KX100110.1__GP
  source 1..4311: mol_type = other RNA
atgaagatgatcctgctcattataatcctttgcgtgaacctggccgctgcaaatcccgtcgccaccagatgtttccacggcgggcagttgattgcggagacaaggagcgctacttccatctctgaattttgcttaaaagacgatgtttcaatgattaagagtgagatcacgtacaccaaaaacgacacaggaatattcggtcatagcaagatctataaatcctggctgattaaggattggaagctatgtaatcctgtgccaactgccggcgggtctatcaacgtaattgaagttaattcggacctctcactgaccacaaaagcatacgtctgcagccgggattgtaccatcactatagacaaggaggaagcccaaattatctttcagacagataaacttaaccacttcgaggtgagtggaaccacgctgtcctctggctggtttaagactaaagctagcgttaccttggaccgcacatgcgagcatattaaggtgacttgtggtaagaaaaccctccagttccacgcatgctttcgacatcacatgtcctgtgtccgtttctttcacaatacaatcctgccggggaccatggtgaactcaatgtgccagaatatcgaactgattataatcctcggattaacgctgattatcttcactcttatggtaatattgacaaagacctatatttgttacatcctgatgcccctatttatgcctatcgcctatgcttacggctgggcctataacaaaagttgcaagaaatgcaattgttgcggcctcgcgtaccatccattcactaactgtgggagccactgcgtttgtggactgaagtttgaggcatctgatagaatgaggattcatcgggaatccggtctttgccaaggctacaaatcactgcgcatcgccagattgctctgtaagagcaaggggagttctctgattatatccacattactgagcatgctccttctgtcgttcatcacccccattgagggaacgatgaccaattatcctgagacaaggcagtactctttggaagagatcgctgacgtggtcgaaggcctactgtccgagcagaacatcaaagaatatgtggtgttctacacttcactctttggtagtctgattcttctgttggccttcatactcagcatcaccctgacaaaggtcactaatgcattagctcggaccaacgttatttattgcgaggagtgttccatgtaccacgccaaaaaggggatcaaatataacggagattttacaaataagtgcggcttctgtacctgcgacgaacaggaggatgaagagggcattatcatacacaaggtgtctaaaaagtgcacttaccgctaccaactgcagtgggcgaaaatcattatgatcattctagtaatgctcctgatgatgcagaacacgatccttatagtggccgcagaaacagactgttggaccaagaatagcttggagctggactgcattgggccactcctgactatctcagattgtagtaacaaagagtccaagaattatgaagaggaagctgccaaacttgtcagccagtctaaaattacccaagctgacgccgaacaggtgacaatcctgggaaacaccatagatactgcattgaaggccatccgatcacagaaaacataccaaacgatgcatctcctggaaagtgtgtttttaatgaagaattgcgactattacagctccttcgagcacaactctggttattcgcaggctaaatggagactgattgcgaagaccagccattttgatatctgttccaggcactcaatgcatcacttctgccggtgtgtggcagacggcactaagtgccagaatggggattgggactttgccggagagatgaacaatacatacagtaccaaaaacgatttctatctacacgacctcaatctgtttttcacacttcatgaaactgcttttcccggcaccacggagtctttgttctaccagctgattgccaagaaaaacaccacaggtgcaagcaagctcctggggaaattaatcactaagtacggcaattccaaactgttcgtcggaatatggaagtttggccaatatcttttgaccctcccttacgtgaacacaactgaactgtcaaagacccgtcgcgagacgattctaaaaacacaccagatcctgaccagaagccaagggggaaggtctgagtccatgagtagcgccgaagtaggtcagatcgctaaggagtgtgccaacgcaaagaatgttggctgcatttctccacggttcgggatcccgattggaaacctcactgcgtgtggcaattcccccaactataagatatacaaaacacctaataagatctataagtcaaacaatcgaggtgaagtgtggtgcagtgaggatgtccattgcctggctgactttgaaccagccgacaccgaggtggtcaacaaagtgaagaaaatgacttgtttccttagcgatgttaatacccgcgcagacatcttttcgattgccatttccgcttgcagaatggtggataagggggtatgtacagtcaacggcgccaaatggaatatcttgaagtgcgagtctggactgtactatttcacggaccacagggaaggccaggataccgggaacgactttggagagtactgtataagccactcatgcaatactgaacggtaccccatcaaccctgatattttaaaggagtgtatctgggaatatcatagtcgcaaatccaagtacatttctacaatcaatctcgagagcctggaggagttcaaaagagcaatgtccgacaaactttcacacaccctgatggtgtataactttaaaccaacagctaacttgccccatataaagccgagctacaagttcattactgccaatggtatcgagaacagtgatggcctcgaatctgcgtatatcctgtccagcattcctgccatagggggaatgtcgatcggctacaatattcagaccaaagacaactttcccctactggatctcatcgttttcgtgaagtcagctgtcattaaaacgacatataatcacatctacgacaccggtccaactatagggatcaacaccaatcatgatgagcactgcacaggcccttgtcccactattatcccacacaaggaaaactggctgaccttttctcaggagaggacaagtcgttggggatgcgaggagttcggctgtcttgcaattaatacggggtgcgtgttcggatcctgccaggacgtaatccatcccgaaaccaaaatataccggaaggccgtggaagaggaggttgtcttgactgtgtgtattaactttcctggcaatacattctgcaccgaaatcaacgctatcgagccaaaaattactgacgaaatcgagctgcaatttaagacagtggataccaagacgttaccgaatctcctggccgtccagaaccacaaactttatagcggtcagataaatgacctggggtctttcagccagggatgtggcaacgttcaaaagactaaccagtccattctaggtgcaggcaccgtgaaatttgattacgtgtgccatggggcgtcacgaaaggacatcattgtaagaaggtgttatacaaataactacgatagttgcaaactcctgaaggaggaacgcagcttgatcttcgccgacaatcacgagaccctggaagtcgctaacactcggcatttaataggagagctccagtttaagattatgctgggcgatatcagatataaagccttcgcagaaaagcccgagcttgaaatcgacgctaaatgtgtggggtgcccttcttgttttgagtcctactcatgcaatttccaaattgttacaagtatcgataccgtgtgtagcgtcgagggaccatgcacactgtttcacaacaggattataatcactgccgcaaagcagtcctatggcgtgaaaatgtcttgcaagaccaagcccggtcctgttgaagagttcacgatttgtaatcgcaactaccgagtgtcgttcgccacaatcgacaaaaatgataagatcgaaattaacaccggggaccagactagctacatagtagagaaagattcacggtgcaagacctggttgtgtcgtgtcagagacgaaggaatctccgtgatttttgagccactcaaggctttctttggcagttatttctctatcgcgttttacattatcataggtatcgccgcactgttcctaattatctatatttttctgcccatgttctttaaacttagggacgtgctcaagaagaatgagtacctgtatttgcaggaactgaagcacaaatga

SEQ ID NO: 10922 - RNA, 4305 nt, synthetic construct
  misc_feature 1..4305: note = derived and/or modified CDS sequence (opt3) from MAGV(CoAr 3363)__KX100107.1__GP
  source 1..4305: mol_type = other RNA
atgctgagcctccttatcctggccttcttgggcttatccacctctaaccccattgctacaagatgctttcacgggggacagctgatagcagagtcaaagagtgccactagcatctccgaattttgtctaaaagacgatgtgtctatgctcaagtcggaggtcgtttacacgaaaaatgacaccggtctgtttggccataacaaggtgttcaggtcatggacaattaaagattggaaactttgcaatcctatcccaactgcgggaggaaccattaacgtaatcgaagtgaataaggacctgagcttgatgacaaagacctatatatgtagtcgggattgcactatcacaattgacaaggaggaagctcaaatcatttttcagaccgataaactcaaccacttcgaggtctccggcacgactctgtctagcggttggtttaagtccaaagcctcagtgaccctggaccgcacatgtgagcatgttaaggtgacttgcgggaagaaaagtctccagttccacgcatgttttaagcatcacatgagctgcgtccgattctttcacaataccatcttaccgggaaacatgataacatctatgtgtcagaatattgaactgatcattatccttggcttgaccctggccatcttcattctaatggtgatgctcacgaaaacttacatatgctatctgcttatgcccatctttatgcctattgcttacctgtatggctgggcatacaacaagtcctgtaaaaagtgcaattgctgtgggttggcctatcatccattcacaaactgcggatcacactgtgtatgcggtctcaaattcgaggctagcgatcgtatgagaatccatagggaaagtggcctgtgtcaagggtacaagtctttacggatagcccgcctgctctgcaagtccaaaggaagctcgcttgttatttctggcctgttgtccatgctaatcctgtcatttgtgacccccatcgagggtactattacaagttaccctgagagcagaaagtataccctcgaagagatcacggacgtcgtggaagggctggtgtccgagcagaatattaaagaatacatagtcttctatacctctctttttggaagcctgatcttgctcctggcgttcattatgtcaatcacattaagtaagatcacttccattctggcaaggcggaacgttatatactgtgaggagtgcagcatgtatcactctaaacgcggcatcaagtacaatggcgattttaccaacaagtgtgggttctgcacatgtaacgaacaggaggacgccgaagggctagtgattcacaaagtatcaaagcgatgcacttataaatgccagctcaagtgggctaaagtgctgatgatcacccttgtcttgctgctcattgcccaaaatacaatcctgatagtggcagctaagaccgattgttggactaagaaaagtcttgacatcgactgcattggtccaatgctggatatcggcagctgtacgaacaagaatacaagatcctacgacaccgaggcccagaaattggttactcagtctaaggtgtcgcagctcgatgcggaccaagccagcctgttagggtcctcaattgatagtgcaatcaaagctataaggacccagaagacataccccaccatgcatctgctagaaactatttttctcatgaagaactgcgactattacacatctttcaatcacaacagcggatattcccaggcccggtggcgtctgatcgctaaaacgggccattttgatatttgttcacgccacagcacccatcacttctgcagatgtatctctgacggtactaagtgccaaaatggggattgggactttgccggcgagatgaacgagccttacaattccaaaaacgatttctatcttcacgacttgaatctgttttacacaatattcgaaaacgcattcccaggaaccacagagagtctcttttatcagctgatccagaagagggacactaccggcgccagcaaagtcttagggaagctgattacgaaatacggaaataacaatatgttcgtgggtgtatggaagtttggccagtaccttttgaccctcccgtatatcaacaacacagaactgtctcaaaatcggaagcagactattctagctacccaggagcccctgtcccgatcacatcctgggcgccaggaaagtatgagctcggcgatccaaggatccgttacaaaagagtgtcacaacgcaaaggatgtgggctgcatatctccaagattcggtattcccatcgggaatctcactgcctgtggcgacagccctaactacaaaatctataagaccccagagaaactgtacaagtcaaataacaagggagaagtctggtgcagtaatgatgtgcattgccttaacgactttgagcccgctgatgaagaggtcgtgaataaagttaagaaattgacgtgtttcctgacagacgtgttagtaaagaccgatattttctccgtcgccgcatctacttgcaaaatggccgacaagggcatctgtacagtgaacgatgctaagtggaatattataaaatgcgacagcgggctctattacttcaccgatcacagggagggacaggacactggtaacgattttggcgaatattgtatctcccactcatgcaataccgagcggttcccgattaaccctgacatcctgaaggactgtacatgggaatttcatagccgcaaaagtaagtacatttctacgatctcccttgagagcctggaagagttcagaagggccatggcagagaaattgtcgcacaccctcactatatacaattttaagcccacagcgaacctgccacatatccgtcctacctataagttcattacagctaacggggttgaaaattcagatggaatcgagtctgcctacattctaagttccatccccgcactgagcggcatatctgtgggttataacgtccagactaaagacaatttcccactcctggatattatcgtgtttatcaagagcgccgtaattcggaccacgtacaaccacatatatgacacagggcccaccatcggcattaatactcagcatgatgaacactgcaccggaccttgtccagctgtggttccgcacaaagagaactggatcacattctcccaagaacgaacttcaagatggggctgcgaggagtttgggtgtcttgccattaataccggatgcgtcttcggcagttgccaggacatcatacatcccgaaacaaaggtgtacaggaaagcagtggaggaagaggtcgttttgacggtgtgtatcaactttcctggtaataactattgcaccgaaattaatgctatcgagccaaagattactgatgagatcgaactgcagttcaaaacagtggacaccaagactttacccaacctcctggccgtacagaatcacaaactttacagcgggcaaataaacgatctgggatctttttcccagggctgtggtaatgtccagaagacaaaccattcaattctaggcatggggaccgcgaagttcgactacgtgtgccacggagccagtcgcaaagatgttatcgtgcggagatgttataacaataactttgacagctgcaagctcctgaaagaggaaacgtccttgatcttcgctgataatcatgagactctggaggtcgcacacaccaagcacttaattggcgaactccaatttaagatcatgctgggggacataaggtacaaatctttcgccgagtcgcctgaacttgagattgacgctaagtgtgtgggatgcccaagctgtttcgaatcatattcctgcaactttcagatcgttacaaatattgataccgtgtgtagtgtagagggcccctgcactctgttccataaccgcatcataatttctgccaataaacagagctacggtttgaagatgtcctgccagacaaaaccgaaccaaaatgaggaatttatcatctgtaaccgaaagtattcagtcctcttcaccacaattgacaagaatgataaaatcgaggtgaacactggggaccagacctcttacatttatgaaaaggatagccggtgcaaaacgtggctgtgtcgtgtgagagacgagggaataagtgtcctatttgaacctctgaaggcattctttggctcctacttcagcatcatcttttacgttgtgattggtatcattgtacttttcctcatagtgtatatctttctgccaatgttctttaaattgaaggatgtcctgaagaaaaatgagtacttatatctccaggagctgaagcacaaatga

SEQ ID NO: 10923 - RNA, 4305 nt, synthetic construct
  misc_feature 1..4305: note = derived and/or modified CDS sequence (opt3) from MAGV(OBS 6657)__KX100116.1__GP
  source 1..4305: mol_type = other RNA
atggagctgctcatcattatacttctgttgggcagcgccgcttcctctcccgtgtcaaccagatgcttccacgggggacagttaatcgcagaaagtaagagcgccacatccatttctgagttttgtctgaaagacgatgtctcgatgatcaagtcagaagttacttacacgaaaaacgacaccggtatttatggccataataaggtgttcaggagctggacaatcaaagattggaagctatgcaaccctataccaactgctgggggaagtatcaatgtaattgaggtgaactccgacctctctctggcgaccaaggcctacgtctgtagccgggattgcacaatcaccattgacaaagaagatgcacaaatcatatttcagactgacaaacttaatcacttcgaggtgtccggcacaaccctgtcaagtggttggtttaagacgaaggccagcgttactttggatcgcacctgtgagcatattaaagtgacatgcgggaagaagtctctccagttccacgcttgttttaaacatcacatgtcctgcatccgattctttcaccatactattctgccgggaaccatggtctcaagcatgtgtcagaacatcgaactgatcattataatcggcctcacattagtgctgttcattcttatggtaatcttgaccaagacgtatatatgctacctgctaatgcccatttttatgcctatcgcatatatctacggctgggcctataataaaagttgtaagaaatgcaactgctgtgggctcgcttaccacccattcactaattgcggatctcattgtgtttgcggtctgaagtttgaggcctccgaccgtatgaggattcacagagaaagcggcctttgtcaagggtacaaatcgctgcggatcgcgcgcatgttgtgcaagtctaagggatcctcactcgtgattagtggcctgttaagcatgctgctcctttccttcataacacccatcgagggtaccctgactaactatcctaatgagagacagtacacattggaagagattgcagatgtcgtggaagggatcctaaccgagcagcacctgaaagaatatgtggtcttctacacgtctctctttggaggcctgatccttctgttgaccctcattctgagcataacaatcaacaaggttactgacttactggcctcaaccaatgtgatttattgtgaggagtgcagtatgtaccattccaaaaagggcatcaaatataacggggatttcacaaataagtgtggattttgcacttgtagcgaacaggaggacattgaaggtgtagtgatccacaaggtctctaggaaatgcacctacaagtaccaactaaaatgggtgcgggttataatgatcattctcgctctgcttttgacactgcagaacaccgtgctcatcgtcgccgcagaggtggactgctggactaagaaatcaattgaaatcgattgtataggcccactgcttaacattgggacgtgcacagacaagagtagccgcacctatgagactgaggtaaataagctggttcgacagtccaaagtgacccaggctgatgccgaacaagtctctatcttgggatcgacactcgacagcgcgattaaggccatcagatcccagaaaacctacgagactatgcatttcctggaaacagtgtttttaatgaagaactgtgattattactcaagtttcgagcacaattctggctatagccagacgaaatggaggctgatagcaaagacctcccattttgacatctgctcacggcacagcgctcaccatttctgtcgttgcgtcaacgaaggtactaagtgtcaaaatggggattgggactttgcccgcgagatgaacgatacatacaattctaaaaacgacttctatctacacgatctcgacctgttttacacccttttcgagaatgcttttcccggcacaactgaatccttgttctaccagctgctccagaagaaaaacaccacgggagccagtaagctgttaggcaaactgattaccaagtatgggaataacaatcttttcgtgggaatctggaaatttggtcagtacttgctcaagctgccttatattaacgacacagagctaagcactgatagaaagtctaccatcatgaaatcccaacagatgctgtcaaggagtcagacaggccggcaggaaagcctctcgtccgcaactccagggaccgccacgaaggagtgctctaatgctaaagacataggatgtattagcccgcgattcggcatccccatcggtaacctgacagcgtgcggggattcacctaactacaagatttataaaaccccagagaagatctacaagagtaataacaaaggcgaagtttggtgttccgacgatgtgcattgccttgcagactttgagcccgccgaagaggaagtagtcaatcgcattaagcaaatgacttgcttcttgacagatgtgaccactaaaaccgacgtgttttctgttgctataagcacatgtaagatggccgataaaggagtctgcacggtgaacgacgcaaagtggaatatcctgaagtgtaactccggcttatattacttcaccgatcacagagacgggcaggatactggaaatgactttggtgagtactgcatttcacacagctgtaacacagagaggttccctatcaatccagacgtactcaaagattgcatttgggaatatcatagtcggaagtctaaatacatctccaccataagcctggagtcgcttgacgaatttcgcagagccatgtcagataagctgtctcacacattgatgatctataacttcaaacccactgctaatctcccgcatattaagcctacctacaagtttatcacggccaacggcattgagaatagtgacgggatcgattccgcatatatactgagctctattcccgcgctaggaggcatgagcgtgggttacaacgttcagacaaaagacaatttcccactgctcgatatcatcgtctttattaagtccgctataatcaaaaccacttataaccacatttacgacaccgggcctacaatcggcattaacactcagcatgatgaacactgtaccggaccctgcccaacactgatcccccacaaggagaattggcttacgttctcacaagagaggaccagtcgttggggctgtgaagagttcgggtgcttggccataaacactggatgtgtgtttggcagctgccaggacatcattcatcctgaagcaaaagtgtaccggaaggccatcgaggaagaggtcgttctgacagtgtgcattaccttcccaggtaatacttattgtacagagatcaacgctatagaaccgaaaattaccgatgagatcgaattacagtttaagacggtggacactaagaccctccccaatctgcttatggtacagaaccacaaactgtactctgggcaaatcaatgatctaggatccttctcacagggctgcggtaacgtccagaagacaaatcaaagtgtgattggcaccgggactgccaaatttgactatgtttgtcatggagcaagccgaaaggacgtgatcgtcagaaggtgctacaacaataactatgagtcctgtaaactcctgaaggaggaatcttcgttgatattcgctgataatcacgagacactggaagtggccaacaccaagcatttaattggcgagctccagtttaaaatcatgctgggggacattcgctacaagagcttcgcggaatcacctgagcttgaggttgatgccaaatgcgtgggatgtccatcctgctttgaaagttattcttgtaatttccagatcgtaacaaacatagacactgtctgcagcgtggatggcccctgtaccctgtttcacaaccggttgattatctccgctgcaaagcagtcatacggtctcaaaatgtcttgcagcagaaggcctgagcaaacggaagagttccagatctgcaatcgcaagtacagtgtgctgttcacaaccattgacaagaacgataaaatcgaaattaatactggggaccagacctcctatatatacgagaaggataaccgatgtaaaacatggctatgccgggtccgtgacgagggaatcagcgttatttttgaaccactgaaggccttctttggctcttatttctcaatcatcttttacgtgattgtaggtataatcgtgcttttcctcattatctatatttttctgcccatgttctttaaattgagagatatcctgaagaggaatgagtacttatatctccaggaactgaagcacaaatga

SEQ ID NO: 10924 - RNA, 4302 nt, synthetic construct
  misc_feature 1..4302: note = derived and/or modified CDS sequence (opt3) from NORV(0234)__EU004188.1__GP
  source 1..4302: mol_type = other RNA
atgatctggttcattctgctccttgccatagctcccagctttggcacccctatcgcaacaagatgcttccacgggggacagctgattgccgaggcgaagtcccaaacttctatctcagaattttgtttgaaagacgatgtgagtatgattaagagcgaggtcacgtacaccaaaaacgacacaggtatcttcggccattccaaggtttataggtcttggactataaaagattggaagttatgcaatccagtgccgaccgtagggggatcgatcaacgtgattgaagtcacagctgacctgtcactaagcaccaaggcctacgtgtgtagtcgggattgcactatcacaattgacaaagagggcgcacagatcgtttttcagaccgataagctcaatcacttcgaagtgtccggtacgactctgtctagcgggtggtttaaaaccaaggcctccgtcacacttgaccgcacttgtgagcatataaaagtgacctgcggaaagaagacactgcagttccacgcttgttttaaacatcacatgtcatgcattcgattctttcacaacaccatcttgcccggcagtatggtagcaagcatgtgtcaaaatattgagctcatcatcattctgggcctgacgctcataatcttcattttaatggccatcctgactaagacatatatatgctaccttttgatgcctatttttatgccaatcgcttatgcctacgggtgggcgtataacaaatcttgtaagaaatgccattgctgtggactggcataccaccccttcaccaattgcggttcccattgtgtttgcggcctaaagttcgaagcctcagatcgtatgagaatccacagggagagcgggctctgtcagggatacaaaagtctgcgggtggctcgccttctgtgcaagtctaagggctccagcttggtcatttcgatcctcctgtctatgttaattctgtcctttgtgactcctatagaaggtacactcaccaactatccagagtcaagaaggtacacgcttgaggaaatcgccgacgtggtcgaggggattatcgcagaacaggatctgaaagagtatatcgttttctacaccagtttgtttggaagcctaattctgctcctggctttcatactttccgtgacactgactaaggtattggacctcctggccaaaaccaatgtgatctattgtgaagagtgctctatgtaccacccccggaagggcattaaatataacggcgattttacaaataagtgtgggttctgcacttgtgacgagcaggaagacgtcgagggagtgatcattcataaggttagcaaaaagtgcacctaccgctaccaagtgaaatgggcgaagatcataatgatcattgtcgtgatcttactgatggcccagaacacaattctaatcgtagcagctgaaaccgattgctggactaaaaagtcactcgagctggactgtataggtcctcttttgaatattggcagttgctccgggaaggaagcccgaacgtatgagacagaggttaaaaagctggtgagccagtctaaagtcacccacatcgatgctgaacatatttcaatcctcggagccactatagacagtgcaatcaagagcattagagcccagaaaacctacgctacaatgcatctgcttgagaccgtgtttctgatgaagaactgtgattattacactgtcttcgaacacaattccggctattctcaagcgaagtggaggttgatcgcaaaaacaaaccactttgacatttgctcgcggcacagcgcccatcacttctgtcgttgcatcaacgatgagacgaagtgtcagaatggtaactgggactttgctggggaaatgaataacacctactccactaaaaaggatttctatcgccatgacctcgatctgttttacacaatattcgagaatgccttcccaggctcaaccgagagtttattttaccatctgctacagactaaaaacacaaccggagcatctaggattctcgaaaagctgagcacgaaattcggcaataacaatatgtttgtggggatctggaagttcggacaatatcttttgaccctgccgtacgttaacgagacagaactctccccctcaaggcagagcactatcctgaccaattctaactccttaagtcggagcacaggtcgacaggagtctctgtcctcagccattcctggcccaaatactaaggagtgcagtaacgctcgcgacgtggggtgtatcagccccagatttgggattcctataggcaatcttaccgcctgcggtgaatcgccatcctataaaatctacaagacgcccgagaaattgtataagtctaacaacaaaggggaaatttggtgtagcgacgatgtacactgcctcaagaatttcgagccggcaacagaagagatcgtcaacaggattaagcagatgacctgctttctgactgacgtgtcaacaaaaaccgatatcttcagtatagcgacttccacctgtcggatggttgacaagggcgtgtgcacagtcaatgatgctaaatggaacatcctaaagtgtgactctggactgttttacttcacggatcaacgcgagggccaggacaccgggaatgattttggagaatattgcattagccactcctgtaacactgagagattccctatcaatcccgacattctcaaagattgcacatgggaataccactcaagaaagagcaagtacatcagtaccatatctctggagtcccttgacgaatttcgtcgggccatgagcgataaattgtcgcatacactgatgatttataacttcaagccaactgcaaatttacctcacatcaaacccacctacaagttcatcacggccaacggtattgaaaattcagacggcctcgactctgcttatatagtgagttccatcccagccctgggaggaatgagcgtaggctacaacgtgcagacaaaagataattttccccttctggacattatcgttttcattaagtctgcagtcatccgaaccacttataaccatatatacgataccggtcctacaatcgggattaatactcagcacgacgagcactgtaccggcgcttgcccaacacaaatcccgcataaggataactggttgacgtttagccaggaaagaacctccaggtggggatgtgaggagttcggctgcctcgccattaacactgggtgtgtgtttggatcatgccaggacatcatacaccccgagacaaaagtgtatcgcaaggcgatggaagaggaggtcattctgaccgtttgcgtgactttccctggcaatacatactgtaccgaaatcaacgccatcgagccaaaaattacggatgaaatcgagctacagtttaagactgtggacaccaaaacactgcccaatatactcgctgtacaaaaccataagctgtacagtggtcagattaatgatcttgggagcttctctcagggatgcggcaacgtccagaaaaccaatcaatccatcttgggtactggcacagcaaagtttgactatgtgtgtcacggggcctcacggaaggatattatcgttagaaggtgctacaacaataaccatgacagttgtaaactgttaaaggaggaaaccagcctcatattcgctgataatcacgagacactggtggtcgccaacactaaacaccttattggagaactgcagtttaagatcatgctaggcgacatccgctataaatccttcgcagagtctcctgaactcgagattgacgcgaagtgcgtggggtgtccatcgtgcttcgagagctactcatgtaattttcagatcattaccaacatagatacggtttgctccgtgagtggaccctgtacactgttccataatcgattgatcattaccgccactaagcaatcttatggcatcaaaatgagctgcccgaccaagcctgaaggtacagagacttttgaaatctgcaacaaacagtacaagattttctttaccacgatagacaaaaacgataagatcgagattaatacaggggaccagacctcctatatctacgaaaaggataaccggtgtaaaacttggctgtgccgtgtaagagacgagggaatttcagtcttattcgagccactcagggcctttttcggctcttactttagcatcatattctatgctgtggtgggtatcattatcctgtttcttgcagtctacattttcctgcccatgatctttaagttgcgcgatatgctcaaaaagaatgaatatctgtacctacaggagagtaaacacaagtga

SEQ ID NO: 10925 - RNA, 4305 nt, synthetic construct
  misc_feature 1..4305: note = derived and/or modified CDS sequence (opt3) from PLAV(75V3066)__KX100122.1__GP
  source 1..4305: mol_type = other RNA
atgctgttcctccttatcctggcctttttgggcttcagcacctccaaccccattgctacaagatgctttcacgggggacagttaatagcagagtctaagtcagccacgagtatcagcgagttctgtctgaaagacgatgtgtccatgctaaagtctgaagtcgtttacattaaaaatgacactggtctctttggccataacaaggtgttcaggtcgtggaccatcaaagattggaagctgtgcaatcctattccaacagctgggggaactatcaacgtaatagaagtgaataaggacctttcactgatgaccaaaacatatatctgtagccgggattgcaccattactatcgacaaggaggaagcgcaaattatctttcagacagataaattgaaccacttcgaggtcagtggcaccacgctctcctctggttggtttaagagcaaagcctccgtgactctggaccgcacctgtgagcatgttaaggtgacatgcgggaagaaatcactgcagttccacgcatgttttaagcatcacatgagttgcgtccgattctttcacaatactatactcccgggaaacatgattaccagcatgtgtcagaatatcgaattaattatcatcctgggccttacattggccattttcatactgatggtgatgctaaccaaaacgtacatctgctatctcctgatgcccattttcatgcctatcgcttacctttatggctgggcatacaacaagtcttgtaaaaagtgcaattgctgtgggctggcctatcatccatttactaactgcggatcccactgtgtatgcggtttgaaattcgaggcttcagatcgtatgagaatacatagggaaagcggcctctgtcaagggtacaagagtctgcggattgcccgcttactgtgcaagtctaaaggatccagcctcgttatctcgggccttctgtctatgttgatcctatcctttgtgacacccattgagggtaccatcacttcataccctgagagtagaaagtatacactggaagagattaccgacgtcgtggaagggctcgtgagcgagcagaatataaaagaatacatcgtcttctatacgtccctgtttggatctcttattctgttgctcgcgttcatcatgagcatcaccctgtcaaagattacaagtatattagcaaaaaggaacgttatctactgtgaggagtgctccatgtatcacagcaagcggggcattaagtacaatggcgattttactaacaaatgtgggttctgcacctgtaacgaacaggaggacacagaaggactggtgatccacaaggtatctaaacgctgcacttataagtaccagctaaaatgggccaaggtgctcatgattaccctggtccttttgctgatcgctcaaaatacaatactcatcgtggccgcagagaccgattgctggactaagaaatcactggacattgactgtatcggtccaatgcttgatattggcagttgcacgaacaagaatacacgaagctacgacgctgaagcccagaaactggtttcccagtctaagatctcgcagttggatgcggaccaagtgagcctcctggggaactccatagattcagccattaaagcaatcagagctcagaagacctatcccactatgcatttactggagaccatttttctaatgaagaattgtgactactatacaaacttcaatcacaacagtggatactctcaggccaaatggaggctcatcgctaagaccggccattttgatatatgcagccggcactccactcatcacttctgtcgttgcatcaatgacggtacaaaatgtcaaaacggggattgggactttgccggcgagatgaatgaaacgtataactcaaagaatgatttctacagccacgacctgaaccttttctataccatttttgagaatgcattccctggaactacagaatctttgttttaccagctgatccagaaaaagaacaccacaggcgcctccaaagtcctcgggaagctgattactaagtacggaaacaataacatgttcgtgggtgtatggaaatttggccagtatttactgacccttccatacatcaataacacggagttgagtcaaaatcgcagactcaccatactggctacacaggaaattctaagcaggtctcattccgggcggcaggagtcaatgagtaacgcgatccagggaagcatcactaaggagtgccacaatgcaaaaggcgttggttgtatttcgccgcgattcgggatccccattggcaacctgaccgcctgcggagactcccctaattataagatatacaaaacaccagaaaagctctataagtctaacaataaaggcgaggtgtggtgtagcaacgatgtccattgcctgaatgactttgaacccgctgatgaggaggtgatcaacaagattaaaaagctgacttgcttcttgaccgacgtctcagtggaagttgatatctttagtgtggccgcatccacgtgtaaaatggccgacaagggggtatgcacagtcaatggagctaagtggaacattatcaaatgtgattctggtctgtactatttcaccgaccaccgcgagggccaagatactgggaacgactttggagaatactgcataagccactcctgtaatacagagagattccctatcaacccagataccttaaaggactgcacttgggaatttcattcaaggaaaagcaagtacattagtaccatctctctcgagtccctggaggagttccggcgcgccatggcagaaaaacttagccacacactgacgatttataatttcaagcccaccgcgaacttgccgcatatcagacctacttacaagtttataacagctaatggcgtggaaaactcggatggtattgagtcagcctatatcctctctagtatccccgcacttgggggcatttccgttggatacaatgtgcagaccaaagacaacttcccactactggacataatcgtctttattaagagcgccgtgatcaggacaacttataatcacatttacgataccggccctacgatcgggataaacacacagcatgacgaacactgtaccggaccctgcccagctgtagtgccccacaaagagaattggatgactttctctcaggagcgtaccagccggtggggctgtgaagagtttggttgcctcgccatcaacacagggtgtgttttcggatcctgccaagatattatccatcctgaaactaaggtctatcgaaaagcagtggaggaagaggtggtcctgaccgtttgcattaattttccaggcaactcatactgtacagagatcaatgctatagaaccgaagattacggacgagatcgaacttcagttcaaaaccgtggatactaagacattgcccaacctgttagccgtgcagaaccacaagctctacagtggtcagatcaatgacctgggcagcttttctcaagggtgcggaaacgtacagaaaaccaatcattccattcttggcatggggactgtcaagttcgattatgtgtgtcacggagcgtcaagaaaagacgttacagtgaggcgctgctacaacaataactttgatagttgtaagctgctaaaagaggagaccagcctcatcttcgccgacaatcatgaaacgctggaggtcgctcacactaagcacttgataggcgaactgcagttcaagattatgttaggtgatatccggtataaatcctttgcagagtctcctgaactcgagattgacgccaagtgcgtggggtgtccatcgtgcttcgagagctactcatgtaactttcaaatcgttaccaatatagatacagtgtgctccgtagaaggaccctgtaccctgttccataacagaattatcatcagtgctaataaacagtcttatggccttaagatgagctgccagactaaacctaaccagaatgaggaatttattatctgcaacaggaagtactccgtcctgttcacaaccattgacaagaatgacaaaatagaggtgaacacaggtgatcaaacttcatatatctacgaaaaggactctcgctgtaaaacctggttgtgccgagtgcgggatgagggcattagcgtcctctttgagccactgaaggccttctttgggagttacttctccatcatcttttatgttgtggtaggaattatagtgctattcctgatcgtctacatttttcttcccatgttcttcaaactcaaggacgtgctgaagcgtaatgaatatttgtacctgcaggagttaaaacacaagtga

SEQ ID NO: 10926 - RNA, 4305 nt, synthetic construct
  misc_feature 1..4305: note = derived and/or modified CDS sequence (opt3) from PLAV(75V5758)__KX100128.1__GP
  source 1..4305: mol_type = other RNA
atggagctgctcatcattatacttctgttgggcagcgccgcttcctctcccgtgtcaaccagatgcttccacgggggacagttaatcgcagaaagtaggagcgccacatccatttctgagttttgtctgaaggacgatgtctcgatgatcaaatcagaagttacttacacgaagaacgacaccggtatttatggccataataaagtgttccggagctggacaatcaaggattggaaactatgcaaccctataccaactgctgggggaagtatcaatgtaattgaggtgaactccgacctctctctggcgaccaaggcctacgtctgtagccgcgattgcacaatcaccattgacaaggaagatgcacaaatcatatttcagactgacaaacttaatcacttcgaggtgtccggcacaaccctgtcaagtggttggtttaagacgaaagccagcgttactttggatcgaacctgtgagcatattaaggtgacatgcgggaaaaagtctctccagttccacgcttgttttaagcatcacatgtcctgcatccgtttctttcaccatactattctgccgggaaccatggtctcaagcatgtgtcagaacatcgaactgatcattataatcggcctcacattagcaattttcatcctgatggtgatacttaccaaaacgtatatttgctacttgctgatgcccgtatttatgcctatcgcctatatctacggctgggcttataataagagttgtaaaaagtgcaactgctgtgggctagcctaccacccattcactaattgcggatctcattgtgtttgcggtctcaaatttgaggcgtccgacagaatgaggattcaccgggaaagcggcctgtgtcaagggtacaagtcgcttcgcatcgcaagaatgctgtgcaaatctaagggatcctcattggtgattagtggcctcctgagcatgttactgctctccttcataacacccatcgagggtacccttactaactatcctaatgagaagcagtacacactggaagagattgccgatgtcgtggaagggatcatgaccgagcagcacttgaaagaatatgtggtcttctacacgtctctatttggaggcctgatcctcctgcttaccctgattttgagcataacaatcaacaaggttactgacctcctggcttcaaccaatgtgatttattgtgaggagtgcagtatgtaccattccaaaaagggcatcaaatataacggggatttcacaaataagtgtggattttgcacttgtagcgaacaggaggacgtagaaggtgtggtcattcacaaggtgtctaggaaatgcacctacaagtaccaattaaaatgggttcgggtgatcatgataatcctggccctactcctgacaattcagaacaccgtccttatcgtggcagctgaggtagactgctggactaagaaatcaattgaaatcgattgtataggcccattgctgaacattgggagttgcacggacaagagcggaaagacatatgagaccgaggttaataaactcgtgcgccagtccaaggtcactcaggccgatgcggaacaaatctctgtgctgggcaacacccttgactcggccattaaagcaatccgaagccagaagacatacgagaccatgcatttcctggaaactgtctttttgatgaaaaattgtgattattactcctcattcgagcacaacagtggttattctcagacaaagtggagactcatagctaagacgagccattttgacatctgctccaggcactcagcccaccatttctgtcggtgcgtgaatgaagggaccaaatgtcaaaacggcgattgggactttgctggagagatgaataacacttacaatagcaagaacgatttctatctgcacgacttagatctgttttacacactattcgagaatgcctttcccggcaccacagaatctctcttctaccagctgcttcagaaaaagaacactaccggggcatccaaattgctgggaaagctcattacgaaatatggtaataacaatatgttcgttggcatctggaagtttgggcagtacctgttaaagctgccttatattaacgacaccgagcttagtgccgaccgtaaaagcacaatcatgaagtctcaacaggtgttgtcccgctcacagactggaagacaggaaagtctcagctcggctaccccaggcacagcgactaaagagtgctccaacgcaaaggatataggttgtatttctccgaggttcgggatccccatcggcaatctgaccgcctgcggagacagccctaactacaaaatttataagacgccagagaagatctacaaatcaaataacaagggcgaagtatggtgtagtgatgacgtccattgcctagctgattttgagcccgccgaagaggaagtggttaatcggattaaacaaatgacatgcttcctgaccgacgtgactacaaagaccgatgtcttttccatagcagtgtctacttgtaaaatggtagacaagggggtgtgcaccgttaacgatgccaagtggaatatcctcaaatgtaacagcggactgtattacttcacagaccaccgagatggtcaggacacgggcaatgattttggggagtactgcatttcccactcatgtaacaccgagcgcttccctatcaatccagacgtccttaaggactgcatttgggaatatcatagcagaaaaagtaagtacatctctactatatccttggagagcctggatgaatttaggcgggctatgtcggacaaattatcacacacactcatgatctataacttcaagcccaccgccaatctgccgcatattaagcctgcatacaaatttatcacagcgaacggaattgaaaattctgatggcatcgacagtgcttatatactttccagcattcccgccctgggtgggatgtctgtgggctacaacgtgcagactaaggataacttcccattgctcgacatcatcgtctttattaaaagcgcaataatcaagaccacgtataatcacatttacgatacaggacctaccatcggcattaacactcagcatgacgagcactgtaccgggccctgcccaacactgatcccccacaaagagaattggctaactttctcccaagagcgcacctcaagatggggatgtgaagagttcggctgcctggccataaacacaggttgtgtttttgggagttgccaggatatcattcatcctgaagctaaggtgtacaggaaagccatcgaggaagaggtggtactcacggtctgcattaccttcccaggaaatacttattgtacagagatcaacgcaatagaaccgaagattaccgacgagatcgaactgcagtttaagactgtggatacaaaaacccttcccaatttgctgatggttcacaaccataagttatacagcggccagatcaatgacctcggttctttctcccaaggctgcgggaacgtgcagaaaacgaatcagtcagtcattggagctggcactgtgaagtttgattatgtttgtcacggggccagtcgtaaagacgtgatcgtacggcgatgctacaacaataactatgagagctgtaagctgcttaaggaggaaacctccctgatattcgcggacaatcatgagacactagaagtcgccaacaccaaacacctcattggagagctgcaatttaagatcatgttgggcgatattagatacaaatctttcgctgaatcgcctgagctggaggtggacgcaaagtgcgtgggttgtccaagctgctttgaatcatattcctgtaacttccagatcgtcactaatatagatacagtttgcagtgtgaacgggccctgtaccttatttcacaataggctcattatctctgccacaaaacagagctacggactgaagatgtcctgctcacgcaagcctgagccaactgaagagttccagatctgcaaccggaaatactctgtacttttcaccacgattgacaagaatgataaaatcgaaattaacacaggcgaccaaaccagctatatatacgagaaggataatagatgtaaaacttggctgtgcagggtgcgcgacgagggtatcagtgtcatttttgaacccttgaaggctttctttggctcctatttcagcatcatcttttacgtgattgttgggataatcgtcctcttcctgattgtgtatatctttctaccgatgttctttaagctgcgagatattcttaaacggaacgagtacctctatctgcaggaattgaagcataaatga

SEQ ID NO: 10927 - RNA, 4317 nt, synthetic construct
  misc_feature 1..4317: note = derived and/or modified CDS sequence (opt3) from POTV(89-3380)__EU004189.1__GP
  source 1..4317: mol_type = other RNA
atggagccccctatgaagctgttcctcatccttgccaccgctgtggcagccgtctacagcctgccagcgtccagatgcttttctgacggcattataatcaaagaaaagcaggattcaaaagctgttagtgagttctgtttgaaggacgatgtgagcatgattaaatcccacgtagtgtattctaagaacgaatcggggatctttgccaattcacaaattttaaggaagtggatcataaaagactggaagctgtgcagcccgctacccacagcaggaggtcagatcaacgtcattgagatcaatcatgatctcactctgagtacgaaaacctacgtgtgtacaactgactgcaccattggcatcgataaggaaaacgcccagataacattccagaccaataaacttaactattttgaggtttccgggactacaatttctagcggatggttcaagtccaagacctcagtgagtctggaccaaacgtgtgagcacttgaaagtcagctgcggcaagaaatctatgcagtttcatgcttgtttcaagcagcacatgtcctgcatccggtacctccataaaactgcactgcctggttatatggccgcttcaatttgtagcaatatcgaactgatcattatgaccacactcactttagccatatttatcctgctttgcattatcaccaagacatacatatgttatttgctgatgccactattcatgcccattgcgtacatctacgggtggctctataacaaaagttgcaagaagtgcaattgttgcggactgtcttaccacccttttaccaactgtggctcctattgcgtgtgtggcgcaaaattcgagacgagcgatcgcatgcgaatccaccgtgaatcggggctttgccagggatacaagtctctgagagtagccaggaaattgtgtaagtccaaaggttcaagtctcgttattagcgtgactctgtccgtctttatcttctctttcattacaccaataggcggggtgatcattaatgacaagttaagcgaggagaagtattcaatcaaccaaatgatggatgctatcgtggacctggaaaattttagtcataacgtctccggaacccagcaggttattagcgtgatattcctccttatctcttgcctgtttttgctactgacttaccggctcaataaaattatccagcacctggcccgctcaggccttctgttctgtgaggaatgcagtatgtatcatagcaagaaagatattaagtacaacggtgactttacaaacaaatgtgggttctgcacttgcggacaacccgaggaccctgaaggcttgaatctccacatcctgtcccagaactgtacgtacaagcagcaatttaagtgggtaaaaataatcatttctatcttactgtcgctaattatcatagagagctccatgattctcgcagctgccgagaccgattgcttctcagaaaagcagatcagtgagttttgtctgggcccacttttgtctattagctcctgcgaagacaaaaattcaagaacattcaagggggaggcgcagaaactggtggccctcaagaagatcactagcgatgaagcaatgctgatagagtctatgggagctaaagtcgaggacgcccttaagatgatccaggctcaaaaatccccggatagtatgtataccatggaatacgtgtttctgaacacatattgtgactactatagcttgttcgagcacaattctggttactcccagattaagtggaggtatatcctcaaaactcatcagtttgatgcctgcgcacggcactcaaacaatcatttctgtcgctgcatgagtgacggcatgcactgtcccagcctggattgggacattgccgatgaattaaacaatacctacatcacaaagcctaacttctttaaacatgactacaatctgctactcgacgttataaccgctgcgttcccagggactggagcagtgtttgtcattgatgcctgcaagaaggctaacgccacggcaatcaaaacattctcgaataacatcattgcccgatttccctataataacctgcttaagggcgtgatgaaattcttgcagtacatctccaagcacccttcttttaaaaagtatcaaccagacaccagacactacgatctgattcccgtagctccgactgccaggggtcggagcctcgggcgttcaaacagttattccgacgcacaggttggccctcccaccaaggattgtcagaaactgaaggaggtgggatgcttatctccaaaattcggcctgcctcttgaaagcataatctcctgcgggtcaagccccaattacaagttgtataaaaagccacagaagtactacaaaagtaacaataaggagaacacatggtgttctaaagacgtccattgcctccacgattttgagcccattaccgaagacgtgctggagaaggtcaaagtgatgacttgttgggaaatcgagcctggaacaattgaggatatcttcacgatagcgtccgaaacctgcaagatcaatgaccgcggtgtttgtgaggtgaacgctgccaagtggaaaattgtaaagtgcgaaactggcctatattactatacagatcatagagagggggacgataccggaagcgacctgggccactactgtctcacacacaaatgcgccggtgggaggtatccaatcaatccggaaattctgcaaaactgtatctgggagtttcattcgcagaagtcacagtacataaatcaggtcgaccttgagcaaattgaagagtataaaaaggcattgactgaaaaactgacccacacgttaaaccattacaatttcctccccaccaagaacctgcctcacatctctccaaattacaagtatgtgacacttaacggccaggagaccagtgatggaatcgaaaattcctacattgttagcgagatacccgctatcgccggcacctctattgggctgaaagtgcagacaaagaacaacggaaatatctttgacttgattatctatgtcaaacgggcagatataatcgctagctacaaccatatttatgacactggtcctaccatcggccacaatgtggagcacgaagaactctgcacggggcaatgtccacagcatattcccgccaaggcgaactggctgacattctcccaggaacgaacctcacgctggggatgcgaggagttcggctgcctagccatcaatactggttgtgtatacgggagttgccaggatataattaaaccggtggctaaggtttatagaaagagcacagaggagaaagtcgaactggagctctgtatcgtgctgcctgacaggaacttttgcaccactcttaatgcattggaaccaaagatcaccgaggagattgaactgcaattcaaaacaatcgatcaggtgtctttacccaacatagtcctcctgcgggaccacaagctgtttaaaggccagattaatgatctgggaacgttcggccagaactgtgggaatgttcaaaagaccaaccagtccatcctaggagccggcactgtgcgctttgactacctctgccattcagctagtagaaaggatattatcataaggcgttgttacaataacaattatgacagctgcaaccaccttcagttggccgagtccctgattttcttagataaccatgaaacactcgaggtgcggaaacctaatcacatcctgggtaccctttctatgaagctgatgttgggggactttcagtacaaaacattcgcaaaggacatcgaactcgattttactggacgatgtgtaggctgcattggttgtttcgagggctttgtctgcgagatgcacatcaccacgacagtggaagcgacctgcaacctggaggcctcgtgtcaattcttccataatcagctacacattaaacccgacgttctgaagtattacactaagatgacctgccagacagatgaatatataccaagcaaaatcaagatttgtaacaaagagtacaagatcactatcgggaaagtgagaaagaatgacaagattgaaatagataactcagaccaaacctcctatatcaaagagaaggatgagaggtgcaaaacatggctttgtcgcgtccgggacgaaggaattagtgtgatctttgagcctctcctgaatattttcggcaactacgggagaatcgctgttgccgtgatatctgcaatcttggctctgattgtattagtctacatcctcatgcccatttgcatgaagatcagggatatactgaaaacgaatgaaaaggagtttcttattgaaagcaaatataagtga

SEQ ID NO: 10928 - RNA, 4311 nt, synthetic construct
  misc_feature 1..4311: note = derived and/or modified CDS sequence (opt3) from TENV(TSV-FE3-66FB)__FJ943508.1__GP
  source 1..4311: mol_type = other RNA
atggagatcttctttattgccctgctcgctatagcaaacagcgtgaatagcactccccttgccacaagatgcttccacggcgggcagctgatcgcggaatctaagtcagctaccagtttgagcgagttttgtttaaaagacgatgtctccatgattaagtctgaaatctactatgttaaaaacgagacgggaattttctcgcataataaggtgctgaggtcatggaccatcaaagactggaagttttgcaaccctgtaccaacagccggtggcagcataaatgtgatcgaagtcaacagtgatatgtccctagcaactaagacctacgtgtgttctcgggactgcacaattaccatcgatcgcgaggaggcccaaattatcttccagactgaaaaactcaatcactttgaggttagcgggacaaccctgtcctcaggatggttcaagagtaaagctagcgtgacgcttgaccgaacttgtgaacatctgaaggtgacctgcggcaaaaagtctttgcagtttcacgcatgtttcaagcatcacatgtcctgcataagatttttccacaacacaatgctcccgggtcgtattgtcaattcaatgtgtcagaacatcgagctgattatcatcctggggctcactattgtaatatttatcttaatggttattctgaccaaaacatatatctgctacatacttatgcccttgttcatgcctattgcctatatctacggatgggcttataataagagctgtaaaaagtgcaactgctgtggcctggcctaccatccattcaccaattgcggcagtcactgtgtgtgcgggctaaaatttgaggcgtctgataggatgcggatccatcgcgaatccggactctgtcaaggttacaagagcctgagaattgcaaggcttctgtgcaaatcgaaggggtcttccttggtcatctcaattctcctgagtatgttactgctcagcttcgtgacgcccatagagggcgcccttactaactatcctcagtccaagctgtactctttggaagagatcgctgacgtggtcgaaggactaattacagagcacaatgttaaagagtatatcgtgttttacaccagcctgttcggcggtctcatcctgcttctggcctttattttgtcaataatgctcactaaggtaacaagtatgctggcacggaccaacgtgatctattgtgaagagtgctccatgtaccacagcaaaacggggattaagtataacggagatttcaccaataaatgtggcttttgcacatgtgacgaacaggaggatgctgaaggcatcattatccataaggtctctaagaaatgcacttacaagtaccagttaaaatgggcccgcataatcatgattatcctgattgtgctactcaccacacaaaacactatcctgatagttgcggccgaggtggactgctgggagcgagcaaccctttcacaggaatgtattgggccattgcagaagatcgaggattgccagaataaagaagagaagacatatatgagtgaagctaacaagctggtcagccaatccaaaattacccaggccgacgctgaccaggtgtctgtactcggagatactatcgactcggccataaaggcaatcagaagccagaaaacgtaccaaacaatgcatctgcttgagaccgttttcctgatgaagaattgtgattattactccacttttgagcacaactcaggttatagtcaggccaaatggaggttgatggctaagaccaatcacttcgacatttgctctcggcatagcaaccaccacttttgtcgttgcgtgacagaaggcaccaagtgtcagaatggggattgggacttcgcgggagagatgaactccacttacaatacaaaatcagatttttatcaacatgacctcaacctgttcttcagcttatacgaatctgcatttcccggcacggccgagtccctgttctaccagctaatcagtgagaagaataccactggtgctagccagctcctggggcagattatcaaaaagtttgccaacaataacatgcttataggcgtctggaaattcggacaatatttgctgacactcccttacgtgaacaccacaaagctgtctaaatcccgcgaagagactattttaaccaatcaccagagactggtcaggtcatatacgggccggcagcagagtatggcaaacgccgaagtgggggagagcaccaagaattgccttaacgctaagaatgttggatgtatctcgccacgatttggtgtgccgatcggcaacttgacagtatgcggggaatccactaattacaaagtctataagacccccgccaaaatttacaagtctaacaatcgccctaaaacatggtgtagcgaggatgtgcattgcctctcaaacttcgagccagcaagtgcggaagttgtgaataagatcaagagaatgacttgctttctgaccgacgtcacgacaaacgtggatgtattctccattgctatatctacctgtaaaatggccgacaagggagtgtgcactgttaatgacgcaaggtggagcatcctaaaatgtgattccggcctgctctattttacagaccaccgggagggtcaagataccgggaacgacttcggcgaatactgcatttcacacaattgtaacactgagcgctaccccatcaaccctgatattatcaaggactgcatatgggaatatcatagcagaaaaagtaagtacatctctgccattaatctggagtcccttgaggaatttaggcgtgctatgagcgagaagttgtcgcacaccctggtcatctataacttcaaaccaacagccaatttaccccatattaagccgtcatacaaatctatcacggtgaacggaatagaaaatagtgatggcattgagtccgcatatatcctcagcaacatccctgctattgggggaatgtctgtgggttacaatgtcctgaccaaggacggctttccccttctggatataatcattttcatcaaaagcgccgttattaagactacatataaccacatctacgacaccgggccaacaataggaatcaatactttgcatgatgaaaagtgtaccggcccttgcccctccattatcccacacaaagagaactggctcacgttctcacaggagcggacaagtcgatggggttgtgaagagtttgggtgcctggcgattaataccggctgtgtgttcggaagctgccaggacatcataagacccgaaactaagatttacaggaaagccgtggaggaggaagtaatcctaaacgcttgcatcaattttcctggcaacacctattgtacagagattaatgcaatcgaaccaaagataactgatgagattgaactgcagttcaaaaccgtcgacacaaagacgctcccgaacctgcttgccgtgcaaaaccacaaattgtactctgggcagatcaatgacattggaaccttttcccagggctgcggtaacgttcaaaagactaatcagacaatgctggggaccggaactgtgcgcttcgattatgtctgtcatggcgcttcacggaaggacatcatagtgagaaggtgctacaacaataactatgagagttgtaaattactcaaggaggaaaaatccctgatttttgccgataatcacgagacacttgaagttgcaaacacccgccatctgctaggtgagctccagttcaagatcatgctgggcgacatccgatacaaagcgtttgccgaaaagcccgagttggagattgatgctaagtgcgtggggtgtccttcctgcttcgaatcttattcgtgtaattttcagatcgtaagcaacgtcgacacggtgtgctacattgagggaccatgtactctgttccacaatcggataatcattaaaaccatgaagcaagcctacggcatcaaaatgtcatgcaagacaaaacccgcaccttccgaagagttcaagatctgcgggcgtacctataacgtggcttttaatactgtcgaaaagaacgataaaattgagataaatacaggagaccagaccagttacatctctgagaaggatgacagatgtaaaacatggttatgcagggttcgcgatgaaggcattagcgtgatcttcgagccactcaagaacctgtttggtaattatttcaacattgccttttacatcataatcgggcttattgcactgttcttgactatctatatttttctccccatgttctttaaactgcgggacgtactaaagagaaacgaatacctgtatcttcaggagctcaagcataaatga

SEQ ID NO: 10929 - RNA, 4311 nt, synthetic construct
  misc_feature 1..4311: note = derived and/or modified CDS sequence (opt3) from TENV(TSV-FL06)__FJ943506.1__GP
  source 1..4311: mol_type = other RNA
atggagatcttctttattgccctgctcgctatagcaagctccgtgaactctacaccccttgccaccagatgcttccacggcgggcagctgatcgcggaatcaaagagtgctactagcttgtccgagttttgtttaaaagacgatgtctctatgattaagtcggaaatctactatgttaaaaatgagacgggaattttctcatacaacaaggtgctgaggagctggaccatcaaagactggaagttttgcaatcctgtaccaacagccggtggcagtataaacgtgatcgaagtcaattccgatatgtctctagcaactaagacctatgtgtgtagccgggactgcacaattaccatcgatcgcgaggaggcccaaattatcttccagactgaaaaactcaaccattttgaggtttccgggacaaccctgtcaagtggatggttcaagagcaaggcttctgtgacgcttgaccgaacttgtgaacacctgaaagtgacctgcggcaaaaagtccttgcagtttcatgcatgtttcaagcaccatatgtcatgcataagatttttccacaatacaatgctcccgggtcgtattgtcaacagcatgtgtcagaatatcgagctgattatcatcctggggctcactattgtaatatttatcttaatggttattctgaccaaaacatacatctgctatatacttatgcccttgttcatgcctgtggcctacatttatggatgggcttacaacaagagttgtaaaaagtgcaattgctgtggcctggcctaccacccattcaccaactgcggctctcattgtgtctgcgggctaaaatttgaggcgtccgataggatgcggatccaccgcgaaagcggactctgtcaaggttataagtcgctgagaatcgcaaggcttctgtgcaaatctaagggctcctcattggtgattagtatcctcctgagcatgttactgctctccttcgtgacgcccattgagggggcccttactaattaccctcagtctaagctgtatagcttggaagagatagctgacgtcgttgaaggactaatcacagagcataacgtgaaagagtacattgtattttatacctcactgttcggcggtctcatcctgcttctggcctttatcttgagtattatgctcactaaggtgacatccatgctggcacggaccaatgtcatatactgtgaagagtgcagcatgtatcactctaaaacggggatcaagtacaacggagatttcaccaacaaatgtggcttttgcacatgtgacgaacaggaggatgctgaaggcattatcattcacaaggtgtcaaagaaatgcacttacaagtatcagttaaaatgggcccgcatcataatgatcattctgatcgttctactcaccacacaaaatactattctgatcgtggcggccgaggtcgactgctgggagcgagcaacccttagtcatgaatgtatagggccattgcagaagattgaggattgccagaacaaagaagagaagacatacatgagcgaagctaataagctggtgtcccagtctaaaatcacccaagccgacgctgaccaggtatcggttctcggagatactattgacagcgccatcaaggcaataagatcccagaaaacgtatcaaacaatgcatctgcttgagaccgtgttcctgatgaagaactgtgattactattcaacttttgagcacaatagtggttactctcaggccaaatggaggttgatggctaagaccaaccacttcgacatctgcagccggcattccaatcaccacttttgtcgttgcgtcacagaaggcaccaagtgtcagaacggggattgggacttcgcgggagagatgaactcaacttataatacaaaaagcgatttttaccagcatgacctcaatctgttcttctctttatacgaatccgcatttcccggcacggccgagagtctgttctatcaactaattagcgagaagaacaccactggtgcttctcagctcctggggcagatcattaaaaagtttgccaataacaatatgcttatcggcgtgtggaaattcggacagtacttgctgacactcccttatgtcaacaccacaaagctgtccaaatcacgcgaagagactaccttaacgaaccaccaaagactggtgaggagttacaccggccggcagcagagcatggcaaatgccgaagttggggagtcgacaaagaactgccttaatgctaagaacgtgggatgtatatccccacgatttggtgtaccgattggcaatttgactgtctgcggggaatctaccaactataaagtgtacaagacacccgccaaaatctataagagcaataaccgccctaaaacttggtgttcagaggatgttcattgcctcagtaatttcgagccagcatccgcggaagtggtcaacaagatcaagagaatgacctgctttctgacggacgtgacaaccaatgtagatgtgttctctattgctatcagcacttgtaaaatggccgacaagggagtttgcacagtcaacgacgcaaggtggtccattctaaaatgtgattcaggcctgctctactttaccgaccaccgggagggtcaggatactgggaatgacttcggcgaatactgcataagccacaactgtaataccgagcgctatcccatcaaccctgatattatcaaggactgcatttgggaatactatagtagaaaatctaagtacatctccgccataaacctggagagccttgaggaatttaggcgtgctatgtcggagaagttgtcacatacactggtgatctataatttcaaaccaacggccaacttaccccacattaagccgtcttacaaaagtatcaccgtgaatggaattgaaaactccgatggcatcgagagcgcatatatactctctaatattcctgctatcgggggaatgagcgtcggttacaacgttctgactaaggacggctttccccttctggatatcattatattcatcaaatccgccgtgattaagacaacctacaatcatatctatgacacagggccaactattggaatcaacaccttgcacgatgaaaagtgtacgggcccttgcccctcaataatcccacataaagagaattggctcacattcagtcaagagcggaccagccgatggggttgtgaagagtttgggtgcctggcgattaacactggctgtgtgttcggatcttgccaggacatcattagacccgaaaccaagatctacaggaaagccgtagaggaggaagtcatactaaatgcttgcattaactttcctggcaatacatattgtactgagatcaacgcattcgaaccaaagatcaccgatgagattgaactgcagtttaaaacagtggacacgaagaccctcccgaatctgcttgccgttcagaaccacaaattgtactccgggcaaatcaacgacataggaactttctcacagggctgcggtaatgtgcagaagacaaaccaaaccatgctggggactggaacagtccgctttgattatgtgtgtcacggcgctagtcggaaggacattatcgttagaaggtgctacaataacaattatgagagctgtaaattactcaaggaggaaaaatccctgattttcgccgataaccatgagacccttgaagtggcaaatacgcgccatctgctaggtgagctccagtttcgaatcatgctgggcgacatacggtacaaggcgttcgccgaaaaacccgagttggagattgatgctaagtgcgtagggtgtccttcttgctttgaatcgtacagctgtaacttccagatcgtctcaaatgtggacactgtgtgctatatcgagggaccatgtaccctgttccacaaccgtgtcattatcaagacaatgaaacaggcctacggcattaagatgtcctgcaaaaccaagcccgcacctagtgaagagtttaaaatatgcgggagaacttataatgttgctttcaacacagtggaaaagaatgataagatcgagattaacaccggagaccaaacatcttacatcagcgagaaagatgacaggtgtaagacttggttatgccgcgtacgggatgaaggcatctccgtgatttttgagccactcaaaaatctgttcggtaactattttaatatagccttctacatcattatcgggcttattgcactgtttttgaccatctatatattcctccccatgtttttcaagctgagagacgtcctaaaaaggaacgaatacctgtaccttcaggagctcaagcacaagtga

SEQ ID NO: 10930 - RNA, 4305 nt, synthetic construct
  misc_feature 1..4305: note = derived and/or modified CDS sequence (opt3) from TLAV(61D240)__KX100119.1__GP
  source 1..4305: mol_type = other RNA
atgctgttcctccttatcctggcctttttgggcttcagcacctccaaccccattgctacaagatgctttcacgggggacagttaatagcagagtctaagtcagccacttccatcagcgaattttgtctgaaagacgatgtgtccatgctaaagtctgaggtcgtttacacgaaaaatgacaccggtctctttggccataacaaggtgttcaggtcgtggacaattaaagattggaagctgtgcaatcctatcccaactgctgggggaaccattaacgtaatcgaagtgaataaggacctttcactgatgacaaaaacctatatatgtagccgggattgcactatcacaattgacaaggaggaagcgcaaatcatttttcagaccgataaattgaaccacttcgaggtcagtggcacgactctcaattccggttggtttaagtctaaagccagcgtgaccctggaccgcacatgtgagcatgttaaggtgacttgcgggaagaaatccctgcagttccacgcatgttttaagcatcacatgtcatgcgtccgattctttcacaacaccatcctcccgggaaatatgataacaagtatgtgtcagaacattgaattaatcattatcctgggccttaccttggccatcttcattctgatggtgatgctaacgaaaacttacatatgctatctcctgatgcccatcttcatgcctattgcttacctttatggctgggcatacaataagagctgtaaaaagtgcaactgctgtgggctggcctatcatccatttacaaattgcggatctcactgtgtatgcggtttgaaattcgaggcttccgatcgtatgagaatccatagggaatcaggcctctgtcaagggtacaagagcctgcggatagcccgcttactgtgcaagagtaaaggatcttccctcgttattagcggccttctgtcgatgttgatcctatcttttgtgacccccatcgagggtactattacatcctaccctgagtcaagaaagtataccctggaagagatcacggacgtcgtggaagggctcgtgagtgagcagaacattaaagaatacatagtcttctataccagcctgtttggatcccttatcctgttgctcgcgttcattatgtctatcacactgagcaagatcacttcaattttagcaaggcggaatgttatatactgtgaggagtgcagtatgtatcactccaaacgcggcatcaagtacaacggcgattttaccaacaagtgtgggttctgcacatgtaatgaacaggaggacgccgaaggactggtgattcacaaagtaagcaagcgatgcacttataaataccagctaaagtgggctaaagtgctcatggtcaccctggtgcttttgctgatcgcccaaaacacaattctcatcgttgcagctggtaccgattgctggactaagaagtctctggacatagactgtatcggcccaatgcttgatattgggtcatgcacgaataaaaacacaagaaattacgacaccgaggcccagaagctggtgagtcagagcaaagtctcccagttggatgcggaccaagcctctctcctgggaaactcgatcgatagcgcaattaaggctatcagggcccagaaaacttatcccaccatgcatttactggaaacaatatttctaatgaagaattgtgactactatacctccttcaaccacaattcaggctacagtcaggctaagtggcggctcattgccaaaactggtcattttgatatctgctctcgtcacagcacacatcacttctgtcgctgcattaacgacgggacgaagtgtcaaaatggcgattgggactttgcaggagagatgaacgagacctataattccaaaaacgatttctactcacacgacctgaatcttttctatactatctttgaaaacgccttccctggcacaaccgagagcttgttttaccagctgatacagaagaaaaacacaactggggcttctaagatcctcggaaaactgattaccaagtacggtaataagaacatgttcgtgggcgtatggaaatttgggcagtatttactgacgcttccatacatcaataacaccgaattgtcccaaaatagaaggcagacaattctcgcgactcaggagagtctgagccggtctcattccggacgacaggaatcaatgagtagcgcaatccaaggctcggttaccaaggagtgccacaacgccaaagacgtgggttgtatatccccgcgcttcgggattcccatcggcaatctaacagcttgcggagattctcctaactataagatctacaaaactccagagaagctgtataagagcaataacaaaggcgaagtctggtgttcaaatgacgtgcattgcctcaacgattttgagcccgccgacgaagaggtcgtgaataaggttaaaaagctgacctgcttccttacggatgtgagtgtaaaaacagacatttttagtgtcgcagcctctacctgtaagatggctgataagggggtgtgcactgttaacgacgccaaatggaatatcattaagtgtgatagcggattgtactatttcacagaccacagagagggtcaggataccggcaacgactttggggaatactgcatatcccactcatgtaacactgagaggttccctatcaatccagatattctgaaagactgcacctgggaatttcatagccggaagagtaaatacatctctacaatttccttagagagcctcgaagagttccgcagagcaatgacggagaagctgtcgcacacccttactatctataacttcaagcccacagcgaatctgccgcatataaggcctacctacaaatttatcacagctaacggagtggaaaattcagacggcattgagtctgcctatatcttgagttccattcccgcactcggtgggatcagcgtcggctacaacgtgcagactaaggataatttcccactgctagacataattgtatttatcaaatctgccgtgatccgtaccacgtataaccacatttacgatacaggacctaccataggcatcaatactcagcatgacgaacactgtaccgggccctgcccagctgttgtcccccacaaggagaactggattacattcagccaagaacggacttcccgatggggatgtgaggagtttggctgcctggccatcaataccggttgtgtgttcgggtcatgccaggatattatccatcctgaaacaaaagtgtatagaaaggcagtcgaggaagaggttatactcacggtgtgcatcaactttccaggaaataactactgtaccgaaattaatgctatcgagccgaaaattactgacgagatcgaactgcagttcaagacagtggataccaagactcttcccaacttgctggccgtacagaaccacaaattatacagtggccaaataaatgacctcggtagcttttctcagggctgcgggaacgtccagaagacaaatcattccattctgggaatgggcaccgcgaaattcgattatgtgtgtcacggggcctcaaggaaggacgttatcgtgcgccggtgctacaacaataactttgatagttgtaaacttctgaaggaggaaacgagcctaatcttcgctgacaatcatgagactctcgaggtcgcacacaccaagcacctgattggagaattgcaattcaaaatcatgctgggcgatataagatataagtcctttgccgagtctcctgaattagagattgacgctaaatgcgtgggttgtccatcgtgcttcgaaagctactcatgtaactttcagatcgttacaaatattgacaccgtgtgctccgtagaggggccctgtactctcttccataacaggatcataattagtgccaataagcagtcttatggactgaaaatgagctgccagacaaagcctaaccaaaatgaggaatttatcatctgcaaccgcaagtactccgtccttttcaccacaattgataaaaatgacaagatcgaggtgaacactggcgatcagacctcatatatttacgaaaaagactctcgatgtaagacgtggctgtgccgggtgcgtgatgagggtataagcgtcttgtttgaaccactcaaagcattctttggcagttacttctccatcattttctatgttgtggtagggatcatcgtgctgttcctaattatatacatctttctgcccatgttcttcaaacttaaggacgtcctcaagagaaatgagtatctgtacttgcaggagctgaagcacaaatga

SEQ ID NO: 10931 - RNA, 4305 nt, synthetic construct
  misc_feature 1..4305: note = derived and/or modified CDS sequence (opt3) from NRIV(9800535)__AY593725.1__GP
  source 1..4305: mol_type = other RNA
atgctgctccttctggtgttgttaatcccctgctacgtcagcgcctcccctgttgtgaccagatgtttccacggcgggcagctgattgctgagaagaaatctcaaacagcagtatcagaattttgcctaaaggacgatgtgagtactataaaaagcgagatcacgtatgaaaagaacaataccggactcttcgcccattccaaagtcctgaggaactggattatcaaggactggaagaattgtaacccagtgccgacagcgggtggctctattaatgttatcgaggtgaacactgatctttcgctgaccacaaaaacctacgtctgctcacgggactgtactataacagtggataaggaagacgctcagatcatttttcagaccgagaaattgaatcacttcgaggtaagcgggacgactctcagttccggatggtttaagaccaaagcctctgttacactggatcgcacttgcgaacatatcaaggtgacctgtggcaagaaaacactgcagttccacgcatgctttaagcatcacatgagctgtattcgattctttcacggtaccatcctccccgggacgatggccacttccatatgccaaaacattgagttaatcattatcatctcactgacacttattatattcatcttgatgattatcctgaccaaaacttatatatgttacctactcatgcctctgtttatgccaattgcttatttctacggatggagttataataagagctgcaaaaagtgctcttgttgcggccttgcataccatccctttacaaactgtggctcccactgcgtctgtgggctgaaattcgaagcctcagaccgtatgagaatccatagggagagcggattgtgccagggttacaagagtctccgggtggctcgcctgttatgtaagtctaaaggctccagcctggtgatctcgattctcctttctatgctgatcttgtccttcgtcacccctattgaggggacgctaaccaattatccagaatcaagaaagtacgatctggaggaaatagccgacgttctcgagggatttatcgtggaaaaaggcattaaggagtatgtagtgttctacacaagtatctttggtgcgctgcttctgttgatcgcactcgtcattactataaccctgaacaaagtgacagagtatttaactaatatcaacgttctgtactgctatgaatgtagcatgtaccactccaagaagaatattaaatacatcggggatttcaccaacaagtgcggattttgtacatgcggcgagctagaagaccaggagggcctcaaaattcacaaggtgtctaggaaatgcatctataagtaccagctgacctggagcaagataatcatgactattcttgtctgtttgctgatcgcccaaaacacgattctcatcgtggctgcctcagatgactgctggactaaaaagagtctggaaatggagtgtatagggccccttcagcaggtagatacctgcgacgacaaagcatcccggagctattctggagaggctcgcaagctggttcgagcctcaaaaattagtgatttggacgcggcccaggtgggtctcctgggcagcactatcgaatccgcaattgcttctatcagaaagcaaaggacctaccctacaatgcatttactggagtcggtcttcctagggaagcactgtgattattacaaaacctttgaacataatagcggatattcccaggccaagtggcggctcactgctaaaacacaccatttcgacatatgctcacgtcacagtacgcaccatttttgtcgctgcatctctgatggcaccaagtgtcagaacggtgacctggatttcgccggggagatgaatagcacttaccaatccaaaaaggactttttcgaacacgattttaaacttttctgcacattggtggagaacgcattcccaggcaccacagagtcactgttttacgaaatgctcagcaagaagaatactaccggaattaaacagctgttagacaagctgacgagaaaattcggcaacaataacatgtttgtcgggatctggaagttcggacagtatcttatgtctttgccgtacattaatgagacctccctcacacccgcccagatcagtaaaatactggaagtgactgaccaacatcacaggagcatttctggtcggcaggagtccctagcttcagcgacccctggcagtaagagcaaggagtgtgggcacgccaaaaaggtttcgtgcatctccccacgattttctgtgcccatggaaggactgatggcatgcggcgatagccctaactataaaatctacaagacaccaactaaactctataagtcaaataacaagggtgaggtatggtgtagtggggacgtccattgctcccaggaactgtctcccgctagccaggagtccgtggatcgcattaaacaaatcacctgtttccttacggaaccggaggtttcagacgatgtgtttagcattgccataagtacatgcaaggtccaggacaaaggcgtgtgtaccgtaaatgaggatagatggaacgtgatcaagtgcgactctggattgatttactatactgatcagagggacggccaggatacagggaatgacttcggagaatactgtctgtcccacagctgccggatcgagcgctttcctattaaccccgcaatcataagagattgtttatgggaataccattcgaggaaatcaaagtatatcacctctctcgacctggagaaccttgaagagttcaagcgtgccattagtgagaaactgtcccacactttgatcgtttacaattttaagccaaccgctaacctccctcatattaaacccgtctataagtacatcacagtgcaaggtgtggaaaatagcgacggcgtcgattctgcctatatagcagcgagcatgccagctctgtccgggacgtcaattggatacaacatcatgagtcgggacaatttccccctatttgatatcattatattcatcaaaagcgccattatcaaggcaacctataaccacatttacgacactggccctacaatcggtataaatgttatgcacgatgagcattgcaccgggcagtgtccaacagacatcccgcacaaagaaaactggattactttcgcccaggagcgaacctctagatggggctgcgaagagtttggatgcctggctgtgaatacgggctgtgtgttcgggtcctgccaggatatcattaggcccgagacaaaggtataccgcaaggccgtcgaagagtcagtgctcctgaccgtttgtatcacttatcctggaaaaaccttttgcacagaaataaacgcaattgagccaaagatcactgacgagcttgaattgcaattcaaaaccgtggatacaaagacgctgcccaatatcttagctgtccagaaccataaactctacagtggccagattaatgacctgggtagcttttcccaagggtgtggaaacatccagcggaccaattcttcgataattggcactggtacagccaagttcgattatgtgtgccacggcgcgagcagaaaggacatcattgttaggcgctgttacaacaacaattatgagtcatgcaaacttctgaaggaagaacagtccctaatgtttgccgataaccatgaaaccatcgacgtggctaatgtacgacacctcctgggggacttgcagttcaaactgatgttaggagatctccggtacaagagttttgcagagaaccctgacctggagatagaagccaaatgtgtcggctgcccatcttgtttcactagctattcctgctcatttaagattgcttctaatatcgatacagtgtgcagcatcgaggggccctgtaccacgttccacaaccgtcttatgattacaagtaccaagcaagactacggaatcaaaatgtcctgcaagacaaaaccgaaggaaaccgaggagttccagatttgtaaaaagacttacacagtgctgtttaccacagtcgagaagaatgataaaatagagatcagcactggcgaccagacctctttcattcaggaaagagatgacaggtgcaagacgtggttgtgtcgcgttcgggatgagggtatctcagtgatctttgaacctattagagccttctttgggtcctatttcagtatagcattttacgtagtgatcagcattatcgtcctcttcctggcgatttatatctttctaccaatggtgttcaaactgagggacgttcttaagcgaaacgagtacctctatctgcaagaaataaaacataagtga

SEQ ID NO: 10932 - RNA, 4305 nt, synthetic construct
  misc_feature 1..4305: note = derived and/or modified CDS sequence (opt3) from NRIV(GSA/TS7/5170/WT)__KM514677.1__GP
  source 1..4305: mol_type = other RNA
atgctgctccttctggtgttgttaatcccctgctacgtcagcgcctcccctgttgtgaccagatgtttccacggcgggcagctgattgctgagaagaaatctcaaacagcagtatcagaattttgcctaaaggacgatgtgagtactataaaaagcgagatcacgtatgaaaggaacaataccggactcttcgcccattccaaggtcctgcggaactggattatcaaagactggaagaattgtaacccagtgccgacagcgggtggctctattaatgttatcgaggtgaacactgatctttcgctgaccacaaagacctacgtctgctcacgcgactgtactataacagtggataaagaagacgctcagatcatttttcagaccgagaagttgaatcacttcgaggtaagcgggacgactctcagttccggatggtttaaaaccaaggcctctgttacactggatcgaacttgcgaacatatcaaagtgacctgtggcaagaagacactgcagttccacgcatgctttaaacatcacatgagctgtattcgtttctttcacggtaccatcctccccgggacgatggccacttccatatgccaaaacattgagttaatcattatcatctcactgacacttattatattcatcttgatggtcattctgaccaagacttatatctgttacctactcatgcctctgtttatgccaatagcttatttctacggatggagttataataaaagctgcaagaaatgctcttgttgcggccttgcataccatccctttacaaactgtggctcccactgcgtgtgtgggctgaagttcgaagcctcagacagaatgaggattcatcgggagagcggattgtgccagggttacaaaagtctccgcgtggctagactgttatgtaagtctaagggctccagcctggtcatctcgatcctcctttctatgctgattttgtccttcgttacccctatcgaggggacgctaaccaattatccagaatcaaggaaatacgatctggaggaaattgccgacgtgctcgagggatttatagtagaaaagggcatcaaagagtatgtggtcttctacacaagtatttttggtgcgctgcttctgttgatggcactcgtgatcactatcaccctgaacaaggttacagagtatttaactaatattaacgtgctgtactgccacgaatgtagcatgtatcactccaaaaagaatataaagtacatcggggatttcaccaacaaatgcggattttgtacatgcggcgagctagaagaccaggagggcctcaagattcataaagtctctcggaagtgcatctaccgctatcagctgacctggagcaaaattatcatgactatacttgtgtgtttgctgatcgcccaaaacacgattctcatcgtagctgcctcagatgactgctggacaaagaagagtctggaaatggagtgtattgggccccttcagcaggttgacacatgcgatgacaaagcatcccgaagctactctggagaggctaagaaactggtgagagcctcaaagatcagtgatttggacgcggcccaggtcggtctcctgggcagcactatagaatccgcaattgcttctatcaggaaacaacggacctatcctacaatgcacttactggagtcggtgttcctagggaagcattgtgattactataagacctttgaacacaatagcggatactcccaggccaaatggcgtctcactgctaagacacatcacttcgacatttgctcacgccacagtacgcatcacttttgtagatgcatctctgatggcaccaaatgtcagaacggtgactgggatttcgccagcgagatgaactccacttatcaatcaaagaaagactttttcgaacatgattttaagctgttctgcacacttgtcgagaatgcattcccagggaccacagagagcttgttttacgaaatgctgtctaaaaagaatactaccggcataaagaacctcctggacaaattaacgaggaagttcggaaataacaatatgtttgtgggcatctggaaattcgggcagtacctgatttcccttccgtatgttaacgagaccagtttgacacccgcccaggtgagcaagatcctcgaagtaactgaccagcaccaccggtctatttccggacgacaagagtcactggctagtgcgaccagcggttcgaaatccaaggagtgtggccatgcaaagaaagtctcttgcatcagccctcgcttttcagtgccaatggaagggctaatggcctgcggagatagtcccaattacaagatatataaaacccctgctaagctgtacaaatccaacaataagggcgaggtttggtgttctggtgacgtgcactgcagccaggaactctccccagcctcacaggagagcgtcgatagaattaagcagatcacttgtttcctgaccgaacccgaggtgagtgacgatgtattttctatcgcaatttccacgtgcaaagtgcaagacaagggggtttgtacagtcaacgaggataggtggaatgtgatcaaatgcgacagcggccttatttattacaccgatcagcgggacggacaggatactggcaacgacttcggggaatattgtttgtcgcattcatgccgcatagagagatttccgatcaaccctacaattatctctgattgtctgtgggaataccacagtaggaagtccaaatacattaccagcttagacctcgagaatctggaagagttcaagcgtgccatctctgagaaacttagccatactctgatagtgtataactttaaacccaccgctaatttgccacacatcaagcctgtctacaaatatattacagttcagggagtggaaaactccgacggtgtggattcagcctacatcagtgcaagcatgcccgcgctctctggcacgtccattgggtataatatcatgtcacgggacaacttcccactgtttgatataattatcttcatcaagagtgctattataaaagccacctacaatcacatctatgacactggacccacaattggcatcaacgtaatgcatgatgagcactgcaccggtcaatgtcctacagacattccacataaggaaaattggatcactttcgcacaggagcgaaccagcagatgggggtgcgaagagtttggctgcctagccgtcaacacgggatgtgtgttcggctcctgccaggatataatcaggccggagacaaaagtttaccgcaaggctgtggaagagtctgtcctgctcaccgtgtgtattacttaccccgggaagaccttttgcacagaaatcaatgccattgagcctaaaatcactgacgagctggaacttcagttcaagaccgttgatacaaaaacgttgccaaacatactggcagtgcaaaatcacaagttatattcgggacagattaacgacctcggcagcttttcacagggttgtgggaatatccaaaagaccaactccagtatcattggaactggcacagctaagttcgattacgtatgccatggtgcctctcggaaggacatcatagtcagaaggtgttataacaataactacgagagctgcaaactgcttaaggaagaacagtccctgatgtttgcggataatcacgaaaccattgacgtggccaacgtgcgccacctactcggcgacctgcagttcaaattgatgctgggggatttacgatataagtcatttgctgagaatcccgacctcgagatcgaagcaaaatgtgtcggatgcccttcttgtttcactagctacagttgctcctttaagattgccagcaacatcgatacagtttgctctatagagggcccatgtaccacgttccataatcggctgatgattacttcaaccaagcaggactatgggatcaaaatgtcctgcaagacaaaacccaaggaaaccgaggagttccaaatctgtaaaaagacttacacagtgctttttaccacagtagagaagaacgataaaattgagatcagtactggagaccagaccagcttcattcaggaacgtgatgacagatgcaagacgtggctgtgtagggtgcgcgatgagggcatatcggtcatctttgaaccgattcgggctttctttggttcttacttctccatcgccttttatgtggttgtgatcattatagtcttgttcctcgcaatctacatttttctgcctatggtgttcaaactaagagacgttctgaagaggaatgagtatctttacctccaggaaatcaaacacaagtga

SEQ ID NO: 10933 - RNA, 4305 nt, synthetic construct
  misc_feature 1..4305: note = derived and/or modified CDS sequence (opt3) from NRIV(TND/S1/19801/WT)__KM514679.1__GP
  source 1..4305: mol_type = other RNA
atgctgctccttctggtgttgttaatcccctgctacgtcagcgcctcccctgttgtgaccagatgtttccacggcgggcagctgattgctgagaagaaatctcaaacagcagtatcagaattttgcctaaaggacgatgtgagtactataaaaagcgagatcacgtatgaaaggaacaataccggactcttcgcccattccaaggtcctgcggaactggattatcaaagactggaagaattgtaacccagtgccgacagcgggtggctctattaatgttatcgaggtgaacactgatctttcgctgaccacaaagacctacgtctgctcacgcgactgtactataacagtggataaagaagacgctcagatcatttttcagaccgagaagttgaatcacttcgaggtaagcgggacgactctcagttccggatggtttaaaaccaaggcctctgttacactggatcgaacttgcgaacatatcaaagtgacctgtggcaagaagacactgcagttccacgcatgctttaaacatcacatgagctgtattcgtttctttcacggtaccatcctccccgggacgatggccacttccatatgccaaaacattgagttaatcattatcatctcactgacacttattatattcatcttgatggtcattctgaccaagacttatatctgttacctactcatgcctctgtttatgccaatagcttatttctacggatggagttataataaaagctgcaagaaatgctcttgttgcggccttgcataccatccctttacaaactgtggctcccactgcgtgtgtgggctgaagttcgaagcctcagacagaatgaggattcatcgggagagcggattgtgccagggttacaaaagtctccgcgtggctagactgttatgtaagtctaagggctccagcctggtcatctcgatcctcctttctatgctgattttgtccttcgttacccctatcgaggggacgctaaccaattatccagaatcaaggaaatacgatctggaggaaattgccgacgtgctcgagggatttatagtagaaaagggcatcaaagagtatgtggtcttctacacaagtatttttggtgcgctgcttctgttgatggcactcgtgatcactatcaccctgaacaaggttacagagtatttaactaatattaacgtgctgtactgccacgaatgtagcatgtatcactccaaaaagaatataaagtacatcggggatttcaccaacaaatgcggattttgtacatgcggcgagctagaagaccaggagggcctcaagattcataaagtctctcggaagtgcatctaccgctatcagctgacctggagcaaaattatcatgactatacttgtgtgtttgctgatcgcccaaaacacgattctcatcgtagctgcctcagatgactgctggacaaagaagagtctggaaatggagtgtattgggccccttcagcaggttgacacatgcgatgacaaagcatcccgaagctactctggagaggctaagaaactggtgagagcctcaaagatcagtgatttggacgcggcccaggtcggtctcctgggcagcactatagaatccgcaattgcttctatcaggaaacaacggacctatcctacaatgcacttactggagtcggtgttcctagggaagcattgtgattactataagacctttgaacacaatagcggatactcccaggccaaatggcgtctcactgctaagacacatcacttcgacatttgctcacgccacagtacgcatcacttttgtagatgcatctctgatggcaccaaatgtcagaacggtgactgggatttcgccagcgagatgaatagcacttatcaatcaaagaaagactttttcgaacatgattttaagctgttctgcacacttgtcgagaacgcattcccagggaccacagagagcttgttttacgaaatgctgtctaaaaagaatactaccggcataaagaacctcctggacaaattaacgaggaagttcggaaataacaatatgtttgtgggcatctggaaattcgggcagtacctgatttcccttccgtatgttaacgagaccagtttgacacccgcccaggtgagcaagatcctcgaagtaactgaccagcaccaccggtctatttccggacgacaagagtcactggctagtgcgaccagcggttcgaaatccaaggagtgtggccatgcaaagaaagtctcttgcatcagccctcgcttttcagtgccaatggaagggctaatggcctgcggagatagtcccaattacaagatatataaaacccctgctaagctgtacaaatccaacaataagggcgaggtttggtgttctggtgacgtgcactgcagccaggaactctccccagcctcacaggagagcgtcgatagaattaagcagatcacttgtttcctgaccgaacccgaggtgagtgacgatgtattttctatcgcaatttccacgtgcaaagtgcaagacaagggggtttgtacagtcaacgaggataggtggaatgtgatcaaatgcgacagcggccttatttattacaccgatcagcgggacggacaggatactgccaacgacttcggcgaatattgtttgtcgcattcatgccgcatagagagatttccgatcaaccctacaattatctctgattgtctgtgggaataccacagtaggaagtccaaatacattaccagcttagacctcgagaatctggaagagttcaagcgtgctatctctgagaaacttagccatactctgatagtgtataactttaaacccaccgccaatttgccacacatcaagcctgtctacaaatatattacagttcagggggtggaaaactccgacggagtggattcagcatacatcagtgcgagcatgcccgctctctctggtacgtccattggctataatatcatgtcacgggacaacttcccactgtttgatataattatcttcatcaagagtgccattataaaagcaacctacaatcacatctatgacactgggcccacaattggaatcaacgtaatgcatgatgagcactgcaccggccaatgtcctacagacattccacataaggaaaattggatcactttcgcccaggagcgaaccagcagatggggttgcgaagagtttgggtgcctagctgtcaacacgggctgtgtgttcggatcctgccaggatataatcaggccggagacaaaagtttaccgcaaggccgtggaagagtctgtcctgctcaccgtgtgtattacttaccccggcaagaccttttgcacagaaatcaatgcaattgagcctaaaatcactgacgagctggaacttcagttcaagaccgttgatacaaaaacgttgccaaacatactggctgtgcaaaatcacaagttatattcggggcagattaacgacctcggatccttttcacagggctgtggtaatatccaaaagaccaactccagtatcattgggactggaacagccaagttcgattacgtatgccatggcgcgtctcggaaggacatcatagtcagaaggtgttataacaataactacgagagctgcaaactgcttaaggaagaacagtccctgatgtttgccgataatcacgaaaccattgacgtggctaacgtgcgccacctactcggtgacctgcagttcaaattgatgctgggcgatttacgatataagtcatttgcagagaatcccgacctcgagatcgaagccaaatgtgtcgggtgcccttcttgtttcactagctacagttgctcctttaagattgctagcaacatcgatacagtttgctctatagagggaccatgtaccacgttccataatcggctgatgattacttcaaccaagcaggactatggcatcaaaatgtcctgcaagacaaaacccaaggaaaccgaggagttccaaatctgtaaaaagacttacacagtgctttttaccacagtagagaagaacgataaaattgagatcagtactggggaccagaccagcttcattcaggaacgtgatgacagatgcaagacgtggctgtgtagggtgcgcgatgagggaatatcggtcatctttgaaccgattcgggccttctttggctcttacttctccatcgcattttatgtggttgtgatcattatagtcttgttcctcgcgatctacatttttctgcctatggtgttcaaactaagagacgttctgaagaggaatgagtatctttacctccaggaaatcaaacacaagtga

SEQ ID NO: 10934 - RNA, 4305 nt, synthetic construct
  misc_feature 1..4305: note = derived and/or modified CDS sequence (opt3) from NRIV(9800521)__JX857326.1__GP
  source 1..4305: mol_type = other RNA
atgctgctccttctggtgttgttaatcccctgctacgtcagcgcctcccctgttgtgaccagatgtttccacggcgggcagctgattgctgagaagaaatctcaaacagcagtatcagaattttgcctaaaggacgatgtgagtactataaaaagcgagatcacgtatgaaaagaacaataccggactcttcgcccattccaaagtcctgaggaactggattatcaaggactggaagaattgtaacccagtgccgacagcgggtggctctattaatgttatcgaggtgaacactgatctttcgctgaccacaaaaacctacgtctgctcacgggactgtactataacagtggataaggaagacgctcagatcatttttcagaccgagaaattgaatcacttcgaggtaagcgggacgactctcagttccggatggtttaagaccaaagcctctgttacactggatcgcacttgcgaacatatcaaggtgacctgtggcaagaaaacactgcagttccacgcatgctttaagcatcacatgagctgtattcgattctttcacggtaccatcctccccgggacgatggccacttccatatgccaaaacattgagttaatcattatcatctcactgacacttattatattcatcttgatgattatcctgaccaaaacttatatatgttacctactcatgcctctgtttatgccaattgcttatttctacggatggagttataataagagctgcaaaaagtgctcttgttgcggccttgcataccatccctttacaaactgtggctcccactgcgtctgtgggctgaaattcgaagcctcagaccgtatgagaatccatagggagagcggattgtgccagggttacaagagtctccgggtggctcgcctgttatgtaagtctaaaggctccagcctggtgatctcgattctcctttctatgctgatcttgtccttcgtcacccctattgaggggacgctaaccaattatccagaatcaagaaagtacgatctggaggaaatagccgacgttctcgagggatttatcgtggaaaaaggcattaaggagtatgtagtgttctacacaagtatctttggtgcgctgcttctgttgatggcactcgtcatcactattaccctgaacaaagtgacagagtatttaactaatataaacgttctgtactgccacgaatgtagcatgtatcactccaagaagaatatcaaatacattggggatttcaccaacaagtgcggattttgtacatgcggcgagctagaagaccaggagggcctcaaaatccataaggtgtctaggaaatgcatttacaagtatcagctgacctggagcaagatcataatgactatccttgtctgtttgctgattgcccaaaacacgatcctcattgtggctgcctcagatgactgctggacgaaaaagagtctggaaatggagtgtatcgggccccttcagcaggtagatacctgcgacgacaaagcatcccggagctactctggagaggctcgcaagctggttcgagcctcaaaaataagtgatttggacgcggcccaggtgggtctcctgggcagcactattgaatccgcaatcgcttctattagaaagcaaaggacctatcctacaatgcacttactggagtcggtcttcctagggaagcattgtgattactataaaacctttgaacacaatagcggatactcccaggccaagtggcggctcactgctaaaacacatcacttcgacatctgctcacgtcacagtacgcatcacttttgtcgctgcatatctgatggcaccaagtgtcagaacggtgactgggatttcgccggggagatgaatagcacttatcaatccaaaaaggactttttcgaacatgattttaaactgttctgcacacttgtggagaacgcattcccaggcaccacagagtcattgttttacgaaatgctgagcaagaagaatactaccggaatcaaacagctcctggacaagttaacgagaaaattcggcaacaataacatgtttgtcgggatttggaagttcggacagtacctgatgtctcttccgtatgtgaatgaggcctccttgacccccgctcagatcagtaaaattctcgaagttacagaccaacaccacaggagcatctctggtcggcaggagtccctggcgtcagcaactcctggcagtaagagcaaggagtgtgggcatgccaaaaaggtgtcgtgcatatccccacgattttctgtacccatggaaggactaatggcttgcggcgatagccctaactacaaaatttataagaccccaacaaaactgtacaagtcaaataacaagggtgaggtctggtgtagtggggacgtgcactgctcccaggaactctctcccgccagccaggagtccgttgatcgcatcaaacaaatcacttgtttcctgaccgaaccggaggtgtcagacgatgtctttagcattgcaatcagtacgtgcaaggtgcaggacaaaggcgtatgtacagtgaatgaggatagatggaacgttattaagtgcgactctggacttatatattacaccgatcagagggacggccaggatactgggaatgacttcggagaatattgtttgtcccatagctgccggatcgagcgctttcctattaaccccgccatcattagagattgtctgtgggaataccactcgaggaaatcaaagtacatcacatctttagacctcgagaacctggaagagttcaagcgtgctataagtgagaaactttcccataccctgatcgtctataattttaagccaactgccaacttgcctcacattaaacccgtgtacaagtatatcaccgtgcaaggtgtcgaaaatagcgacggcgttgattctgcatacattgcggctagcatgccagccctctccgggacatcaatcggatataacataatgagtcgggacaatttccccctgtttgatattatcatcttcattaaaagcgcaataatcaaggccacgtacaaccacatttatgacaccggccctactatcggtattaatgtgatgcatgatgagcactgcacagggcagtgtccaaccgacatcccgcataaagaaaactggataacattcgctcaggagcgaacttctagatggggctgcgaagagtttggatgcctagccgtgaataccggctgtgtattcgggtcctgccaggatatcattaggcccgagacgaaggtctaccgcaaggcagtggaagagtcagttctgctcacagtgtgtatcacctaccctggaaaaactttttgcaccgaaattaacgctatcgagccaaagataacagacgagctggaacttcaattcaaaactgtcgataccaagacattgcccaatattctggccgtgcagaaccacaaattatatagtggccagatcaatgacctcggtagcttttcccaagggtgtggaaacatccagcggacaaattcttcgattatcggcaccggtactgcgaagttcgattacgtttgccatggcgccagcagaaaggacataattgtgaggcgctgttataacaacaattacgagtcatgcaaactgcttaaggaagaacagtccctgatgtttgctgataaccacgaaacaatcgacgtagcaaatgtccgacacctactcggggacctgcagttcaaattgatgctgggagatttacggtataagagttttgccgagaaccctgacctcgagattgaagctaaatgtgtgggctgcccatcttgtttcaccagctactcctgctcatttaagatcgccactaatatagatacagtgtgctctattgaggggccctgtaccacgttccataaccgtctgatgatcactagcaccaagcaagactatggaatcaaaatgagttgcaagacaaaaccgaaggaaaccgaggagttccagatttgtaaaaagacttacacagtcctttttaccacagttgagaagaatgataaaatcgagatttccactggcgaccagaccagcttcatacaggaaagagatgacaggtgcaagacgtggctgtgtcgcgtgcgggatgagggtatctctgtaatttttgaacctatcagagcattctttgggtcatacttctccatcgcgttttatgtggtcattagtataatcgtgttgttcctcgccatttacatctttctgccaatggttttcaaactaagggacgtgctgaagcgaaacgagtatctttacctccaagaaattaaacacaagtga

SEQ ID NO: 10935 - RNA, 4305 nt, synthetic construct
  misc_feature 1..4305: note = derived and/or modified CDS sequence (opt3) from NRIV(Adrar)__KJ716849.1__GP
  source 1..4305: mol_type = other RNA
atgctgctccttctggtgttgttaatcccctgctacgtcagcgcctcccctgttgtgaccagatgtttccacggcgggcagctgattgctgagaagaaatctcaaacagcagtatcagaattttgcctaaaggacgatgtgagtactataaaaagcgagatcacgtatgaaaagaacaataccggactcttcgcccattccaaagtcctgaggaactggattatcaaggactggaagaattgtaacccagtgccgacagcgggtggctctattaatgttatcgaggtgaacactgatctttcgctgaccacaaaaacctacgtctgctcacgggactgtactataacagtggataaggaagacgctcagatcatttttcagaccgagaaattgaatcacttcgaggtaagcgggacgactctcagttccggatggtttaagaccaaagcctctgttacactggatcgcacttgcgaacatatcaaggtgacctgtggcaagaaaacactgcagttccacgcatgctttaagcatcacatgagctgtattcgattctttcacggtaccatcctccccgggacgatggccacttccatatgccaaaacattgagttaatcattatcatctcactgacacttattatattcatcttgatggtcattctgaccaaaacttatatctgttacctactcatgcctctgtttatgccaatagcttatttctacggatggagttataataagagctgcaaaaagtgctcttgttgcggccttgcataccatccctttacaaactgtggctcccactgcgtgtgtgggctgaaattcgaagcctcagaccgtatgaggattcatagagagagcggattgtgccagggttacaagagtctccgggtggctcgcctgttatgtaagtctaaaggctccagcctggtcatctcgatcctcctttctatgctgattttgtccttcgttacccctatcgaggggacgctaaccaattatccagaatcaagaaagtacgatctggaggaaattgccgacgtgctcgagggatttatagtagaaaaaggcatcaaggagtatgtggtcttctacacaagtatttttggtgcgctgcttctgttgatggcactcgtgatcactatcaccctgaacaaagttacagagtatttaactaatattaacgtgctgtactgccacgaatgtagcatgtatcactccaagaagaatataaaatacatcggggatttcaccaacaagtgcggattttgtacatgcggcgagctagaagaccaggagggcctcaaaattcataaggtctctaggaaatgcatctacaagtatcagctgacctggagcaagattatcatgactatacttgtgtgtttgctgatcgcccaaaacacgattctcatcgtagctgcctcagatgactgctggaccaaaaagagtctggaaatggagtgtattgggccccttcagcaggttgacacatgcgatgacaaagcatcccggagctactctggagaggctaagaaactggtgcgcgcctcaaagatcagtgatttggacgcggcccaggtcggtctcctgggcagcactatagaatccgcaattgcttctatccgaaagcaaagaacctatcctacaatgcacttactggagtcggtgttcctagggaaacattgtgattactataagacctttgaacacaatagcggatactcccaggccaaatggaggctcactgctaagacacatcacttcgacatttgctcacggcacagtacgcatcacttttgtcgttgcatctctgatggcaccaaatgtcagaacggtgactgggatttcgccggggagatgaatagcacttatcaatccaagaaagactttttcgaacatgattttaagctgttctgcacacttgtcgagaacgcattcccaggcaccacagagtcattgttttacgaaatgctgagcaagaaaaatactaccggaataaagaaactcctggacaagttaacgcgcaaattcggcaacaataacatgtttgtggggatctggaagttcggacagtacctgatttctcttccgtatgttaatgagacctccttgacacccgcccaggtgagtaagatcctcgaagtaactgaccagcaccacagaagcatttctggtaggcaagagtccctggcttcagcgacccctggcagtaaaagcaaggagtgtgggcatgcaaagaaggtctcgtgcatctccccacggttttctgtgcccatggaaggactaatggcctgcggcgatagccctaactacaaaatatataagacaccagctaagctgtacaaatcaaataacaagggtgaggtttggtgtagtggggacgtgcactgctcccaggaactctctcccgccagccaggagtccgtcgatcgaattaaacagatcacttgtttcctgaccgaaccggaggtgtcagacgatgtatttagcatcgcaattagtacgtgcaaggtgcaagacaaaggcgtttgtacagtcaatgaggatcgctggaacgtgatcaagtgcgactctggacttatttattacaccgatcagagagaaggccaggacactgggaatgatttcggagagtattgtttgtcccatagctgcaggatagaacggtttcctatcaaccccgccattatctcggactgtctgtgggagtaccactcacgcaagtctaaatacattacaagtttagatctcgaaaacctggaggagttcaagagagctatctccgaaaaacttagccataccctgatagtgtataattttaagccaactgccaacttgcctcacatcaaacccatttacaagtatatcaccgtccagggtgttgaaaattctgacggcgtggacagcgcatacattgcggcttccatgccagccctctcagggacaagtatcggatataacataatgagcagggataatttccccctgtttgacattatcatcttcattaaatctgcaataatcaaggccacgtacaaccacatttatgataccggccctactatcggtattaatgtgatgcatgacgagcactgcacagggcaatgtccaaccgatatcccgcataaggagaactggataacattcgctcaggaacgtacttcccggtggggctgcgaggagtttggatgcctagccgtaaataccggctgtgtcttcgggtcatgccaggacatcattcgaagtgaaacgaaagtgtacagaaaggcagttgaggaaagcgtgctgctcacagtctgtatcacctaccccggaaaaactttttgcaccgagattaacgctatcgagcctaagataacagatgaactggagcttcagttcaaaactgtggacaccaagacattgccaaatattctggccgttcaaaaccacaagttatattccggccagatcaatgatctcggttctttttcgcaggggtgtggaaacatccagaaaacgaatctgagcattatcggcaccggtactgcgaagttcgactacgtgtgccatggcgcctcaaggaaagatataattgtacgccggtgttataacaacaattacgaatcctgcaaacttctgaaagaggaacaaagtctaatgtttgctgacaaccacgagacaatcgatgtcgcaaatgtgagacacctcctgggggacttgcagttcaagctgatgttaggagacctcaggtataagtcttttgccgagaaccccgatctggaaattgaggctaaatgtgtgggctgccctagctgtttcacctcctactcatgctcttttaagatcgccagcaatatagacactgtctgcagtattgaagggccatgtacaaccttccataaccgccttatgatcacgtccactaaacaggattatggaatcaagatgagctgcaaaaccaagcccaaggagacagaagagttccaaatttgtaaaaagacctacactgttctgtttacaaccgtggagaaaaatgacaagatcgaaatttctacaggcgatcagacttcattcatacaggagaaagacgatcgatgcaagacctggttgtgtcgggtacgtgacgaaggtatctccgtgatttttgagccgatcagagcattctttgggagttacttcagcatcgcgttttatgtcgtgatttcgataatcgttctcttcctggccatttacatctttctacctatggtgttcaagctgagggatgtccttaaacgcaacgaatatctctacctgcaggagattaagcacaaatga

SEQ ID NO: 10936 - RNA, 4305 nt, synthetic construct
  misc_feature 1..4305: note = derived and/or modified CDS sequence (opt3) from NRIV(DakArD28542)__JX857317.1__GP
  source 1..4305: mol_type = other RNA
atgctgctccttctggtgttgttaatcccctgctacgtcagcgcctcccctgttgtgaccagatgtttccacggcgggcagctgattgctgagaagaaatctcaaacagcagtatcagaattttgcctaaaggacgatgtgagtactataaaaagcgagatcacgtatgaaaagaacaataccggactcttcgcccattccaaagtcctgaggaactggattatcaaggactggaagaattgtaacccagtgccgacagcgggtggctctattaatgttatcgaggtgaacactgatctttcgctgaccacaaaaacctacgtctgctcacgggactgtactataacagtggataaggaagacgctcagatcatttttcagaccgagaaattgaatcacttcgaggtaagcgggacgactctcagttccggatggtttaagaccaaagcctctgttacactggatcgcacttgcgaacatatcaaggtgacctgtggcaagaaaacactgcagttccacgcatgctttaagcatcacatgagctgtattcgattctttcacggtaccatcctccccgggacgatggccacttccatatgccaaaacattgagttaatcattatcatctcactgacacttattatattcatcttgatggtcattctgaccaaaacttatatctgttacctactcatgcctctgtttatgccaatagcttatttctacggatggagttataataagagctgcaaaaagtgctcttgttgcggccttgcataccatccctttacaaactgtggctcccactgcgtgtgtgggctgaaattcgaagcctcagaccgtatgaggattcatagagagagcggattgtgccagggttacaagagtctccgggtggctcgcctgttatgtaagtctaaaggctccagcctgatcatctcgattctcctttctatgctgatcttgtccttcgtcacccctattgaggggacgctaaccaattatccagaatcaagaaagtacgatctggaggaaatagccgacgttctcgagggatttatcgtggaaaaaggcattaaggagtatgtagtgttctacacaagtatctttggtgcgctgttccttctgatggcattggtcatcactattaccctcaacaaagtgacagagtatctgactaatataaacgttttatactgccacgaatgtagcatgtatcactccaagaagaatatcaaatacattggggattttaccaacaagtgcggattctgtacatgcggcgagctggaagaccaggagggcctaaaaatccataaggtgtctaggaaatgcatttacaagtatcagctcacctggagcaagatcataatgactatcctggtctgtcttttgattgcccaaaacacgatcctgattgtggctgcctcagatgactgctggacgaaaaagagtctcgaaatggagtgtatcgggcccctgcagcaggtagatacctgcgacgacaaagcatcccggagctactctggagaggctaagaaacttgttcgcgcctcaaagataagtgatctggacgcggcccaggtgggtttgctcggccctactattgaaagcgcaatcgcttccattcgaaagcaaagaacctattctacaatgcacctgttagagtcggtctttctggggaaacattgtgattactataagaccttcgaacacaatagcggatactcccaggccaaatggaggctaactgctaagacacatcactttgacatctgctcacggcacagtacgcatcacttctgtcgttgcatatctgatggcaccaaatgtcagaacggtgactgggattttgccggggagatgaatagcacttatcaatccaagaaagacttctttgaacatgatctcaagctgttctgcacacttgtggagaacgcattcccaggcaccacagagtcattgttttacgaaatgctgagcaagaaaaatactaccggagtcaagaaactcctggacaagttaacgcgcaaattcggcaacaataacatgtttgtggggatctggaagttcggacagtacctgatgtctcttccgtatgttaatgagacctccttgacacccgcccaggtggctaagattctcgaagtaactgaccagcaccacagaagtatcagcggtaggcaagagtctctggcgtccgcaacccctggctcaaaaagtaaggagtgtagccatgccaaaaaggtctcgtgcatttccccacggttttctgtgcccatggaagggctaatggcttgcggagatagccctaactacaaaatctataagacaccagccaagctgtacaaatcaaataacaagggcgaggtttggtgtagtggtgacgtgcactgctcccaggaactctctcccgcaagccaggagtccgtcgatcgaataaaacagattacttgtttcctgaccgaaccggaggtgtcagacgatgtatttagcatcgccatcagtacgtgcaaggtgcaagacaaaggggtttgtacagtcaatgaggatcgctggaacgtgattaagtgcgactctggccttatctattacaccgatcagagagacggacaggatactggcaatgacttcggggaatattgtttgtcccatagctgcaggattgagcggtttcctataaaccccgctatcatttcggattgtctgtgggaataccactcacgcaagtctaaatacatcacaagtttagacctcgagaacctggaagagttcaagagagccatttccgagaaacttagccataccctgatcgtgtataattttaagccaactgcaaacttgcctcacataaaacccgtctacaagtatatcaccgttcagggagtggaaaattctgacggtgtggatagcgcgtacattgctgcctccatgccagcactctcaggcacaagtatcgggtataacattatgagcagggacaatttccccctgtttgatatcataattttcatcaaatctgccatcattaaggctacgtacaaccacatatatgacaccggacctactatcggcattaatgtaatgcatgatgagcactgcacaggtcaatgtccaaccgacatcccgcataaggaaaactggattacattcgcccaggagcgtacttcccggtgggggtgcgaagagtttggctgcctagcagtcaataccggatgtgtgttcggctcatgccaggatatcatacgacccgagacgaaagtttacagaaaggctgtggaagagagtgtcctgctcacagtgtgtatcacctaccctgggaaaactttttgcaccgaaattaacgccatcgagccaaagattacagacgagctggaacttcagttcaaaactgttgataccaagacattgcccaatatcctggcggtgcaaaaccacaagttatatagcggacagataaatgacctcggctccttttctcagggttgtgggaacattcagaaaacaaattcgagcatcatcggaaccggcactgccaagttcgattacgtatgccatggtgcttcaaggaaagacattatcgtccgccggtgttataacaacaattacgagtcctgcaagctgcttaaagaagaacaaagtctgatgtttgcagataaccacgaaacaatagacgtggccaatgtgagacacctactcggcgacctgcagttcaagttgatgctgggggatttaaggtataagtcttttgctgagaaccctgacctcgagattgaagccaaatgtgtcggatgcccaagctgtttcacctcctactcatgctcttttaagatcgcaagcaatattgatactgtttgcagtatcgagggcccctgtacaaccttccataaccgcctgatgataacgtccactaaacaggactatgggattaagatgagctgcaaaaccaagccgaaggaaacagaggagttccaaatctgtaaaaagacctacactgtgctttttacaaccgtagagaaaaatgataagatcgagatttctacaggagaccagacttcattcatccaggaacgagatgaccggtgcaaaacctggctgtgtcgtgtgagagatgagggcatttccgtcatatttgaacctatcagggcgttctttggtagttacttcagcattgccttttatgtggttgtgtcgatcatcgtcttgttcctcgctatttacatatttctgccaatggtgttcaagctacgcgacgttctgaagcggaacgagtatctttacctccaggaaatcaaacacaagtga

SEQ ID NO: 10937 - RNA, 4305 nt, synthetic construct
  misc_feature 1..4305: note = derived and/or modified CDS sequence (opt3) from NRIV(SUD-HKV141)__JX857323.1__GP
  source 1..4305: mol_type = other RNA
atgctgctccttctggtgttgttaatcccctgctacgtcagcgcctcccctgttgtgaccagatgtttccacggcgggcagctgattgctgagaagaaatctcaaacagcagtatcagaattttgcctaaaggacgatgtgagtactataaaaagcgagatcacgtatgaaaagaacaataccggactcttcgcccattccaaagtcctgaggaactggattatcaaggactggaagaattgtaacccagtgccgacagcgggtggctctattaatgttatcgaggtgaacactgatctttcgctgaccacaaaaacctacgtctgctcacgggactgtactataacagtggataaggaagacgctcagatcatttttcagaccgagaaattgaatcacttcgaggtaagcgggacgactctcagttccggatggtttaagaccaaagcctctgttacactggatcgcacttgcgaacatatcaaggtgacctgtggcaagaaaacactgcagttccacgcatgctttaagcatcacatgagctgtattcgattctttcacggtaccatcctccccgggacgatggccacttccatatgccaaaacattgagttaatcattatcatctcactgacacttattatattcatcttgatggtcattctgaccaaaacttatatctgttacctactcatgcctctgtttatgccaatagcttatttctacggatggagttataataagagctgcaaaaagtgctcttgttgcggccttgcataccatccctttacaaactgtggctcccactgcgtgtgtgggctgaaattcgaagcctcagaccgtatgaggattcatagagagagcggattgtgccagggttacaagagtctccgggtggctcgcctgttatgtaagtctaaaggctccagcctgatcatctcgattctcctttctatgctgatcttgtccttcgtcacccctattgaggggacgctaaccaattatccagaatcaagaaagtacgatctggaggaaatagccgacgttctcgagggatttatcgtggaaaaaggcattaaggagtatgtagtgttctacacaagtatctttggtgcgctgttccttctgatggcattggtcatcactattaccctcaacaaagtgacagagtatctgactaatataaacgttttatactgccacgaatgtagcatgtatcactccaagaagaatatcaaatacattggggattttaccaacaagtgcggattctgtacatgcggcgagctggaagaccaggagggcctaaaaatccataaggtgtctaggaaatgcatttacaagtatcagctcacctggagcaagatcataatgactatcctggtctgtcttttgattgcccaaaacacgatcctgattgtggctgcctcagatgactgctggaccaaaaagagtctcgaaatggagtgtatcgggcccctgcagcaggtagacacatgcgatgacaaagcatcccggagctactctggagaggctaagaaacttgttcgcgcctcaaagataagtgatctggacgcggcccaggtgggtttgctcggccctactattgaaagcgcaatcgcttccattcgaaagcaaagaacctattctacaatgcacctgttagagtcggtctttctggggaaacattgtgattactataagaccttcgaacacaatagcggatactcccaggccaaatggaggctaactgctaagacacatcactttgacatctgctcacggcacagtacgcatcacttctgtcgttgcatatctgatggcaccaaatgtcagaacggtgactgggattttgccggggagatgaatagcacttatcaatccaagaaagacttctttgaacatgatctcaagctgttctgcacacttgtggagaacgcattcccaggcaccacagagtcattgttttacgaaatgctgagcaagaaaaatactaccggagtcaagaaactcctggacaagttaacgcgcaaattcggcaacaataacatgtttgtggggatctggaagttcggacagtacctgatgtctcttccgtatgttaatgagacctccttgacacccgcccaggtggctaagattctcgaagtaactgaccagcaccacagaagtatcagcggtaggcaagagtctctggcgtccgcaacccctggctcaaaaagtaaggagtgtgggcatgccaaaaaggtcagctgcatttcgccacggttttccgtgcccatggaaggactaatggcttgcggcgattctcctaactacaaaatctataagacaccagccaagctgtacaaaagcaataacaagggtgaggtttggtgttcaggggacgtgcactgcagtcaggaactcactcccgcatcccaggagtctgtcgatcgaataaaacagattacctgtttcctgacggaaccggaggtgagcgacgatgtattttccatcgccatctcaacatgcaaggtgcaagacaaaggcgtttgtaccgtcaatgaggatcgctggaacgtgattaagtgcgacagcggacttatctattacactgatcagagagacggccaggatacagggaatgacttcggagaatattgtttgagtcattcttgcaggattgagcggtttcctataaaccccgctatcatttccgattgtctgtgggaataccacagccgcaagtcgaaatacatcacctcattagacctcgagaacctggaagagttcaagagagccatttctgagaaacttagtcatactctgatcgtgtataattttaagccaaccgcaaacttgcctcacataaaacccgtctacaagtatatcacagttcagggtgtggaaaattccgacggcgtggatagcgcgtacattgctgcctctatgccagcactcagcgggacgtccatcggatataacattatgtcaagggacaatttccccctgtttgatatcataattttcatcaaaagtgccatcattaaggctacctacaaccacatatatgacactggccctacaatcggtattaatgtaatgcatgatgagcactgcaccgggcaatgtccaacagacatcccgcataaggaaaactggattactttcgcccaggagcgtaccagccggtggggctgcgaagagtttggatgcctagcagtcaatacgggctgtgtgttcgggtcttgccaggatatcatacgacccgagacaaaagtttacagaaaggctgtggaagagtccgtcctgctcaccgtgtgtatcacttaccctggaaaaaccttttgcacagaaattaacgccatcgagccaaagattactgacgagctggaacttcagttcaaaaccgttgatacaaagacgttgcccaatatcctggcggtgcaaaaccacaagttatattcaggccagataaatgacctcggtagttttagccaggggtgtggaaacattcagaaaaccaattcctctatcatcggcactggtacagccaagttcgattacgtatgccatggcgcttcgaggaaagacattatcgtccgccggtgttataacaacaattacgagagctgcaagctgcttaaagaagaacaatcactgatgtttgcagataaccacgaaaccatagacgtggccaatgtgagacacctactcggggacctgcagttcaagttgatgctgggagatttaaggtataagtcctttgctgagaaccctgacctcgagattgaagccaaatgtgtcggctgcccaagttgtttcacttcttacagctgctcctttaagatcgtttcaaatattgatacagtgtgctctatcgaggggccctgtaccacgttccataaccgcctgatgataactagcaccaaacaggactatggaattaagatgagttgcaaaacaaagccgaaggaaaccgaggagttccaaatctgtaaaaagacttacacagtactttttaccacagtggagaaaaatgataagatcgagatttccactggcgaccagaccagcttcatccaggaacgagatgaccggtgcaaaacgtggctgtgtcgtgtcagagatgagggtatttctgtgatatttgaacctatcagggcattctttgggtcatacttctccattgcgttttatgttgtggtcagtatcatcgtgttgttcctcgccatttacatatttctgccaatggttttcaagctacgcgacgtgctgaagcggaacgagtatctttacctccaggaaatcaaacacaagtga

SEQ ID NO: 10938 - RNA, 4305 nt, synthetic construct
  misc_feature 1..4305: note = derived and/or modified CDS sequence (opt3) from NRIV(SUD-HKV66)__JX857320.1__GP
  source 1..4305: mol_type = other RNA
atgctgctccttctggtgttgttaatcccctgctacgtcagcgcctcccctgttgtgaccagatgtttccacggcgggcagctgattgctgagaagaaatctcaaacagcagtatcagaattttgcctaaaggacgatgtgagtactataaaaagcgagatcacgtatgaaaagaacaataccggactcttcgcccattccaaagtcctgaggaactggattatcaaggactggaagaattgtaacccagtgccgacagcgggtggctctattaatgttatcgaggtgaacactgatctttcgctgaccacaaaaacctacgtctgctcacgggactgtactataacagtggataaggaagacgctcagatcatttttcagaccgagaaattgaatcacttcgaggtaagcgggacgactctcagttccggatggtttaagaccaaagcctctgttacactggatcgcacttgcgaacatatcaaggtgacctgtggcaagaaaacactgcagttccacgcatgctttaagcatcacatgagctgtattcgattctttcacggtaccatcctccccgggacgatggccacttccatatgccaaaacattgagttaatcattatcatctcactgacacttattatattcatcttgatggtcattctgaccaaaacttatatctgttacctactcatgcctctgtttatgccaatagcttatttctacggatggagttataataagagctgcaaaaagtgctcttgttgcggccttgcataccatccctttacaaactgtggctcccactgcgtgtgtgggctgaaattcgaagcctcagaccgtatgaggattcatagagagagcggattgtgccagggttacaagagtctccgggtggctcgcctgttatgtaagtctaaaggctccagcctgatcatctcgattctccttgccatgctgatcttgtctttcgtcacccctattgaggggacgctaaccaattatccagaatccagaaagtacgatctggaggaaatagcggacgttctcgagggatttatcgtggaaaaaggcattaaggagtatgtagtgttctacacatcaatctttggtgcactgttccttctgatggccttggtcatcactattaccctcaacaaagtgacagagtatctgactaatataaacgttttatactgccacgaatgtagtatgtatcacagcaagaagaatatcaaatacattggggattttaccaacaagtgcggattctgtacatgcggcgagctggaagaccaggagggcctaaaaatccataaggtgtccaggaaatgcatttacaagtatcagctcacctggtctaagatcataatgactatcctggtctgtcttttgattgctcaaaacacgatcctgattgtggccgcaagcgatgactgctggaccaaaaagtcactcgaaatggagtgtatcgggcccctgcagcaggtagacacatgcgatgacaaagctagtcggtcctacagcggagaggccaagaaacttgttcgcgcgtctaagatatcagatctggacgccgcacaggtgcgattgctcggtcctactattgaaagtgctatcgccagcattagaaagcaaaggacctattccacaatgcacctgttagagtctgtctttctgggcaaacattgtgattactataagaccttcgaacacaattcggggtacagccaggctaaatggcggctaactgccaagacacatcactttgacatctgctcccgtcactcaacgcatcacttctgtcgctgcataagtgatgcaaccaaatgtcagaacggagactgggattttgccggcgagatgaatagtacttatcaaagcaagaaagacttctttgaacatgatctcaagctgttctgcacacttgtggagaacgctttcccaggtaccacagagtccttgttttacgaaatgctgtcaaagaaaaatactaccggggtcaagaaactcctggacaagttaacgagaaaattcggcaacaataacatgtttgtgggaatctggaagttcggccagtacctgatgagccttccgtatgttaatgagacctctttgacacccgcacaggtggcgaagattctcgaagtaactgaccagcaccacaggtccatcagtgggcggcaagagagcctggcctctgctacccctggatccaaatcaaaggagtgtggtcatgccaaaaaggtcagttgcattagcccacgattttcggtgcccatggaaggcctaatggcatgcggggattcccctaactacaaaatctataagacaccagccaagctgtacaaatctaataacaagggagaggtttggtgtagcggcgacgtgcactgctcacaggaactcactcccgctagtcaggagtccgtcgatcgcataaaacagattacctgtttcctgacggaaccggaggtgtctgacgatgtatttagcatcgccatctccacatgcaaggtgcaagacaaaggtgtttgtaccgtcaatgaggatagatggaacgtgattaagtgcgactcagggcttatctattacactgatcagagggacggccaggatacaggaaatgacttcggcgaatattgtttgagccatagttgccggattgagcgctttcctataaaccccgcaatcatttctgattgtctgtgggaataccactccagaaagagcaaatacatcacctcgttagacctcgagaacctggaagagttcaagagggcgatttcagagaaactttctcatactctgatcgtgtataattttaagccaaccgctaacttgcctcacataaaacccgtctacaagtatatcacagttcagggggtggaaaatagtgacggagtggattccgcctacattgcagccagcatgccagctctctctggtacgagcatcggctataacattatgtcccgtgacaatttccccctgtttgatatcataattttcatcaaatcagccatcattaaggcaacctacaaccacatatatgacactgggcctacaatcggaattaatgtaatgcatgatgagcactgcaccggccaatgtccaacagacatcccgcataaggaaaactggattactttcgctcaggagcggaccagtcgatggggttgcgaagagtttgggtgcctagccgtcaatacgggctgtgtgttcggaagctgccaggatatcataagacccgagacaaaagtttacaggaaggcggtggaagagtctgtcctgctcaccgtgtgtatcacttaccctggcaaaaccttttgcacagaaattaacgccatcgagccaaagattactgacgagctggaacttcagttcaaaaccgttgatacaaagacgttgcccaatatcctggctgtgcaaaaccacaagttatattccgggcagataaatgacctcggatcatttagtcagggctgtggtaacattcagaaaaccaatagctccatcatcgggactggaacagcaaagttcgattacgtatgccatggcgcctctcgcaaagacattatcgtccggagatgttataacaacaattacgagtcgtgcaagctgcttaaagaagaacaaagcctgatgtttgctgataaccacgaaaccatagacgtggccaatgtgaggcacctactcggtgacctgcagttcaagttgatgctgggcgatttacgctataagtcatttgcagagaaccctgacctcgagattgaagcgaaatgtgtcgggtgcccatcctgtttcacttcttactcttgcagctttaagatcgcctccaatattgatacagtttgctcaatcgagggaccctgtaccacgttccataaccgactgatgataacttctaccaaacaggactatggcattaagatgagctgcaaaacaaagccgaaggaaaccgaggagttccaaatctgtaaaaagacttacacagtgctttttaccacagtagagaaaaatgataagatcgagattagtactggggaccagacctccttcatccaggaacgggatgaccgttgcaaaacgtggctgtgtagagtgagggatgagggaattagcgtcatatttgaacctatccgcgctttctttggctcttacttctcaattgccttttatgtggttgtgtccatcatcgtcttgttcctcgcaatttacatatttctgccaatggtgttcaagctacgggacgttctgaagagaaacgagtatctttacctccaggaaatcaaacacaagtga

SEQ ID NO: 10939 - RNA, 4344 nt, synthetic construct
  misc_feature 1..4344: note = derived and/or modified CDS sequence (opt3) from BWAV(M459)__NC_034490.1__GP
  source 1..4344: mol_type = other RNA
atggccatgttcgagctgatcgtgctccttgcttttagctacgtcaccggcgttccccaggaactgacaagatgcttcactgggggatccgtggtaaggcaacactggtctaagaacgcaatttcagagttgtgtttaaaagacgatgtgagtataatcaagagcgaaattgagtataaaaagaatgaaacgggtacctttgccctgtccaaaatctaccggaagtggattacaactgactgggagaagtgccagcctcagaaatctaccggcgggcatatctcggtcctagaggtgcgccacgatctcacactggcgtcagctacctatatatgtggaaacccatgcactatcaatgttgaccgagaaatggcccaggtgcatcttcaaacagagggcgtcaaccacttcgaaattagcggtaccacgatcaagagtgggtggtttaaaactaccacatacattactctggatcagacctgtgagcatttgaaggtgtcctgcggaaaacagtctgtacagttccacgcatgttttaagcaacacatggcctgcgttcgtttcctccatagaacaatcctgccgggcaatatggctaacagcatatgtcagaatattgagatcattatcctgctcgcattaaccctgtccatctttattcttttgtgcatactgacgaagacttatatctgttacattctactccccatcttcatacctatttcatatatctacggctacttttataacaggagttgcaaaaagtgcagccagtgtgggctggtgtaccacccattcacagaatgcggacggaattgtgtctgcggtgcccgctatgacacctctgagagaatgaaacttcataggctgtccggcttgtgtcccgggtacaagtcactcaaagctgcccgggtgctgtgcaagagcaaaggaagtgcgtctatcttatccattctgatcagcctccttattctgacttttgtgacacctataaacggcttgatgctaaaggataccgacatcacgaatctgaagattgataccctcccagacgatatgctggaacttatccacaacgtcgactatctgaaattgatcctcgagattaatataacaatcttcggtttcattctgatcattatcttatttatgctgctaatgttctaccgctatcagcacatatttatctcgatttacgttatcgattgtaaggaatgcaacatgtaccattctaaatccgggctccgatataatggagacttcactaacaagtgtatgacctgcacatgtggcgaggtggacgatatggagggcctgaacaaacacaagaagagatacaattgccttattaaatataagactaccatcttgcaacactttttcctgtcaatactcgtatgcctgattcttaaagaaagtgtgctgtttgcagccgctcagagcgaggaaatcattaagtgtttggagcaggaatccctcacatctaaatgcaccgggcccctgttaaagactcctcaatgtacggagcagcagaagaacctgctattcatcgagatagccaaacagatggaaaaggacaatatcattacaagcctcgataacgcactgatcgctaaacttccaaatgagattgccggatcaatggcgatcttggacaccaagaaatactatcatgaacaaataactctggagtacgccattctcagtaagtattgcgattactacaagaaatatgaaggtaacaccggctactcccagacaacctggaggacttatctgcggagccaggacttagagatctgtctgatccttccgtaccagtttttctgccgttgttttaagtctgggacaggatgcattgatacgaaaatggagatcaagtcaaccatggacacttattacagtagccatcaaacaaaattcgattccgacttgaattatatgctccacgtcattcacctggcatttcgcggctctgctacctcgtacatagccaagtgtctaatcgagaaaaactacacagaaactattagctatctgaccaagatccaggaaaagtaccccaataaccagctcctgaaagtggctattttcttcacgaatcatcttttgaaccagtccctggttgagaattttgaggtgtcaaccgaatggagtagatataagcactctacagcccaacctgagcatgaatggaaaaagggtagcgagttaaaaatgctcgatccaaacaagctgaagactgggcccgcaatccagacctgccttcacataaaagacctgcactgtatctcccctaggtcacgggccccaacaagcggcattatcacttgcggattgaatgaccaggcttgcgtctaccgaaagcccgataaaaagatttatgcgtctcatatgacccagcacggcttctgtgtgatggacgggcattgcctcaaaccgtttgaacctatctccggagagatgctgcaaataattaagaagagtaaatgttggacggaggatatcgaagacctaatcacagagggtcaggataagggccgcattagctgccagcccatagacgtagggaactgtaacgtttctggaaatctgtggaccatcactctctgctccgataaaaagttctactatacagacaacaaacacgtgcatgataattcaaaggacattggctactactgtatggaagagaactgcaagatcccaagatttcctattcaccccgatttcgtcaaagactgtgaatgggatctgaatcacatcaagatagaccatcttaaacaaatcaacattgaggacatcaatagttataagaaaattttgaccgagaagctgactaccgcattaaacagctttaaatacaagggtaatgaaaacctcccacactcgatccccaagtataaatacataacaattcaggggacgcagaccatcgatggcatcgagaatgccttcattgaagtggagatccctgctctgtccggatctgccactggctttaagataagctcaagggacgggattgaacttttcgatgcaatcctgtatgtcaaacaggccagtttttcctctgtgtacaagaaactatatgttacaggaccaaccattggtatcaacacaaagcatgacgagcggtgcactggcgcttgtccgatgaccctcccccacagctacgggtggctgacgttctccaaggagcgcacatcacaatggggatgcgaagagtacggctgcttggccataagcgatggttgtgtgtttgggagttgccaggacattatcaaagatgacctgaccatctatagaaaggaaactgaggagttatctctcgcagaaatttgtatcaccttcatgcataatacattctgcacttccattgatagcaccacacctacgataaccgacatcctggaggcgcagtttaaaactgtagaatcgttcaaacttccaaacacagtcggcctgaaaatgcacaagttgtacattggaaccatcaatgatatcggcgtgtataagaaggcttgtgggaacgttcagaagtacaacaatactattctcggatcaggctctcccaaatttgactatgtgtgccacctggccaagaggaaagatgtcatactacgtaagtgtttcgacaacgactacaatagttgcaagctgcttaaagtggcaaacgatctccggatcgaggaagacggtgagaagctgaaagtaattaattataagaaagtgatggggacattgaagtttaaggccatcttcggagatattaaatacaagtcctttacccaagacgttgatatcgacgctgaggccacgtgtgtcggctgcctgaactgtttcgaaaatataaactgcgagatcaaagtgcagagccctttagaaactacctgcgaggtggaatctagctgtgatctctttacaacccgaatcctgttccatcaggacattcacaagtacgcacttaaactgatttgctccaaggaggcttcaagtaaattttggatcagattctgtaataaggagataaagagctctatttccttgatcaacgccgcgccaattctcgaactggcccccatcgatcagacttcatatgtcaaagaggaagacgagaggtgcggtacatggatgtgtcgcgttgctcaagaaggcataggggtgatcttcgagccgtttaagaatctattcggaagttacctgggcatcttttatattattatcatagtgattatccttctcgtactgttcgtctacatctttttgcctatgattttaaaactgaaggagatcctccagaaaaacgaagtggcatatcagcgggatatgaagataagatga

SEQ ID NO: 10940 - RNA, 4344 nt, synthetic construct
  misc_feature 1..4344: note = derived and/or modified CDS sequence (opt3) from BWAV(UgAr1888)__KJ867186.1__GP
  source 1..4344: mol_type = other RNA
atggccatcttcaagctgattgtgctccttgcttttagctacgcaaccggcgtcccccaggagctgtccagatgcttcacagggggatctgttgtgaggcaacactggagtaaaaacgccatatcagaattgtgtttaaaggacgatgtaagcatcattaaatccgagatcgaatataagaaaaatgagactggtacgtttgcgctgaacaagatttaccggaagtggatcaccacagactgggaaaaatgccagcctcagaagtctactggcgggcatatatcggtgctagaggtccgccacgatctcaccctggcttcagccacatatatctgtggaaatccatgcaccattaacgtggaccgagagatggcacaggttcatcttcaaactgaaggcgtgaatcacttcgagatcagcggtacaaccattaaaagtgggtggtttaagacgactacctacatcacactggatcagacttgtgaacatttgaaagtctcctgcggaaagcagtctgtgcagttccacgcctgttttaagcaacacatggcttgcgtacgtttcctccatagaaccatactgccgggcaacatggcaaatagcatttgtcagaacatcgagattatcatcctgctcgccttaacactgtccatttttatacttttgtgcatcctgaccaaaacgtatatttgttacatcctactccccatattcattcctatctcatatatctacggctacttttataataggagttgcaagaaatgcagccagtgtgggctggtttaccacccattcactgagtgcggacggaactgtgtgtgcggtgctcgctatgacacatctgaaagaatgaaacttcataggctgtccggcttgtgtcccgggtacaaatcactcaagaccgcccgggtcctgtgcaaaagcaagggaagtgcgtctattttatccatcctgattagcctccttatactgacttttgtgacacctatcaatggcttgatgctaaaggataccgacattacgaacctgaaaatcgataccctcccagacgatatgctggagcttatccacaatgtggactatctgaagttgattctcgaaataaacatcatgattttcggtttcatcctgattatcatattatttatgctgctaatgttctaccgctatcagcacatctttatttcgatctacgtcattgattgtaaagagtgcgacatgtaccattctaagtccgggctccgatataatggagacttcacaaacaaatgtatgacttgcacctgtggcgaagttgatgacatggagggcctgaacaagcacaagaaaagatacaattgccttatcaagtataaaacaactatattgcaacatttttcactgagtatgctcgtgtgcctgattcttaaggagagcgtactgttcgcagccgctcagcccgaagagatcattaaatgtttggaacaggagtccctcacctctgaatgcacagggcctctgttaaagaccccacaatgtactgagcagcagaagaacctgctatttatggagatcgccaaacagatggaaaaggataatgtgataacgagcctcgacaacgcactgatcgctaaacttccgaatgagattgccggatcaatggcgatcttggatacaaagaaatactatcacgaacaaattaccctggagtacgccatcctcagtaagtattgcgactactacaagaaatatgaaggtaacactggctactcccagaccacatggaggacctatctgcggagccaggatttagagatatgtctgattcttccctaccagttcttttgccgttgtttcaagtctgggactggatgcatcgacacaaaaatcgagtttaagtcaacgatggatacctattacagtagccatcaaactaaattcgactccgatttgaattatatgctccacgtcattcacctggcatttcgcggctctgctacatcgtacatcgccaagtgtctaattgagaaaaactacaccgaaacaataagctatctgactaagatccaggaaaagtaccctaataaccagctcctgaaagtggctattttcttcaccaatcatcttttgaaccagtccctggttgagaattttgaggtgtcaacggaatggagtagatataagcactctgccacccaaccagagcatgaatggaaaaagggtagcgagttaaaaatcctcgactccaacaagctgaagacagggcccgcaattcagacttgccttcacatcaaagacctgcactgtatatcacctaggagccgggccccaacctctggcatcattacatgcggattgaatgatcaggcttgcgtctaccgaaagcccaacaaagaaatctatgcgtcccatatgactcagcacggcttctgtattatggacgggcattgcctcaagccgtttgagcctatcagtggagagatgctgcaaataattaaaaagagcaagtgttggaccgaagatatcgaggacctaatcacggaaggtcaggataaaggccgcatttcttgccagcccatagacgtggggaactgtaatgtatccggaaacctgtggacaatcaccctctgctcagataagaaattctactatactgacaataagcacgttcatgatagtagcaaagacgtgggctactactgtatggaggaaaactgcaagattccaagatttcctatccaccccgatttcgtcaaggactgtgagtgggatctgaatcacatggagattgaccatcttaaacaaatcaacatagaagacatcaattcgtataagaaaattttgacagagaagctgatcaccgcattaaactcctttaaatacaagggtaatgaaaacctcccacactctattcccaaatatgagtacatcactatacaggggacccagacaattgatggcatcgaaaatgccttcatcgaggtggagattcctgctctgagcggatcagccacgggctttaagatcagttccagggacgggatagaacttttcgatgcaattctgtatgtcaagcaggcctcttttagctccgtgtacaaaaagctatatgttaccggaccaactatcggtattaacacaaaacatgacgagcggtgcaccggcgcttgtccggtgacactcccccactcatacgggtggctgactttcagcaaggaacgcaccagtcaatggggatgcgaggagtacggctgcttggccatctctgatggttgtgtatttgggtcctgccaggacataattaaagatgacctgacggtctatagaaaggaaacagaggaattaagcctcgcagagatctgtatcaccttcatgcataatactttctgcacctcgattgattcaacaactcctaccatcacagacattctggaagcgcagtttaagacggtggagtctttcaaacttccaaacaccgttggcctgaagatgcacaaattgtacataggaactatcaatgatattggcgtgtataagaaggcttgtgggaacgtccagaagtacaacaatacaatcctcggaagtggctcccccaagtttgactatgtgtgccacctggccaaaaggaaggatgtaatcctacgtaaatgtttcgacaacgactacaatagctgcaagctgcttaaagtggcaaacgatctccggattgaggaagacggtgagaagctgaaggttataaattataaaaaggtcatggggaccttgaaatttaaggccatcttcggagatgtgaaatacaagtcttttactcaagacgtggatattgacgctgaagccacatgtgtcggctgcctgaactgtttcgagaatatcaactgcgaaattaaggttcagagccctttagagaccacgtgcgaggtggaatcctcatgtgatctctttactacccgaatcctgttccatcaggacatacacaaatacgcacttaagctgatctgcagtaaagaggctacaagcaagttttggattagattctgtaaaaaggaaatcaaatcttccatttcattgatcaatgccgcgccaatactcgagctggcccccattgatcagaccagttatgtgaaggaagaggacgagaggtgcggtacttggatgtgtcgcgtagctcaagaaggcatcggggtcattttcgagccgtttaagaacctattcggaagctacctgggcatcttttatataatcattatcgtgattatccttctcgttctgttcgtgtacatatttttgcctatgattttaaaactgaaggaaatcctccagaaaaatgaggtcgcatatcagcgggatatgaaggtgagatga

SEQ ID NO: 10941 - RNA, 4332 nt, synthetic construct
  misc_feature 1..4332: note = derived and/or modified CDS sequence (opt3) from BWAV/PGAV(SAAr1)__KJ867177.1__GP
  source 1..4332: mol_type = other RNA
atgatctgcatttgtatattcgtggccatctttcccgctatttacgcaatccctgacagctattccagatgcttcaccggcgggacagtcgttaaggagatgtggtctaaagatgccgtgactgaactgtgtattaaggacgatgtatcaatcgtgaaaacggagaccagttacaagaaaaacggaacaggtacttttgcgctcaataaggtcaccaggaagtggcttatgacagactgggaaaaatgcaagccacagaaaagctcctctggccacataaacgtgatcgaggttcgggatgacctgaccttggctacttcgacatatatttgttcaagcagttgcaccatcaatgtggatcgcgaaacggcccaaattcagttaaacactgactccatcaatcatttcgagatagcagggaccacaattaagactggatggtttaaatctaccacactggtcgccctagatcagacctgtgagcacctcaaggtgagctgcggcaagcagtccgtacaattccatgcttgttttaaccagcacatgtcatgcgttcgattcctgcatcgtacgatccttccgggtaatatggcaaaaagtatttgtcagaacatcgaaatcattatactggtggggttgatcattctcatctttctgctgctctgcatattaactaagacatacatttgctatatcctgcttcccatcttcattcctttgagctacgcctatggatacttttacaataaagcctgtaagaaatgctctcagtgtggcctggtctatcacccattcaccgagtgcggctccaactgtgtgtgcggggctagatacgacacttcagaaaggatgaagctacaccggatcagcggactctgtcccggttataaaagtctgcgcacagcgagagtgctttgcaagtctaagggctccgcaagcattctgtcgatattgatctctattctcatcctgatgtttgtcacccctatcaatgggtacatgattacgaacgagttcgatgagggaaaattaaccgttgactccctgccagatgacatgctctcaatgataagtaggcttagcgccctgcaattcatctttacattgaatattgcttgttccgtgctagtaactctgttgacctgcctgttccttatcatcttttatcggttccagcatcgctttctgtctaagtacgccattaactgtacagaatgcgacatgtatcaccagaaaaagggcttgatatacaatggtgatttcactaacaaatgcatgacctgtacatgcggggaggtgaacgacatggaaggactcaataagcataagaaacgatacaactgtctgatcaagtataaagcagcttggtttttaaatctgaccattactatcatttgcctaatgctcatcaaggatggcagcatgatggccgcggccgagacgaacatagaaacatgtatggcaaaaccctcactgaccactgactgcaccggccctttccttaagattacaaagtgtgatgagagtcagaaagctctcccatttcaagagatcgccaagcagctggtcaaatccaatgtgctcaccctgcttgacaagcacattgttgaaaaactgccgaacgagatcgctgggagcttgtctatactcgataagaagcagcactaccatgaacaactggccgtggagtatggaatcttatcaaaatactgcgactattacgaactgtataagagtaatagcggttactcccagtctacttggggcacatacctaagatcgcacgatttcgagatttgtctcctgcttccctatcagtacgtctgtaggtgctttaaaagcgggacgggatgcaccgacactaagttcgagtttgaacagaaaatgaacgagacatataattccaagaacgatatgtacaattcagacttcaccttggcactgacagtgctccatctggccatgcggggcactgctagtacctatatcattgacaacgtattacagaaaaattactctaacgttatcgaatatctgaatacgaccaagaacaacttcaagagcaatcaagtgtttggtgtccttgtggatttcacaatatacttgctccgtcacgcgtcctacgcaaaatataacctgcctcagtcactaaagaaatttcgcagcgtctcttccgacctgactaccattagtgggagaagctctggccagaatatcgtgtccgatctccatcaaggagacgttatcaagacatgcctgaacattaaacagcttaattgtatctcaccaaagagtaggactaccacgacaaacttgattacctgcggcagctcgcagatatccgtgtacaatctgccccgggggcagttatatgagtctgtaactacagaacacggaacctgtgccggtgatggccactgcctcactgacttcatgcctatcaacagcgattttctggctacccttaagaaatcaaagtgttggacaacggacattccaaatatcattaaactggtcgagagtgatgggaagatctcctgccaacccatagacgtgggatcttgtaacgttagcggcaatatctggaccattactaaatgctccgataacaagtactattacacagacaataagcatgtgcacgatgacgagaaagacatcggtcattattgtatggaagagacctgcaagttcgtccgatttccgattaacgataaattcgtgtcaaattgtgaatgggacttgaaccacatcgagataaacaagctcaatcaggtagagctggataacattaatgcctacaaaaaggtgctaacagaaaagctgactagcagtctctctgtttttaaatacaagctgacccagaaccttcctcacgtcatccccaaattcaagtatatcacgattcaggggacacaaaccgtggacggcatagagaatagttttatcgaagtggagattccagcattgagcggagccgcttcgggcttcaaaatcatgactaaggaaaacaatgagctgtttgatgccattttatacgtcaaacaggcatcattctctagtatctataagaagatatacaccacagggcctactatcggaattaacaccaaacatgacgagaagtgcacaggtgcgtgccccgttaatctcccacactccacgggctggctgaccttcgctaaagaacgcactagcacatgggggtgtgaggaatatggatgccttgccatcaacgatggctgtgtgtttggttcttgccaggacattatcaaggatgagatgtacatattcaaaaaggaaaccgaggaggtggcactggtagaaatttgtatcagctttaatcataagactttctgcacagacgtcgattccaccacgcccatcattactgacaccctagaggcccaatttaaaacagtggaatcatataagctccctaaccacgttgctctgaaacagcataagttgtacgtggggcagatcaatgatttcggcgtctacaaaaaggcctgtggaaacgtgcagaagataaataacaccatttatggcgaggggactccaagatttgactacctgtgccacttagcaaaaaggaaggacgttctcgtgcggaaatgtttcgataacgactataatagttgcagcctgcttacaatcgctgatgacctgcgcttggaagaggatggagagaagctcaaagtaattaactacagaaaggtcctgggctctatgaagtttaaagccctattcggtgacatcaggtataagtcctttaccgaagatatagagctggacgtggaagcgtcatgtgccgggtgcattaattgcttcgataacatccactgtgagatcaaacttacaaatggactcgacacttcctgcagcttcgagtcctcttgtgatgcttttaactcgcgtattctgttcaatagcaaccaacatgtgtactcaaccaagttgatctgcacgaaagaacagacaaaggcatttgagattaagatatgtggcaaaaccatcaaggccgacctggtcgttactgaagctaaaccgattttagagctcacccccatcgaccagacatcctatatcaaggaagaggatactcggtgcggtacctggttctgtcgactgacgaaagagggctttagtgtgcttctggaacctttcaagaatttgtttgggtcttacctcggaattgcctacacaataatcattgcactgctatgcctgttcgtatttatctatattatccttccaatgataatgaaactcaaggaggtgctgaagcagaacgaaatcgcgtaccaaaaagagcagaagaaaagatga

SEQ ID NO: 10942 - RNA, 4332 nt, synthetic construct
  misc_feature 1..4332: note = derived and/or modified CDS sequence (opt3) from BWAV/PGAV(191B-07)__KJ867180.1__GP
  source 1..4332: mol_type = other RNA
atgatctacatttatatattcgtggccatctttcccgctatttacgcaatccctgacagctattccagatgcttcaccggcgggacagtcgttaaggagatgtggtctaaagatgccgtgactgaactgtgtattaaggacgatgtatcaatcgtgaaaacggagaccagttacaagaaaaacggaacaggtacttttgcgctcaataaggtcaccaggaagtggcttatgacagactgggaaaaatgcaagccacagaaaagctcctctggccacataaacgtgatcgaggttcgggatgacctgaccttggctacttcgacatatatttgttcaagcagttgcaccatcaatgtggatcgcgaaacggcccaaattcagttaaacactgactccatcaatcatttcgagatagcagggaccacaattaagactggatggtttaaatctaccacactggtcgccctagatcagacctgtgagcacctcaaggtgagctgcggcaagcagtccgtacaattccatgcttgttttaaccagcacatgtcatgcgttcgattcctgcatcgtacgatccttccgggtaatatggcaaaaagtatttgtcagaacatcgaaatcattatactggtggggttgactatcctcatttttctgctgctctgcatcttaacaaagacctacatatgttatattctgcttcccatcttcatccctttgagctacgcctacggatatttttacaataaggcttgcaagaaatgctctcagtgtggcctggtctatcacccattcactgagtgcggctccaactgtgtgtgcggggccagatacgacacatcagaaaggatgaagctacaccggattagcggactctgtcccggttataaaagtctgcgcaccgcgagagtgctttgcaagtctaagggctccgcaagcatcctgtcgattttgatatctatcctcattctgatgtttgtcacgcctatcaatgggtacatgatcaccaacgagttcgatgagggaaaattaacagttgactccctgccagatgacatgctctcaatgattagtaggcttagcgccctgcaattcatatttactttgaatatcgcttgttccgtgctagtaaccctgctcacatgcctgttccttattatcttttatcggttccagcatcgctttctgtctaagtacgccattaactgtactgaatgcgacatgtaccaccagaaaaagggcttgatctataatggtgatttcaccaacaaatgtatgacatgtacctgcggggaggtggacgatatggaaggactcaacaagcataagaaacgatacaattgcctgataaagtataaagcagcttggtttttaaacctgactatcacgattatctgcctaatgctcattaaggacggcagcatgatggccgcggccgagtcaaatatcgaaacatgtatggcaaaacccagtctgaccactgattgcaccggccctttccttaagataacaaagtgtgacgagtcccagaaggctttgccatttcaagagattgccaaacagctggtcaaaagcaacgtgctcaccctgcttgataagcacatcgttgaaaaactgccgaatgagattgctgggtctttgtcaatcctcgacaagaagcagcactaccatgaacaactggccgtggagtatggaatattaagtaaatactgcgattattacgaactgtacaagagcaactccggttattctcagtcgacttggagaacatacctaaggagccacgacttcgagatctgtctcctgcttccctatcagtacgtctgccggtgttttaaatccggcacggggtgcaccgatactaagttcgagtttgaacagaaaatgaatgagacatataactcaaagaatgacatgtacaacagtgacttcaccttggcactgacagtgctccatctggccatgcgtggaactgcttctacctatattatcgataatgtattacagaaaaactacagcaatgttattgaatacctgaacacgaccaagaataacttcaagtccaaccaagtgtttggcgtccttgtggacttcacaatctatttgctccgccacgcgtcatacgcaaaatataatctgcctcagagcctaaagaaatttagatctgtctccagtgatctgactaccataagcggtaggtcttccgggcagaacattgtgtcagacctccatcaaggcgatgttatcaagacatgtctgaatatcaaacagcttaactgcattagtccacggagccgaactaccacgacaaatttgattacctgcggaacttcgcagatctccgtgtacaacctgccccgcggccagttatatgagtctgtaacaaccgaacacgggacttgtgccgacgatggacactgcctcaccgacttcatgcctataaatagcgattttctggctacacttaagaagtcaaaatgttggacgaccgacatcccaaacattatcaagctggtcgagagtgatggtaaaatttcctgccaacccatcgacgtgggctcttgtaatgttagcgggaacatatggactatcacaaagtgctccgataataaatactattacaccgacaacaagcatgtgcacgacgatgccaaggacattggacattactgtatggaggaaacatgcaaattcgtcagatttccgatcaatgataagttcgtgtcaaactgtgagtgggacttgaatcacattgaaatcaacaaactcaaccaggtagagctggataatataaacgcatataagaaagtgctaactgagaagctgaccagcagtctctctgtttttaagtacaaactgacgcagaatcttcctcacgtcattcccaagttcaaatatatcacaatccagggcacccaaactgtggacggtattgaaaactcctttatagaggtggaaatcccagccttgagcggggctgcctcgggcttcaagattatgaccaaagagaataacgaactgtttgatgcaatcttatacgtcaagcaggcgtcattctctagtatttataaaaagatctacacaactggacctaccataggcatcaatacaaagcatgacgagaaatgcacgggggcttgtcccgttaacctcccacacaataccggatggctgactttcgccaaggagaggacatccacctggggttgcgaagagtatggctgccttgcaattaacgatgggtgtgtgtttggaagctgccaggacatcattaaagatgaaatgtacatcttcaagaaagagactgaagaggtggccctggtagagatatgtatttcttttaatcataagacattctgcaccgacgtcgatagcacgactcccatcatcaccgacacactagaagctcaatttaagaccgtggagtcctacaaactccctaaccacgttgccctgaagcagcataaattgtatgtgggccagattaatgacttcggtgtctacaagaaagcatgtgggaacgtgcagaagatcaataacactatatatggcgaaggaacaccacggtttgattacctgtgccacttagctaagcgcaaagacgttctcgtgagaaagtgtttcgataacgactataattcatgcagtctgcttaccattgccgatgacctgaggttggaggaagatagcgagaaactcaaggtaatcaactaccgtaaagtcctgggctctatgaagtttaaggcgctattcggggacattcggtataaatcctttacagaggatatcgaactggacgtggaggcctcatgtgctggatgcataaattgtttcgataacattcactgcgaaatcaaacttactaatggcctcgacaccagttgcagcttcgagtcctcttgtgacgcatttaactcgcgaatcctgttcaatagcaaccaacatgtgtactcaacgaaattgatttgcacaaaggagcagaccaaagcctttgaaatcaagatttgtggtaagactataaaagctgatctggtcgttaccgaggccaagccgatcttagaactcacacccattgaccagacttcctacatcaaagaggaagataccagatgcgggacgtggttctgtaggctgacaaaggagggatttagtgtgcttctggagcctttcaaaaatttgtttggctcttatctcggtatcgcatacaccgtaattatagcgctgctatgcctgttcgtgtttatctatattatccttccaatgattatgaagctcaaagaagtcctgaagcagaacgagatcgcctaccaaaaggaacagaaaaagcgctga

SEQ ID NO: 10943 - RNA, 4326 nt, synthetic construct
  misc_feature 1..4326: note = derived and/or modified CDS sequence (opt3) from CEV(283)__KX817313.1__GP
  source 1..4326: mol_type = other RNA
atgatcttcatgctgattctctttgccgtggctgcagccagccccgtctaccagagatgcttccaagacggcgcgatagttaagcagaacccttccaaagaggctgtgaccgaagtatgtcttaaggatgacgtgtctatgatcaaaacagaggccaggtatactaaaaattcaacgggggtctttagtaacaatgtggcaattcggaagtggctggttagcgattggcacgactgccgcccacgaaaggtggtcggaggtcatatcaacgtgattgaagtaggcgatgacttgaccttacacacagagtcctacgtttgttctgccgattgcactatcggggtggacaaggaaaccgctcaggtccgtctgcagacagataccactaatcatttcgagatagcaggaacaaccgtgaaatcgggctggtttaagtcaacgacttatatcagcctagaccaaacctgtgagcacctcaaagtgagttgcggtccgaagtccattcagttccatgcctgttttaaccagcacatgtcttgcgtcagattcctgcacaggacaatccttcccgggagcattgctaattccatctgtcagaacgttgaaataattatcctggtgactttggccctcctgatttttatcctgctctcaatcattagtaaaacctacatatgctatttactgatgcctatcttcattccaatcgcgtacatatatggacttatttacaataagagctgtaagaaatgcaagttgtgcggcctggtataccatccctttacagagtgtggcacccactgcgtgtgtggggcacggtatgatacgtctgaccgcatgaaactacatagagcctccggactctgccctggttacaagtcactgagggctgcccgggtcatgtgtaaaagcaagggcccagcaagtatcctttctatcattactgctgtgctgatcttgacattcgttacccccattaacgccatgatggtgggggaatccaaagagacttttgagctcgaagaactgcctgatgacatgttagaaatggcgaataacctgaatacatattacatgctctgcgtcgccaactatgcagtgacctggagccttctgatagtagctttgatcattggactactgttcaagaagtaccaacaccgcttcctcgacatctatgccatgtactgtgaggaatgcgatatgtaccacgaccgatcgggcatcaaatggaatggtgattttacgaacaagtgtgggcattgcacctgtggacagtatgaggacgcttctggcctgcttgttcacagaaaaacatacaactgcctgattcagtataagtccaaatggataatgaatttcttggtgacttacgtcatcctcgtgctgttaaaggattcagtcgtgattgttcaggccaagggcgtggactttagtgagtgcatcgaagcagagaaagtaaggtggaactgtaccgggccattcgtcaatctgggaaactgcgaaaagaaacaaaagaaagagccgtatagcaatattgccgctcagctaaagggtctcggcgcgatctccatactggatgtgcccatcattgcatctatccctgaagacattgccggggcccttcggtacatcgaggatcagcgtagctatcattcacaattgacagttgagtacgctatgctgactcgctactgtgactattacacccagtttagtgataactccggatatagccagacaacctggagagtgtacctcaggtctcacgacttcgaagcatgcgtcctgtatccaaatcagcatttttgtcggtgcgtgaagcacggcgacaaatgttcaagtagcaactgggatttcgcctccgagatgaagaattactattctggtaaacaatcgaagtttgacaaagatcttaacctggctttgactagcctccaccatgccttccgagggacgtcctcaagttacatagcaggcctgttatctagcaaggcgaatgacgaactggtacagtacacatccaagattcgcgagaaatttcccggaaacgctctactcaaggccgtgatcgattatattgcatacatgaaaggcctgaccgaaatgtcaaatttcaagaaagacgagttttgggatgagcttgtttatgtccctgacccaactaagcccccgaaattgagcagatcttccgggaccgtgtacgatttcaagagtgccacaagcaacctgggagaaaagaattgcaaagacgtgaagggtgtcgtttgtctctctcctaggtccggcgtgacctatgattcaatcatagcttgcggggagggaagtagccccaacatctaccggattccaaaaactggcgtgtatcagtcgaactccgaaccttctaattactgtgtaagcgactcacactgcctggaggatttcgaggtcatcaaccaggaagagttagacgccattaagaaaagtcgctgctgggaagtggactacctgtatgcaaatccctccaagcaatctgatggtatcagaagctgtaggatgcgtgacgctgggcattgcaacgttacaacgaatcggtggccaataattcagtgtgatgacaacaagtactattactccgagcttcagcgagattatgacaaagaacaggatatcggccacttttgcttgtcacccagatgtaccactgtgaggttccctatccacccaaagcatgtcagcaattgcgactggcaagtgagtcactctacagttgataaagtggacgtacataacctcgaggatattgagcagtaccgcaaggccatcacccagaaactgcaaaattccctaagcatttttaagtatgcgcggacaaagaacctgccgcacataaaacccatctacaagtacattactatcgaaggaaccgagacggccgaaggcattgagtcggcttatatcgaatcagagatacctgcactcgccgggacctctatcggattcaaaattaatacaaaggagggtaaacatctgcttgacgtcatcgcttacgtgaagcaggccagttattccagcttgtacaacaagatgtatgtgactggcccaaccgtcgggattaatacaaaacacgatgaactgtgtactggaccctgccctgttaacgtgccacactctgacggctggttaacctttgcaagagagaggacgagctcctggggttgtgaagagttcgggtgcctcgcgatctcagacggctgtgtatttggaagttgccaggatctgataaaggaggagcttgccgtgtaccgcaaagagacagaagaggctaccaatgtcgaactgtgcttgactttcagcgacaagacatattgtaccgagctcaaccccattactccgatcatcaccaacctgtttgaggtgcagttcaaaacagttgaaacgtactctctacctcgagtggtcgccgtgcaaaatcatgagattcggataggccagatcaacgatctggggatttactccaagggatgcggcaatgttcagaaagtgaacaataccatctatggtaacggggtcccaaagtttgactacctctgtcacctggcatcacgtaaggaagtaattgtgagaaaatgcttcgataatgactttcaggcttgtaagttccttcaaagtccccctagctataggttggaggaagatgacggatccatcactgttatagattacaaaaagatcctgggcacaattaaaatgaaggccatcttaggtgacgtgaagtataaaaccttcgcagagaacattgatatcacagccgagggcgtctgcactgggtgtgtgaattgctttgaaaacatacattgtgagctcaccattcacacgacaatcgaggcttcttgccccgtaacctcgccatgtactctgttccatgaccgcatccttattacccctgacgaacacaagtacgcgatgaaagtgatctgcacagaaaagcagactggaaccctgccctttaaaatatgcaatagcaaggtcgatgccacactaacgctcgttgaggcaaagccaattctggagttggcttcagtggaccagaccgcctatatccgggaaaaagatgagagatgtaagacttggatgtgcagggtgcgagacgaaggcattcaggtcatcctggagccgttcaaaaacttatttgggtcctacataggaattttctacacaagtatcctcatcgtgattaccatctttattataatctatgttattctgcctatctgtttcaaacttaaggatactctgcaaaagcacgaagacgcctacaagcgcgagatgaaaatccggtga

SEQ ID NO: 10944 - RNA, 4326 nt, synthetic construct
  misc_feature 1..4326: note = derived and/or modified CDS sequence (opt3) from CEV(BFS283)__AF123483.1__GP
  source 1..4326: mol_type = other RNA
atgatcttcattctgatactctttgccgtggctgcagccagccccgtctaccagagatgcttccaagacggcgcgatcgttaagcagaacccttccaaagaggctgtgaccgaagtatgtcttaaggatgacgtgtctatgattaaaacagaggccaggtatactaagaactcaacgggggtctttagtaacaatgtggcaatccggaaatggctggttagcgattggcacgactgccgcccacgaaaggtggtcggaggtcatattaacgtgatcgaagtaggcgatgacttgaccttacacacagagtcctacgtttgttctgccgattgcactataggggtggacaaggaaaccgctcaggtccgtctgcagacagataccactaatcatttcgagatcgcaggaacaaccgtgaaatcgggctggtttaagtcaacgacttatattagcctagaccaaacctgtgagcacctcaaagtgagttgcggtccgaagtccatccagttccatgcctgttttaaccagcacatgtcttgcgtcagattcctgcacaggacaattcttcccgggagcatcgctaattccatatgtcagaacgttgaaattatcattctggtgactttggccctcctgatctttatcctgctctcaattataagtaaaacctacatctgctatttactgatgcctattttcatcccaatagcgtacatttatggacttatctacaataagagctgtaagaaatgcaagttgtgcggcctggtataccatcccatcacagagtgtggcacccactgcgtgtgtggggcacggtatgatacgtctgaccgcatgaaactacatagagcctccggactctgccctggttacaagtcactgagggctgcccgggtcatgtgtaaaagcaagggcccagcaagtattctttctatcattactgctgtgctgatattgacatttgttacccccatcaacgccatgatggtcgggggatccaaagaaactttcgagctcgaggaactgcctgatgacatgttagagatggcgaataacctgaatacatattacatgctctgcgtgaccaactatgccgtgacgtggagccttctgattatcgcattggctatcggcctactgtttaagcgctaccaacaccgattcctcgacatttatgccatgtactgtgaagagtgcgatatgtaccacgacagatcgggtataaagtggaatggggatttcaccaacaaatgtggacagtgcacatgtggccagtatgaagacgcttctggcctgcttgtacataggaagacttacaactgcctgatccagtataaatccaagtggattatgaattttcttatcacctacgttattctcgtgctgttaaaagattcagtcgtgatcgtccaagccaaggggacagacttcagtgagtgcatagatgcagacaagatcaaatggaactgtactggaccatttgtgaatctgggtaactgcgagaagaaacagaagaaagaaccgtatagcaatattgccgctcagctaaagggcctctccgcgatctctattctggatgttcccatcatagcaagcattcctgaggacatcgccggggcccttcggtacattgaagatcaacgttcatatcacagtcagttgaccgtggagtacgctatgctgacacgctactgtgactattacacccagttctccgacaacagcggatattctcagactacgtggagagtatacctcaggtcacatgtctttgaagcatgcatcctgtatccaaatcaacacttctgtcggtgcgtgaagcatggcgataaatgtagtagctccaactgggactttgcctctgagatgaagaattactattcgggtaaacagaacaagttcaataaagatcttaacctggctttgacaagcctccaccacgcctttcgagggacctcctcaagttacatagcaggcctgttatctactaaggcgaatgacgagctggttcagtacaccagcaagatccgcgaaaaattccccggaaacgctctactcaaggccattatcgattatattgcatacatgaaaggcctgacagagatgtccaattttaagaaagacgagttctgggatgaacttgtgtatgtccctgacccaaccaagcccccgaaattgtcaagagggagcgaaactgtgtacgattttaagtctgccacatccaacctgggagagaagaactgcaaagacgtaaagggtgtggtttgtctcagtcctaggagcggcgtcacgtatgattctatcatagcttgcggggagggatcctcacccaatatttacaaaatcccaaagaccggcgtgtatcagagtaacagcgaaccttcgaattactgtgtgtccgactctcattgcctggaggatttcgaagtcatcagccaagaggagttagacgccattaaaaagtcacggtgctgggaagttgactacctgtatgcaaatcccccaaagcagagtgatggtgtgcgctcctgtagaatgaaagacgctgggcactgcaatgtgactacaaacaggtggcccatcattcagtgtgatgacaataagtactattactctgagcttcagcgtgattatgacaaagaacaagatataggccatttctgcttgagccctcggtgtgccaccgtacgatttccaatccacccgaagcacatttccaactgcgactggcaggtctcacatagcacagtggataaagttaatgtgcacaacctcgaggacatcgaacagtacagaaaggcgattactcagaagctgcaaaatagtctatctatcttcaaatatgccaggaccaagaacctgccccatataaaacctatctacaagtacattacgatcgagggaaccgagacagctgaaggcattgagtccgcatatatcgaaagcgagataccagccctcgctgggacttcgattggatttaaaatcaataccaaggaaggtaagcatctgcttgatgtcatcgcctacgtgaaacaggcatcatattctagtttgtacaacaagatgtatgttacaggccccactgtggggattaataccaaacacgacgagctgtgtacgggaccttgcccagtaaacgtcccccactccgatggctggttaacattcgcgcgcgagcggaccagctcttggggttgtgaagagtttgggtgcctcgccataagcgacggctgtgtgttcggatcctgccaggacctgatcaaggaggaacttactgtgtacagaaaagaaacagaggaggctaccaacgtcgaactgtgcttgacttttgccgataagacctattgtacagagctcaatccggttacgcctattatcaccaacctgttcgaagtgcaatttaaaactgtagagacatactcactaccaagggtggtcgcagtgcagaatcacgagattcgcatcggccagataaacgacctgggggtttacagtaagggatgcggcaatgtgcagaaggtcaacaataccatctatggtaacggggtgcccaaattcgattacctctgtcatctggctagccgaaaggaagttattgtgcggaaatgctttgacaatgatttccaagcctgtaagtttcttcagtctcctccctcctatcgtttggaggaagacgatggatcaatcacagtcattgactacaaaaagatcctgggcactataaagatgaaagcaattttaggtgatgtaaagtataaaaccttcgccgagaacatcgacatcacggctgaaggcgtgtgcacagggtgtattaattgcttcgagaacatccactgtgagctcaccatacatactaccattgaagcgagttgcccagttacaagcccttgtactctgtttcacgatagaatccttattacccccgacgagcataagtacgccatcaaagtgatatgcacagaaaagcagacgggaaccctgccattcaagatttgcaattccaaaatcgacgcaactctaacactcgtcgaggctaagccgatcctggaattggcccctgtggatcagaccgcctatattagggagaaagacgagcgctgtaagacttggatgtaccgggtaagagatgaaggcatccaagtgattctggagccctttaaaaacttattcgggtcttacataggaatcttttatacatcgattctcgtcgttatcgctatgttcatcattgtgtacgtgatactgccaatctgctttaagttgaaggacaccctgcagaggcacgaagatgcatataaacgagagatgaagattcgctga

SEQ ID NO: 10945 - RNA, 4329 nt, synthetic construct
  misc_feature 1..4329: note = derived and/or modified CDS sequence (opt3) from CHATV(Mohko ILO8-3)__KF719222.1__GP
  source 1..4329: mol_type = other RNA
atgatgatcttcattctgatactctttgccgtgagcgctgcatcccccgtctaccagagatgcttccaagacggcgccatcgttaagcagaacccttctaaagaggcggtgaccgaagtatgtcttaaggatgacgtgtcaatgattaaaacagaggctaggtatgtcaagaatgccactgggatctacagtaacaatgtggcaattcggaaatggctggttagcgattggcacgactgccgcccacgaaaggtgtccggaggtcatatcaacgtcatagaagtgggcgatgacttgtctttacacacggagtcgtatgtatgttcagccgattgcaccatcggggttgacaaggaaacagctcaggtgcgtctgcagactgataccacaaatcattttgagattgcaggaaccactgtcaaaagcggctggttcaagagtacaacctacatcacgctagaccaaacttgtgagcacctcaaagtgtcctgcggtccgaagtctgtgcagtttcatgcctgtttcaaccagcacatgagctgcgtcagatttctgcacaggaccattcttcccgggtccatcgctaattcaatatgtcagaacattgaaatcattatcctggttacattgactctcctgatcttcgtgctgctcagtattttaagcaaaacctatatatgctacctgcttatgcctatctttattccaatcgcctatatatacggaattatctacaataagtcttgtaagaaatgcaagttgtgcggcctggtatatcatcccttcacagagtgtggcacccactgcgtgtgtggggcgcggtacgatacgtccgaccgcatgaaactacatagatcaagcggactctgccctggttataagagtctgagggcagcccgggtcatgtgtaaatctaagggcccagcttccatccttagcattatcactgccattctggtgttgacatttgttacccccataaactcgatggtgatcggggaatctaaagaggtcttcgagctcgaggaactgcctgatgacatgttagaaatggcactgaagattaatctctactattttgtgtgcgtaatcaactacgctgttacttggtcccttgtgatcgtcgccctgttgattgcgctaatattcaagaaatatcaacaccgcttcctgaatctctacgccatgtactgtgaggaatgcgacatgtatcacgatcgaatcggactgaagagaaacggcgactttacaaataaatgtaggcagtgcacctgtggtcagtacgaggatgcaacggggcttatgacccatcggaagacatataactgcctggtgcagtacaaatcaaagtggattttgaacttcctcatcacttatatgattctgaccttaatcaaggacagtgctataatcgtccaagccgctggaacagattttagcgcctgcctggaggcacagtccgtggactggaattgtactggcccattcctaaacctcggcaattgccagaaacaacagaagaaagaatcttacgccaacattgctacccagctgaaggggcttcaggcgatcagcgttttggatgtgccgatgattgcaaatatccccgaggacatagccggagctctgcgttatattgaagagaaagatacatttcacgtacaactcaccgccgaatacgcaatgctgactcgctactgtgactattacacgcagttcgccgataactcaggttatagtcagacaacctggagagtctaccttaggtcccatgactttgacgcttgcatcctgtatcctaatcagcacttctgtcggtgcgtgaagcatggcgataagtgttctagctcaaactgggactttgccaatgagatgaaaaactactatagtgggaagcaaaataaattcgataaggacttgaacctcgcactgatggcggttcaccacgcttttcgaggaactagctccgcctacattgcaaccatgttatctaaaaagtcgaataacgatctggtgacatacaccaataagatcaaagagaagttcccaggcaacgccctactcaaagctataatggactatatcagctacatgaagggtctgtccgaaatgactaactttaaatatgatgagttctgggacgatcttttgcataagccctcacctacaaatgccccacccctgagtcgcgactctgaaccgagctacaacttcaaatccgtcatttcaagcagatctgtgaagtcctgcaagaatgtgaaaaacgtagtttgtctcagtcctaggagcggggtctcttatgattccatcctggcatgcggcgagcccaatggaccatcagtgtacaagaaacctagtgacggcgtgtttcagagcaactcggataagacgatgtattgtttagctgactcccactgcctggaagacttcgaggtcgtttctcaggaggaacttgatgccattaaaaagagcaagtgctgggtgaccgagtaccccaatgtgaaattgtcaaagctcagtgacgggatcacttcctgtcggatgaaagattctggaaagtgcaacgtagcggccaatcgctggccaataattcagtgtgaaaacgacaaattttactatagcgagctgcaaaatgattacgacaagacacaggatatcggtcatttctgcctatcccccggctgttcaaccatcagatttcctattaaccagaagcacatcagcaattgcaactggcaggtcagtaggtcttccattgctaaaatagacgtgcacgatatcgaggacattgatcaatatcgtaaggcaatcacacagaaactgcagactgggctcagcctgttcaagtacgccaaaaccaagaatcttccacatattaagccgatctataaatacataacgatcgaaggaaccgagacagctgaaggcattgagtcggcctatatcgaatcagagattcccgcattggcgggtacttctatcgggtttaagataaacagtaaagagggcaagcacctgttagacattgttggatacgtgaaatccgccagctactctagcgtctataccaagctctactccacaggccctacttcagggatcaacaccaaacatgatgaactgtgtacgggaccatgccccgtgaatatcaaccaccaaacaggttggcttaccttcgctaaggagcggacaagtagctggggctgtgaagagtttgggtgcctggccatttctgacggatgtgttttcggctcctgccaggacatagtgcgagatgaattgtcagtatatagaaaggagacagaggaagtcaccgacgtggagctctgcctgacttttagtgataaaacctactgtacaaatctaaaccctatcacgccaattatcaccgacctgttcgaagtgcagtttaagactgtcgagacatatagcctccccaggattgttgcaatccagaatcatgaagtgaaaataggtcaaatcaacgatctgggggtatactccaagggctgcggaaatgtgcagaaagtcaacggcaccgtgtatgggaatggagttccgaagttcgactacctttgtcacttggcttctcgcaaggaggtgattgtccggaaatgcttcgataacgactaccaggcctgtaagtttctgcagactcctgcatcgtatagattagaggaaagctcaggcactgtgaccgttatcgattacaaaaagattctcggtacgatcaaaatgaaggccatactgggggacgtgaagtataaaacattcgctgataatgtcgacatgaccgcggagggatcctgcgccggctgtattaactgctttgaaaatatccactgtgagcttactctgcataccacaatcgacgcaagttgcccagtaacttctccctgtaccgtgttccacgataggattctaatcacacctaacgagcataagtacgctatgaaagttatatgcacggaaaagcccggtaataccctcactattaaaatctgcggcacaaagattgacgccagcctggccttgatcgatgctaagccaatactggagttagcacctgtggaccaaaccgcctatattcgcgaaaaagatgagcgatgtaagacttggatgtgccgggtccgtgacgaagggctccaggtgatcctggagccctttaaaaaccttttcggatcctacatcggcatcttttatacattcattatttgtataatcgtactgttgattgtgatctacatcgtcctcccaatttgctttaagctgagagataccctaaggcagcacgaggacgcgtacaaacgcgaaatgaagatacggtga

SEQ ID NO: 10946 - RNA, 4329 nt, synthetic construct
  misc_feature 1..4329: note = derived and/or modified CDS sequence (opt3) from CHATV(Mohko M07-1)__KF719225.1__GP
  source 1..4329: mol_type = other RNA
atgatgatcttcattctgatactctttgccgtgagcgctgcatcccccgtctaccagagatgcttccaagacggcgccatcgttaagcagaacccttctaaagaggcggtgaccgaagtatgtcttaaggatgacgtgtcaatgattaaaacagaggctaggtatgtcaagaatgccactgggatctacagtaacaatgtggcaattcggaaatggctggttagcgattggcacgactgccgcccacgaaaggtgtccggaggtcatatcaacgtcatagaagtgggcgatgacttgtctttacacacggagtcgtatgtatgttcagccgattgcaccatcggggttgacaaggaaacagctcaggtgcgtctgcagactgataccacaaatcattttgagattgcaggaaccactgtcaaaagcggctggttcaagagtacaacctacatcacgctagaccaaacttgtgagcacctcaaagtgtcctgcggtccgaagtctgtgcagtttcatgcctgtttcaaccagcacatgagctgcgtcagatttctgcacaggaccattcttcccgggtccatcgctaattcaatatgtcagaacattgaaatcattatcctggttacattgactctcctgatcttcgtgctgctcagtattttaagcaaaacctatatatgctacctgcttatgcctatctttattccaatcgcctatatgtacggaataatttacaataagtcttgtaagaaatgcaagttgtgcggcctggtatatcatcccttcacagagtgtggcacccactgcgtgtgtggggcgcggtacgatacgtccgaccgcatgaaactacatagatcaagcggactctgccctggttataagagtctgagggcagcccgggtcatgtgtaaatctaagggcccagcttccatccttagcatcattactgccatcctggtgttgacatttgttacccccattaactcgatggtgataggggaatctaaagaggtcttcgagctcgaggaactgcctgatgacatgttagaaatggcactgaagatcaatctctactattttgtgtgcgtaattaactacgctgttacttggtcccttatcatcgtggccctgttgattgcgctaatattcaagaaatatcaacaccgcttcctgaatctctacgccatgtactgtgaggaatgcgacatgtatcacgatcgaatcggactgaagagaaacggcgactttacaaataaatgtaggcagtgcacctgtggtcagtacgaggatgcaacggggcttatgacccatcggaagacatataactgcctggtccagtacaaatcaaagtggattttgaacttcctcatcacttatatggtgctgaccttaattaaggacagtgctatcatagtccaagccgctggaacagattttagcgcctgcctggaggcacagtccgtggactggaattgtactggcccattcctaaacctcggcaattgccagaaacaacagaagaaagaatcttacgccaacatcgctacccagctgaaggggcttcaggcgattagcgttttggatgtgccgatgatcgcaaatattcccgaggacatcgccggagctctgcgttatatagaagagaaagatacatttcacgtacaactcaccgccgaatacgcaatgctgactcgctactgtgactattacacgcagttcgccgataactcaggttatagtcagacaacctggagagtctaccttaggtcccatgactttgacgcttgcattctgtatcctaatcagcacttctgtcggtgcgtgaagcatggcgataagtgtgggagctctaaccgagactttgccaatgagatgaaaaactactattcaggaaagcaaaataaattcgataaggacttgaacctcgcactgatggcggttcaccacgcttttcgcggcacaagtagcgcctacatcgcaaccatgttatccaaaaagtctaataacgatctggtgacatacaccaataagattaaagagaagttcccaggtaacgccctactcaaagctatcatggactatatatcgtacatgaaggggctgagcgaaatgactaactttaaatatgatgagttctgggacgatcttttgcataagccctcccctacaaatgccccacccctgtcaagagacagtgaaccgtcttacaacttcaaaagcgtcatctcctcaaggagcgtgaagtcttgcaagaatgtgaaaaacgtagtttgtctctcccctcggagtggcgtcagctatgattctattctggcatgcggagagcccaatggcccatccgtgtacaagaaaccttcagacgggatctttcagagtaacagcgataagacgatgtattgtttagctgactcgcactgcctggaagacttcgaggtggtctcccaggaggaacttgatgccattaaaaagtctaagtgctgggttaccgagtaccccaatgtgaaattgagcaagctctcagacggaatcacaagttgtcgcatgaaagattccggtaagtgcaacgtggcggccaatagatggccaataattcagtgtgaaaacgacaaattttactattctgagctgcaaaatgattacgacaagactcaggatatcggccatttctgcctaagccccgggtgttccaccatcaggtttcctattaaccagaagcacatctcaaattgcaactggcaggtaagccgtagttctattgctaaaatagacgtccacgatatcgaggacattgatcaatatcggaaggcaatcacacagaaactgcagactggactctccctgttcaagtacgccaaaaccaagaatcttccacatattaagccgatctataaatacataacgatcgaaggcaccgagacagctgaaggtattgagagcgcctatatcgaatcggagattcccgcattggcggggacttcaatcggctttaagataaactctaaagagggaaagcacctgttagacattgtgggctacgttaaaagtgcctcctacagctctgtgtataccaagctctacagcacagggcctacttccggaatcaacaccaaacatgatgaactgtgtacgggtccatgccccgtcaatatcaaccaccaaacaggctggcttaccttcgctaaggagcgaacttcaagttgggggtgtgaagagtttggatgcctggccattagcgacggctgtgtgttcggttcttgccaggacatagttagagatgaattgtccgtgtataggaaggagacagaggaagtaaccgacgtcgagctctgcctgactttttcagataaaacctactgtacaaatctaaaccctatcacgccaattatcaccgacctgttcgaagtgcagtttaagactgtggagacatatagtctcccccgcattgtcgcaatccagaatcatgaagttaaaatagggcaaatcaacgatctgggcgtgtacagcaagggatgcggcaatgtacagaaagtgaacgggaccgtctatggaaatggcgtgccgaagttcgactacctttgtcacttggcttcccggaaggaggttattgtgagaaaatgcttcgataacgactaccaggcctgtaagtttctgcagactcctgcatcttataggttagaggaaaattcgggtactgtcaccgtgatcgattacaaaaagattctcgggacgatcaaaatgaaggccatactgggagacgttaagtataaaacattcgctgataacgtggacatgaccgcggagggcagctgcgccggttgtattaattgctttgaaaacatccactgtgagcttactctgcataccacaatcgacgcatcatgcccagtcacttccccctgtaccgtattccacgatcgcattctaatcacacctaatgagcataagtacgctatgaaagtgatatgcacggaaaagcccggcaacaccctcactattaaaatctgcgggacaaagattgacgccagtctggccttgatcgatgctaagccaatactggagttagcacctgttgaccaaaccgcctatattcgagaaaaagatgagcggtgtaagacttggatgtgccgtgtgagagacgaaggactccaggtcatcctggagccctttaaaaaccttttcggctcttacatcgggatcttttatacattcattatttgtatgatagtgctgttgatcgtaatttacatcgtgctcccaatctgctttaagctgagggataccctacgccagcacgaggacgcgtacaaacgggaaatgaagattagatga

SEQ ID NO: 10947 - RNA, 4329 nt, synthetic construct
  misc_feature 1..4329: note = derived and/or modified CDS sequence (opt3) from CHATV(Mohko M07-2-83)__KF719228.1__GP
  source 1..4329: mol_type = other RNA
atgatgatcttcattctgatactctttgccgtgagcgctgcatcccccgtctaccagagatgcttccaagacggcgccatcgttaagcagaacccttctaaagaggcggtgaccgaagtatgtcttaaggatgacgtgtcaatgattaaaacagaggctaggtatgtcaagaatgccactgggatctacagtaacaatgtggcaattcggaaatggctggttagcgattggcacgactgccgcccacgaaaggtgtccggaggtcatatcaacgtcatagaagtgggcgatgacttgtctttacacacggagtcgtatgtatgttcagccgattgcaccatcggggttgacaaggaaacagctcaggtgcgtctgcagactgataccacaaatcattttgagattgcaggaaccactgtcaaaagcggctggttcaagagtacaacctacatcacgctagaccaaacttgtgagcacctcaaagtgtcctgcggtccgaagtctgtgcagtttcatgcctgtttcaaccagcacatgagctgcgtcagatttctgcacaggaccattcttcccgggtccatcgctaattcaatatgtcagaacattgaaatcattatcctggttacattgactctcctgatcttcgtgctgctcagtattttaagcaaaacctatatatgctacctgcttatgcctatctttattccaatcgcctatatgtacggaataatttacaataagtcttgtaagaaatgcaagttgtgcggcctggtatatcatcccttcacagagtgtggcacccactgcgtgtgtggggcgcggtacgatacgtccgaccgcatgaaactacatagatcaagcggactctgccctggttataagagtctgagggcagcccgggtcatgtgtaaatctaagggcccagcttccatccttagcatcattactgccatcctggtgttgacatttgttacccccattaactcgatggtgataggggaatctaaagaggtcttcgagctcgaggaactgcctgatgacatgttagaaatggcactgaagatcaatctctactattttgtgtgcgtaattaactacgctgttacttggtcccttatcatcgtggccctgttgattgcgctaatattcaagaaatatcaacaccgcttcctgaatctctacgccatgtactgtgaggaatgcgacatgtatcacgatcgaatcggactgaagagaaacggcgactttacaaataaatgtaggcagtgcacctgtggtcagtacgaggatgcaacggggcttatgacccatcggaagacatataactgcctggtccagtacaaatcaaagtggattttgaacttcctcatcacttatatggtgctgaccttaattaaggacagtgctatcatagtccaagccgctggaacagattttagcgcctgcctggaggcacagtccgtggactggaattgtactggcccattcctaaacctcggcaattgccagaaacaacagaagaaagaatcttacgccaacatcgctacccagctgaaggggcttcaggcgattagcgttttggatgtgccgatgatcgcaaatattcccgaggacatcgccggagctctgcgttatatagaagagaaagatacatttcacgtacaactcaccgccgaatacgcaatgctgactcgctactgtgactattacacgcagttcgccgataactcaggttatagtcagacaacctggagagtctaccttaggtcccatgactttgacgcttgcattctgtatcctaatcagcacttctgtcggtgcgtgaagcatggcgataagtgtgggagctctaactgggactttgccaatgagatgaaaaactactattcaggaaagcaaaataaattcgataaggacttgaacctcgcactgatggcggttcaccacgcttttcgaggcacaagtagcgcctacatcgcaaccatgttatccaaaaagtctaataacgatctggtgacatacaccaataagattaaagagaagttcccaggtaacgccctactcaaagctatcatggactatatatcgtacatgaaggggctgagcgaaatgactaactttaaatatgatgagttctgggacgatcttttgcataagccctcccctacaaatgccccacccctgtcacgcgacagtgaaccgtcttacaacttcaaaagcgtcatctcctcaagaagcgtgaagtcttgcaagaatgtgaaaaacgtagtttgtctctcccctaggagtggcgtcagctatgattctattctggcatgcggagagcccaatggcccatccgtgtacaagaaaccttcagacgggatctttcagagtaacagcgataagacgatgtattgtttagctgactcgcactgcctggaagacttcgaggtggtctcccaggaggaacttgatgccattaaaaagtctaagtgctgggttaccgagtaccccaatgtgaaattgagcaagctctcagacggaatcacaagttgtcggatgaaagattccggtaagtgcaacgtggcggccaatcgctggccaataattcagtgtgaaaacgacaaattttactattctgagctgcaaaatgattacgacaagactcaggatatcggccatttctgcctaagccccgggtgttccaccatcagatttcctattaaccagaagcacatctcaaattgcaactggcaggtaagcaggagttctattgctaaaatagacgtccacgatatcgaggacattgatcaatatcgtaaggcaatcacacagaaactgcagactggactctccctgttcaagtacgccaaaaccaagaatcttccacatattaagccgatctataaatacataacgatcgaaggcaccgagacagctgaaggtattgagagcgcctatatcgaatcggagattcccgcattggcggggacttcaatcggctttaagataaactctaaagagggaaagcacctgttagacattgtgggctacgttaaaagtgcctcctacagctctgtgtataccaagctctacagcacagggcctacttccggaatcaacaccaaacatgatgaactgtgtacgggtccatgccccgtcaatatcaaccaccaaacaggctggcttaccttcgctaaggagcggacttcaagttgggggtgtgaagagtttggatgcctggccattagcgacggctgtgtgttcggttcttgccaggacatagttcgagatgaattgtccgtgtatagaaaggagacagaggaagtaaccgacgtcgagctctgcctgactttttcagataaaacctactgtacaaatctaaaccctatcacgccaattatcaccgacctgttcgaagtgcagtttaagactgtggagacatatagtctccccaggattgtcgcaatccagaatcatgaagttaaaatagggcaaatcaacgatctgggcgtgtacagcaagggatgcggcaatgtacagaaagtgaacgggaccgtctatggaaatggcgtgccgaagttcgactacctttgtcacttggcttcccgcaaggaggttattgtgcggaaatgcttcgataacgactaccaggcctgtaagtttctgcagactcctgcatcttatagattagaggaaaattcgggtactgtcaccgtgatcgattacaaaaagattctcgggacgatcaaaatgaaggccatactgggagacgttaagtataaaacattcgctgataacgtggacatgaccgcggagggcagctgcgccggttgtattaattgctttgaaaacatccactgtgagcttactctgcataccacaatcgacgcatcatgcccagtcacttccccctgtaccgtattccacgataggattctaatcacacctaatgagcataagtacgctatgaaagtgatatgcacggaaaagcccggcaacaccctcactattaaaatctgcgggacaaagattgacgccagtctggccttgatcgatgctaagccaatactggagttagcacctgttgaccaaaccgcctatattcgcgaaaaagatgagcgatgtaagacttggatgtgccgggtgcgtgacgaaggactccaggtcatcctggagccctttaaaaaccttttcggctcttacatcgggatcttttatacattcattatttgtatgatagtgctgttgatcgtaatttacatcgtgctcccaatctgctttaagctgagagataccctaaggcagcacgaggacgcgtacaaacgcgaaatgaagattcggtga

SEQ ID NO: 10948 - RNA, 4326 nt, synthetic construct
  misc_feature 1..4326: note = derived and/or modified CDS sequence (opt3) from CHATV(LEIV-15854)__HQ734820.1__GP
  source 1..4326: mol_type = other RNA
atgatcttcattctgatactctttgccgtgagcgctgcatcccccgtctaccagagatgcttccaagacggcgccatcgttaagcagaacccttctaaagaggcggtgaccgaagtatgtcttaaggatgacgtgtcaatgattaaaacagaggctaggtatgtcaagaatgccactgggatctacagtaacaatgtggcaattcggaaatggctggttagcgattggcacgactgccgcccacgaaaggtgtccggaggtcatatcaacgtcatagaagtgggcgatgacttgtctttacacacggagtcgtatgtatgttcagccgattgcaccatcggggttgacaaggaaacagctcaggtgcgtctgcagactgataccacaaatcattttgagattgcaggaaccactgtcaaaagcggctggttcaagagtacaacctacatcacgctagaccaaacttgtgagcacctcaaagtgtcctgcggtccgaagtctgtgcagtttcatgcctgtttcaaccagcacatgagctgcgtcagatttctgcacaggaccattcttcccgggtccatcgctaattcaatatgtcagaacattgaaatcattatcctggttacattgactctcctgatcttcgtgctgctcagtattttaagcaaaacctatatatgctacctgcttatgcctatctttattccaatcgcctatgtatacggaataatttacaataagtcttgtaagaaatgcaagttgtgcggcctggtgtatcatcccttcacagagtgtggcacccactgcgtctgtggggcgcggtacgatacgtccgaccgcatgaaactacatagatcaagcggactctgccctggttataagagtctgagggcagcccgggtgatgtgtaaatctaagggcccagcttccatccttagcatcattactgccatcctggttttgacatttgtgacccccattaactcgatggtcataggggaatctaaagaggtgttcgagctcgaggaactgcctgatgacatgttagaaatggcactgaagatcaatctctactattttgtatgcgttatgaactacgctgtgacttggtcccttgtcattgtggccctgttgatcgcgctaatcttcaagaaatatcaacaccgcttcctgaatctctacgccatgtactgtgaggaatgcgacatgtatcacgatcgaattggactgaagagaaacggcgactttacaaataaatgtaggcagtgcacctgtggtcagtacgaggatgcaacggggcttatgacccatcggaagacatataactgcctggtccagtacaaatcaaagtggatattgaacttcctcatcacttatatggtgctgaccttaattaaggacagtgctatcattgttcaagccgctggaacagattttagcgcctgcctggaggcacagtccgtggactggaattgtactggcccattcctaaacctcggcaattgccagaaacaacagaagaaagaatcttacgccaacatcgctacccagctgaaggggcttcaggcgataagcgtattggatgtcccgatgatcgcaaatattcccgaggacatcgccggagctctgcgttatattgaagagaaagatacatttcacgtgcaactcaccgccgaatacgcaatgctgactcgctactgtgactattacacgcagttcgccgataactcaggttatagtcagacaacctggagagtttaccttaggtcccatgactttgacgcttgcatcctgtatcctaatcagcacttctgtcggtgcgtgaagcatggcgataagtgttctagctcaaactgggactttgccaatgagatgaaaaactactatagtgggaagcaaaataaattcgataaggacttgaacctcgcactgatggcggtccaccacgcttttcgaggaactagctccgcctacatagcaaccatgttatctaaaaagctgaataacgatctaattacatacaccaataagatcaaagagaagttcccaggcaacgccctcctgaaagctattatggactatatctcgtacatgaagggtcttagcgaaatgactaactttaaatatgatgagttctgggacgatttgctgcataagccctcccctacaaatgccccacccctctcacgcgacagtgaaccgtcttacaacttcaaaagcgtgatatcctcaagaagcgtaaagtcttgcaagaatgtgaaaaacgttgtctgtctgtcccctaggagtggggcaagctatgattctatcttagcttgcggcgagcccaatggaccatccgtgtacaagaaaccttcagacggcgtgtttcagagtaacagcgataagacgatgtattgtctggccgactcgcactgccttgaagacttcgaggtcgtttcccaggaggaattggatgcgattaaaaagtctaagtgctgggtgaccgagtaccccaatgtgaaactcagcaagctgtcagacgggatcacaagttgtcggatgaaagattccggaaagtgcaacgtagccgctaatcgctggccaattatccagtgtgaaaacgacaaattttactattctgagctacaaaatgattacgacaagacacaggatataggtcatttctgcctgagccccggctgttccaccattagatttcctatcaaccagaagcacatctcaaattgcaactggcaggtcagcaggagttctattgcaaaaatcgacgtgcacgatattgaggacatagatcaatatcgtaaggccatcacacagaaactccagactgggctgtcccttttcaagtacgctaaaaccaagaatttgccacatattaagccgatctataaatacattacgatcgaaggaaccgagacagccgaaggcatagagagcgcatatatcgaatcggagattcccgcgctggccggtacttcaatcgggtttaagattaactctaaagagggcaagcacttactcgacatcgttggatacgtgaaaagtgcttcctacagctctgtctataccaagctgtacagcacaggccctacttccgggataaacaccaaacatgatgaactttgtacgggaccatgccccgtgaatattaaccaccaaacaggttggctgaccttcgccaaggagcggacttcaagttggggctgtgaagagtttgggtgcttggcaatcagcgacggatgtgttttcggctcttgccaggacatcgtgcgagatgaactctccgtatatagaaaggagacagaggaagtcaccgacgtggagctgtgcctaactttttcagataaaacctactgtacaaatctgaaccctattacgccaataatcaccgacctcttcgaagtgcagtttaagactgtcgagacatatagtctgcccaggattgttgctgtgcagaatcatgaagtaaaaatcggtcaaattaacgatcttgggatctacagcaagggctgcggaaatgtgcagaaagtcaacggcaccgtgtatgggaatggagttccgaagttcgactacttgtgtcacctggcctcccgcaaggaggtgatagtccggaaatgcttcgataacgactaccaggcatgtaagtttttacagactcctgcctcttatagactcgaggaaaattcgggcactgtgaccgttatcgattacaaaaagattctgggtacgatcaaaatgaaggctattcttggggacgtgaagtataaaacattcgcggataacgtcgacatgaccgccgagggaagctgcgcaggctgtatcaattgctttgaaaacatacactgtgagctgactctacataccacaattgacgcttcatgcccagtaacttccccctgtaccgtgttccacgataggatcctcatcacacctaatgagcataagtacgccatgaaagttatttgcacggaaaagcccggtaacaccctgactatcaaaatatgcagtacaaagattgacgcctctttggctctgatcgatgcaaagccaattttagagctcgcccctgtggaccaaaccgcgtatatccgcgaaaaagatgagcgatgtaagacttggatgtgccgggtccgtgacgaaggccttcaggtgatactggagccctttaaaaacctgttcgggagctacattggaatcttttatacattcatcatttgtgtaatcgtgttgctcattgtcatatacatcgttctgccaatttgctttaagctaagagataccctgaggcagcacgaggacgcttacaaacgcgaaatgaagatccggtga

SEQ ID NO: 10949 - RNA, 4326 nt, synthetic construct
  misc_feature 1..4326: note = derived and/or modified CDS sequence (opt3) from CHATV(LEIV-17756)__EU621834.1__GP
  source 1..4326: mol_type = other RNA
atgatcttcattctgatactctttgccgtgagcaccgcttcccccgtctaccagagatgcttccaagacggcgcaatcgttaagcagaacccttctaaagaggccgtgacagaagtatgtcttaaggatgacgtgtcaatgattaaaactgaggcgaggtatatccggaatgctacggggacctttagtaacaatgtcgccattcgcaagtggatcgtgagcgattggcacgactgccgaccaaagaaggtttccggaggtcatataaacgtgatcgaagtcggcgatgacctgtctttgcacacagagtcgtacgtgtgttcagcagattgcactattggggtagacaaggaaaccgcccaggttcgtttacagacagataccactaatcatttcgagatcgctggaacaaccgtgaaaagcggctggtttaagagtacgacttatattaccctggaccaaacatgtgagcacctaaaagtctcctgcggtccgaagtctgtgcagttccatgcatgttttaaccagcacatgagctgcgtgagattcctccacaggactatcctgcccgggtccatagccaattcaatttgtcagaacatcgaaattatcatccttgtcaccctgacattgctcatttttgttctgctgagtatactcagcaaaacctacatctgctatttactgatgcctattttcatcccaatagcttacatttatggaatcatctacaataagtcttgtaagaaatgcaaactttgcggcttggtgtaccatccctttacggagtgtggcactcactgcgtatgtggggcccggtatgatacatccgaccgcatgaaactgcatagatcaagcggactatgccctggttacaagagtctcagggcggcacgggtgatgtgtaaatctaagggcccagcctccattctgagcatcattaccgctatacttgtcctgactttcgtgacacccatcaactcgatggttgtgggggaatctaaagaggtctttgagttggaagaactccctgatgacatgctggaaatggccttaaagattaatttctattacttcgtgtgcgtaatgaactatgcagttacctggggactgatcgtggtcgctctccttatcggcctgatttttaagaaataccaacaccgcttcttgaatctatatgccatgtactgtgaggaatgcgacatgtaccacgatcgaacgggtctgaagagaaacggggactttaccaataaatgtaggcagtgcacatgtggacagtatgaggatgcgactggcctcatgacccatcggaagacatacaactgcctggtgcagtataaatccaagtggatacttaacttcctgatcacttacatggtcttgaccctcattaaggactcagccatcgtggttcaagcaacaggcaccgattttagtagctgcctggagactcagtccgtgaattggaactgtacggggccattcttaaatctgggaaactgccagaaacaacagaagaaagaatcttatgctaatattgccacacagctaaagggtctccaggctatcagcgtactggacatgccgatgatagcctcaatccccgaggatattgcaggcgcccttcgttacatcgaggagcgcgaaacctttcacgtccaattgactgctgagtatgcgatgctgaccagatactgtgactactatacacagttcgcagataacagtgggtactcccagaccacttggagggtgtatctccggagccatgactttgatgcctgcattctgtaccctaatcagcacttctgtcgatgcgttaaacatggagacaagtgttcttcaagtaactgggactttgctaatgagatgaagaactattacagcggcaaacaaaataagttcgataaagaccttaacctggccttgatgacaatgcaccacgcatttcgcggtacgtcctctgcctatatcgctgccctcctgtcgaagagaagcaatgatgacttagtggcatacaccaacaaaataaaggaaaagttcccagggaatgcgctgctaaaagctgtcatggattacatttcctatatgaagtcactcagtgagatgtctaacttcaaatacgacgaattttgggatgacctgcttcataagcccaaccctactaaagcccccagcttgtccaggggcgatgagccagcatataatttcaagctggccatctcaagccggtctatgaaatcctgcaagaacgtgaagagtgtagtgtgtctcagcccgcgctctggagtttcctacgactcaattctggcttgcggcgaacctaatgcccccagtgtccacagaaaaccaagcgatggggtgtttcagtcgaactccgacaagacaatgtattgtttagcagattctcattgcctggaggacttcgaggtggtcagccaggaggagcttgacgctatcaaaaagtcagaatgctgggttaccgagtaccctaatgtgaaattgagtaagctctccgatggaataaagtcttgtaggatgaaagacagcggtaagtgcaacgtggccacaaatcgttggcccatcattcagtgtgagaacgataaattttattactccgaactgcaaaatgactacgataagactcaggacatcggccacttctgcctatcaccagggtgtagcaccattcggtttcccatcaaccagaaacacataagtaattgcaactggcaggtatctcgatccagcattgcgaagatcgatgtccataatatcgaggacattgaacaatatagaaaggccatcacgcagaaactgcagacctcgctctcactgttcaagtacgctaggactaaaaaccttcctcacattaagccaatatataaatacatcacaattgagggaaccgaaacagcagagggcatcgagtctgcctatattgaaagtgagatcccggctttggccggtacttccatagggtttaagatcaatagcaaggaaggcaaacatctgttagatgtgattggatacgttaagtctgcaagctattcctcagtgtacaccaaactctacagtacgggccccacaagcgggatcaacaccaagcacgacgagctgtgtactggaccttgcccagcgaacattaaacatcaaacaggttggcttaccttcgcccgcgaacggacttcttcctggggctgtgaggagtttgggtgcctggctatctcagatggatgtgtcttcggcagttgccaggacatagtgagagatgaattgagcgtttataggaaggagaccgaagaggtgacagacgtagaactctgcctgacgttttccgacaaaacctactgtactaatctaaaccccattacacctatcatcaccgatctgttcgaggtccagttcaagacagtggagacttattctctcccacgcattgtggccatacagaatcacgaaatcaagattggtcaaatcaacgacctgggggtctactcgaaaggctgcggaaatgttcagaaggtgaacggcaccgtatatgggaatggagtgcccaaatttgattacctttgtcacttggcaagccgaaaggaggtcattgtgcggaaatgcttcgacaacgattatcaggcttgtaagtttctgcagacgccggcctcataccgtttagaagaaaattccggcacagttaccgtgatcgactacaagaaaatactcggtactatcaagatgaaagcaattctgggggatgtcaagtataaaaccttcgccgacaacgtggatatcacagctgagggaagttgcactggctgtattaattgctttgaaaacatccattgtgagcttaccatacacacaacgattgacgcgtcttgccctgttaccagcccatgtactgtgttccatgatagaatcctggtcacacccaatgaacacaagtacgccatgaaggtaatctgcaccgagaaacctggttccactctagcaattaagatctgcaacacaaaaatagacgcttcactcgccctgattgacgccaagcccatcttggaactggctccagtggatcaaaccgcatatattagggagaaagacgagcgctgtaagacgtggatgtgccgggttagagatgaaggcttacaggtgatcctcgagccttttaagaatctgttcgggtcttacataggaatcttttatactttcgtcattagcatcattgcccttctgatcgtgatttacataatcttgcccatttgttttaaactcagggacaccctgcgaaagcatgaagatgcgtataaacgcgagatgaagatccggtga

SEQ ID NO: 10950 - RNA, 4326 nt, synthetic construct
  misc_feature 1..4326: note = derived and/or modified CDS sequence (opt3) from CHATV(LEIV-18733)__HQ734821.1__GP
  source 1..4326: mol_type = other RNA
atgatcttcattctggtgctccttgccgtcagcaccgcttcccccgtttaccagagatgctttcaagacggcgcaatagtgaagcagaacccttctaaagaggccgtaacagaagtgtgtctgaaggatgacgtctcaatgatcaaaactgaggcgaggtatatgaagaatgctacggggaccttcagtaacaatgtggccattcggaaatggttggttagcgattggcacgactgccgcccaaagaaggtgtccggaggtcatatcaacgtcattgaagtgggcgatgacttatctctgcacacagagtcgtacgtatgttcagcagattgcactatcggggttgacaaagaaaccgcccaggtgcgactacagacagataccactaatcattttgagatagctggaacaaccgtcaagagcggctggttcaaaagtacgacttatatcaccctcgaccaaacatgtgagcacctgaaggtgtcctgcggtccgaaatctgtgcagtttcatgcatgtttcaaccagcacatgagctgcgtccgttttcttcacagaactgttctgcccgggtccattgccaattcaatctgtcagaacattgaaatcataattttggtgaccctcacactgctgatcttcgtactcttaagtattctgagcaagacctacatctgctatcttttgatgcctatctttattccaatagcttacgtgtatggaatcatttacaataagtcttgtaaaaagtgcaaactgtgcggcctagtctaccatcccttcacggagtgtggcactcactgcgtgtgtggggccaggtatgatacatccgaccggatgaagctccatcgctcaagcggactgtgccctggttacaaaagtcttagagcggcaagggttatgtgtaagtctaaaggcccagcctccatcctgagcataattaccgctatcttggtgctcacttttgtcacacccatcaactcgatggtgattggggaatctaaggaggtattcgagctggaagagttacctgatgacatgctggaaatggccctcaagatcaatttttattacttcgtttgcgtgattaactatgcagtcacctggggacttatagtggtcgctctgttgatcggcctagtgttcaaaaagtaccaacaccggtttctgaatctctatgccatgtactgtgaggaatgcgacatgtaccacgatcgcacgggtctgaaacgaaacggggacttcaccaataagtgtagacagtgcacatgtggacagtatgaggatgcgactggccttattacccataggaaaacatacaactgcctggttaagtataagtccaaatggatcttgaactttctcatcacttacatggtgctgaccttaattaaggactcagccatagtagtccaggcagctggcacagatttcagtgcctgcctggaggctcaaagcgtggactggaattgtaccgggccatttctaaacctcggaaattgccagaaacagcaaaagaaagaatcctatgccaacatcgcaactcagctgaagggtcttcaggccatttctgttttggatatgccgatgatcgctagcattcccgaggacatcgcgggcgcactgcggtacatagaagagaaggaaacgttccacgtgcagctcacagccgagtatgctatgctgacccgttactgtgattactatactcaatttgccgacaattcagggtacagtcagaccacatggcgcgtctatcttagatcccatgatttcgacgcatgcatcctgtaccctaaccagcacttttgtaggtgcgtgaaacatggagacaagtgttcgtcttcaaattgggatttcgccaacgagatgaaaaattattacagtggcaagcagagcaaatttgacaaggatttgaacctcgctctgatgaccgtacaccacgccttccggggtacttcctctgcatatattgcgacaatgttatcgaagaaaagcaataacgacctggtggcttacacgaataagatcaaagaaaagtttccagggaacgccctactcaaagcagttatggattacatttcctatatgaagtcactgagtgagatgaccaatttcaaatacgacgagttctgggatgaccttttgtatcgacccaaccctactaaggccccatctctgagccgcgaatccgaaacatcatacaactttaagctcgtcatcagccccaaatctatgaagtcctgcaaaaatgtgaagagtgtggtctgtctgagcccgagatctggcgcttcctatgattcaatattagcctgcggagagcctaacggccccagtgtttacaggaaaccaagcgggggagtgttccaaagcaattccgacaagaccatgtattgtctggcagattctcattgccttgaggactttgaagtgattggtcaggaggaattggatgctatcaagaaaagcgtatgctgggccgtcgagtaccctgacgtgacactctcaaagctgagtgacggcgttaaatcctgtcggatgaaggattctgggaaatgcaacgtggcggccaatcgctggcccattatccagtgtgagaacgacaagttctactatagcgaactacagaatgattacgacaagactcaagatataggacacttttgcctgtccccaggctgttcaaccgtcagattccccatcaaccagaaacatattagcaattgcaactggcaagtgagtaggtcttccatcgctaagattgacgttcacgatatcgaggacatagatcagtatcgtaaagcaattacgcagaagctccagaccagcctgtcgctttttaaatacgccaagacaaagaatttgcctcacatcaaaccaatctataagtacattactatcgaaggtaccgagacagctgaagggattgagtcagcctatatagagtctgaaatcccggcactggcgggcaccagtgtgggattcaaaattaactccaaggagggcaaacatttactcgacatcattgggtacgtaaagagcgcctcttacagctccgtctatactaaactgtactcaacgggacccacaagtggtatcaataccaagcacgatgaactttgtactggcccttgcccagctaacataaatcatcagaacgggtggctgacatttgccaaggagcggaccagctcttggggatgtgaagagttcggctgcttggcaatctccgacggttgtgtgtttgggtcatgccaagatattgtgcgagacgagctcagtgtctatagaaaagaaactgaggaagttaccgacgtggagctgtgcctaacattcagcgataagacgtactgtaccaacctgaatcccatcactcctattatcacagacctctttgaagtacagttcaaaaccgtggagacatattccctgccaaggatagtcgctattcagaaccacgagatcaagatcggccagattaatgatcttggagtgtactctaaaggctgcgggaacgttcaaaaggtgaatggaactgtctatggcaacggtgtgcccaagttcgactacttgtgtcatctggcctcgcgcaaagaagttatagtgcggaagtgctttgataatgactaccaggcatgtaaattcttacagaccccggccagctatagactcgaggaaaactcagggacgatcacagtcattgattacaagaaaatcctgggaaccattaagatgaaggctatccttggcgacgtaaaatataagacttttgcggataatgtggacataaccgttgagggttcctgcgccggctgtatcaactgcttcgagaatattcactgtgaactgacaatccacactaccattgaggcaagttgccctgtgacatctccatgtacggtctttcatgataggatcctaataacccccaacgaacacaaatacgctatgaaggtggtatgcactgagaaacctgggaatacactcaccctgaaggtgtgcaacactaaggtcgacgccagcttggccctgattgacgctaaacccatcttagaactcgcaccagttgatcagacagcctatatccgcgagaaggacgagcgatgtaaaacctggatgtgccgggtgcgtgatgaaggactgcaagtgattcttgagcctttcaagaatctgtttggctcctacatcgggatattctatacgattatcatttcaatcatagtcttgctcattgtgatctacatcattctgcccgtttgttttaaactaagagacactctgaggcagcatgaagatgcgtacaagcgcgagatgaaggtacggtga

SEQ ID NO: 10951 - RNA, 4326 nt, synthetic construct
  misc_feature 1..4326: note = derived and/or modified CDS sequence (opt3) from CHATV(LEIV-22712)__HQ734822.1__GP
  source 1..4326: mol_type = other RNA
atgatcttcattctgatactctttgccgtgagcgctgcatcccccgtctaccagagatgcttccaagacggcgccatcgttaagcagaacccttctaaagaggcggtgaccgaagtatgtcttaaggatgacgtgtcaatgattaaaacagaggctaggtatactaagaatgccacggggacctttagtaacaatgtcgcaatccggaaatggctggtgagcgattggcacgactgccgcccaaagaaggtttccggaggtcatattaacgtgatcgaagtcggcgatgacttgtctttacacacagagtcgtacgtgtgttcagccgattgcactataggggtagacaaagaaaccgctcagatccgactgcagacagataccactaatcatttcgagattgcaggaacaaccgttaagagcggctggtttaaaagtacgacttatatcaccctagaccaaacatgtgagcacctcaaggtgtcctgcggtccgaaatctgtccagttccatgcctgttttaaccagcacatgagctgcgtgcgtttcctgcacagaactgtgcttcccgggtccattgctaattcaatctgtcagaacatagaaattatcattctggtcaccttgacactcctgatctttgttctgctcagtatcttaagcaagacctacatttgctatctgcttatgcctatattcatcccaattgcctacgtgtatggaatcatatacaataagtcttgtaaaaagtgcaaattgtgcggcctggtataccatccctttacggagtgtggcactcactgcgtgtgtggggcgaggtatgatacatccgaccggatgaagctacatcgctcaagcggactctgccctggttacaaaagtctgagagcagccagggtcatgtgtaagtctaaaggcccagcttccgtgcttagcattatcaccgccatcctggttttgactttcgtgacacccattaactcgatggtcgtgggggaatctaaggaggtatttgagctcgaagaactgcctgatgacatgttagaaatggcactgaagatcaatttctattacttcatttgcgttatgaactatgctgtgacctggggactcatagtcgtgggccttctgatcggtttggtctttaaaaagtaccaacaccggttcctaaatctgtatgccatgtactgtgaggaatgcgacatgtaccacgatcgcacggggctcaaacgaaacggagactttaccaataagtgtagacagtgcacatgtggccagtatgaggatgcgactggcctgattacccataggaaaacatacaactgccttgtgcagtataagtccaagtggatcctgaacttcttgatcgcctacatgactctcaccctgattaaagactcagcaataatcgttcaagctacagggaccgattttattagttgcttagagactcagagcgtgaattggaactgtacgggaccattcctgaatctaggtaactgccagaagcaacagaaaaaggaaccgtatgccaatatcgctacacagctcaaaggcctgcaggccatttccgtacttgacatccccatgatagcaaacatccctgaggatattgccggggctttgcggtacatcgaagagaaggaaacctttcacgtccaactgactgcggagtatgcaatgctcacccgttactgtgactactatacacagttcgccgataattctggatacagccagaccacttggcgcgtgtatctgagatcacatgactttgatgcttgcattctttacccaaaccagcacttctgtaggtgcgttaagcatggcgacaaatgtagttccagcaattgggactttgccaacgagatgaagaattattactctggtaaacaatcaaagttcgataaagacctgaacttggcactcatgacaatgcaccacgcctttcgggggacgagtagcgcttatatcgccaccctgttatccaagaagctgaatgatgacctagcagcgtacactaacaaaataaaggaaaaattccccggcaatgctctcctgaaggccatgatggattacatttcttatatgaaatcgcttagcgagatggcaaacttcaagtacgacgaattttgggatgacttgctgcataaacctgatccaacaaaggctcccctcctgtcccgaggatcagagccggtgtataacttcaagttagtcgtgagttctcgcagcgtaaaatcctgcaagaatgtgaaatcagttgtctgtctgagccctagatctggcgtgtcctacgacagtgtgcttgcctgcggggaacccaacggaccaagcgtctataggaagccttctgatggtgtttttcagtccaattcagacaaaaccatctactgtttggccgatagtcactgcctcgaggacttcgaggtgattagccaggaggagctggacgcaatcaagaagtcggaatgctgggtgatagagtatcccaacgtaaaactaacaaagccatccgatggcatcaaatcttgtcggatgaaggacagcgggaaatgcaatgtcgctactaaccgctggcccattatccagtgtgagaataacaatttttactactcagaactgcaaaacgattatgacaagacccaggatattggacatttctgcctcagtcctggctgttccacgatcagatacccaataaatcagaagcacatttctaactgcaattggcaagtgagccactcctcaatcgccaaaatcgacgttcataacattgaggatatcgaacagtataggaaggcgattacccagaaactgcagacaagccttagtttgtttaagtacgccaaaactaagaatctgccgcacataaagcccatctataaatacattaccatcgagggtacagaaactgctgaggggattgagtctgcatatatcgaatccgagatacctgccttagctggcaccagcatcggattcaagattaactcgaaagaaggcaagcatctcctggacgtgatcgggtacgtcaaatcagcctcttacagttccgtgtatagcaagctgtactctacgggaccaacaagcggtattaacaccaaacacgatgagctgtgtactggcccctgccctgaaaatatcaagcatcaaacagggtggttgacctttgcacgtgagcggacttcctcatggggatgtgaggagttcggctgcctcgcgataagtgacggttgtgtttttgggagctgccaggatattgtgaaggacgagctgtctgtatatcgaaaagaaaccgaggaagtcacagatgtggagctatgcctgacgttctccgacaagacctactgtactaacctcaatccaatcacacccatcattaccaacctgtttgaggtgcagttcaaaacagtcgaaacttattcacttccgagaatagttgccatccagaatcacgagattaagatcggccaaattaacgacttgggagtgtacagtaaaggctgcgggaatgtacagaaggtgaacggaaccgtctatggcaatggtgtgcctaagttcgattacctgtgtcacttagctagcaggaaagaagttatcgtgcgcaagtgctttgacaacgattaccaggcctgtaaattcctccagacgccagcatcctatcggctggaggaaaattctggggctataacagtcatcgactacaagaaaattcttggaaccatcaagatgaaggccattctgggcgatgtgaaatataagacttttgcagacaacgttgatatcaccgccgaaggttcgtgcacaggctgtataaattgcttcgagaacattcattgtgaactaactatccacaccacaatcgaggctagctgccccgtgacgtcaccttgtaccgtctttcatgacaggattctcgtaactcccaatgaacacaaatacgcgatgaaggtggtttgcacagagaaaccagggtccaccctggtgatcaaggtctgcaacactaagatagatgccagtttggcactgattgacgctaaacctatcttagagctcgcccccgtggatcaaacagcctatattagagaaaaggacgagcgctgtaaaacctggatgtgccgagtacgggacgaaggacttcaggtgatccttgagccattcaagaacctgtttggctcttacatagggattttctatacgtttatcatcagcattatcgtcttgctcattgttatatacatcattctgccgatctgtttcaaactacgtgatactctgagaaagcatgaagacgcttacaagagggagatgaaaatccgctga

SEQ ID NO: 10952 - RNA, 4332 nt, synthetic construct
  misc_feature 1..4332: note = derived and/or modified CDS sequence (opt3) from INKV(KN3641)__U88059.1__GP
  source 1..4332: mol_type = other RNA
atggaggtgctgaacctcatctggcttctgaccttgtgcagcgcctcccccgtcttccagagatgttttcaagacggcgctattgttaagcagaatccttctaaagaagcagtgacagaggtatgcttaaaggatgacgtgtcaatgataaaaactgaagccaagtacatcaaaaacacgaccgggacattcgcgaataacattgctatgaggaagtggctggtcgccgattggcacgactgtcggccacagaagagtagcggaggtcatatcaatgtgattgaggttggcgatgacctatccctccacactgaatcttatatctgctcggcagattgtgtgataaccgtcgacaaagagacagcccagatccgcctgcaaaccgataacactaatcattttgaggtggctgggacaaccgtaaagtcaggatggttcaaaagcacgacttacattacccttgaccagacatgcgaacacctgaaggttagttgtggcccgaaatccatccagtttcatgcatgcttcaaccagcacatgtcttgtgtgcgatttttgcaccgtactattctccccggtagcatcgccaattccatatgccaaaacattgagatcattatcctggtcaccctgtcactcgtgatcttcatttttctaacaatagtgagtaagacctatgtctgttacctgcttatgcctatcttcattccaatcgcttatatatacgggtggatttataataagagctgcaaaaagtgcagattgtgtggactggtttaccatccctttacggaatgcggcactcactgtgtgtgcggcgccaggtacgagacatctgatcggatgaaactacatcgcgcgtccgggctctgtcctggatataagaacctgagagcagccagggtaatgtgcaaatcaaagggtccagctagcgtgcttagtatcatgaccgccgtcctgatcttgactttcgtgacacccatttctgcaatggttatcggcgagtccagcgaagtgtacaccctcggggacctgcctgatgacatggtcgagatggctgaacgggtgaatatttattaccagataatcattatcaactattcgatcacgtgggtatttttactgctcggacttattatagcctacttcttccgcaaatatcagcaccgatttctgtctttctacgcgatgtactgtaaggagtgcgacatgtatcacgaaagagccggcttgacctactggggtgattttacaaataagtgtaggcagtgcacttgtgggcaattcgaggacgttaccggactaatggtgcataaaaagtcctataactgcatcattaaatacaaggcaaaatggatccgggatatgctgattacatatctcctgatcatgcttataaaggactcactgttgtttgtcggcgctactggcaccgatttcgccgcttgcatcgacgagaagacagtgacctggaaccgtactgggccatttctcaatctgggacgctgtgataaaagtcagaagaaaacgggttacacagacattgccgatcagttaaagggcctgggggcaatcagcgtcctagacattccgatgatcaaaaagatgcccgatgaaatatccggatctctcaagtgcattgacgacctggagacccaccatgaacaacttactgccgagtatgctttcttgaccagatactgtgattactatacacagtacaccgacaacagcggctattcacagactgtgtggaggacatacctgcggagtcacgattttggtgcgtgcgttgtgtatcctaatcagcatttctgtcgatgcgtaaaacacggggacaagtgtaactccgcaaaatgggattttgccaatgaaatgaagacgttctacaccggccaaaaagctaagtttaacaaggacctcaatctggcccttctggtcttgcacaaagcattccgcggaactggcacaagctatatcgccgagtctatggctagaaaggataacaggtcaatgacccatttcgccctcgagattaaaaagaaatttccaacaaatgcactgttaactgcgctgatcgactacataagttacctacagagccccgctgaaatgtccaccttcgagctcgatgaagactgggaggattttaagtataaacctgaaccaacggagtctccccagctgcggtcgcaccgcaccgaccagtacaacttcaagaatgccgatagcaactccaatgtgaaggtttgcaaaaacatccaaaaggtgtcatgtattagtccgagatctagggcaaaatttgagaatatcattgcctgcggggaacatgctaaccctagcgtctatacaatgcccaacgtgtccatctaccagtcaaatagcgagcgttctcactattgtatagccgactcccactgccttgaagagtacgaggtagtggaaactgagttgctgaacgcactcaagaaaagtaagtgctgggctcgggaaatggacgatattgttctgcataagcaggtcgacggattacgaagctgtagaatgaaagataccggtaattgcaacgtgcaggagaatgactggacaatcgtgctgtgtgaaaacggcaattattactactctgaggcccacagggattatgacaaggatcaagacgtcgggcatttctgcctttccccacgctgttcaactatccggtaccctattagtaaaagacacatcaagaactgcgattggcagattagccattcgaccatagacaaaatctccgttcaggagttggcggatattgaacagtataagaaggccatctctcaaaaactccagacgagcctgtcaatttttaagtacgtgaaaacaaagaatctaccccacatcaaaccagcttataagtacataaccgtggagggagtagaaactgtcgagggcatcgaaaacgcattcattgagagtgagatccccgccctggctggtacagccattgggtttaagatcaattccagggaaggcaactatctcatggacgtgataggatacgttaaatctggcagctactccgcaacctatactaagctgtacattaccgggcctacaatcggagtgaatacgaaacacgatgagaagtgtaccggtccatgcccggcgatcattgaccataaagaaggctggcttactttcgccaaggggcgcacatcaacctggggatgtgaggaatttggctgcttggctgtcagcgacggttgtgtgttcgggagttgccaggatataatcaaagacgagctggccgttcaccgaaagacaactgaggaacccaccacggtggagttatgcctcacattttctgataagacctattgtactaacctgaatgcaattacccctatcattacagacaaattcgaagtacaattcaagactgtcgagtcctacacccttccacggatcatagctatcaaaaaccatgagattaaggtgggccagatcaacgatctgggagtgtatagcaaaggctgcgggaatgtccagaagattaacggaacaaattacggcaacggtttgcccaagtttgactatctctgtcacctggccgggcgtaaagaagttatcataagaaagtgcttcgataatgactaccaggcatgtaaatttctacaatcgcctccatcatacaggctggaggaacatcagggaacggtgaccgtaattgattataagaaaatcctcggcactatcaagatggaggccattctgggtgacgtgaagtaccgcaactatcagtctaatatcgaaataaacgctaaaggcacatgcgcggggtgtattaattgcttcgagaacatccactgtgagtttaccattcacactacagtcgaagccagttgccccatcgtgaccgattgggtttccttccatgaccggatacttattacgccggacgagcacaagtacgcattgaaagtggtctgtcaggaaaagcctaaactgagcttaaagtttaagatctgcaatactaacatcgatgcttctatgaccgtggttgacagcaaaccaattctcgagctggcccccgtggatcaaacaacctatatcagagaaagggacgagcgatgcaagacttggatgtgtcgcgtccgggatgagggattccaggtaattcttgaaccttttaaaaatctgttcggctcctacatagggatcttttatacaggaattttatgcatcgtgtgtctcctgatcgttatttacataatcttgcccatttgcttcaagctgagagacaccttaaggcagctcgaggatgcctacaaaaaggaagtgaagatccgttga

SEQ ID NO: 10953 - RNA, 4332 nt, synthetic construct
  misc_feature 1..4332: note = derived and/or modified CDS sequence (opt3) from INKV(SWAR83-161)__U88060.1__GP
  source 1..4332: mol_type = other RNA
atggaggtgctgaacctcatctggcttctgaccttgtgcagcgcctcccccgtcttccagagatgttttcaagacggcgctattgttaagcagaatccttctaaagaagcagtgacagaggtatgcttaaaggatgacgtgtcaatgataaaaactgaagccaagtacatcaaaaacgcgacggggaccttcgctaataacattgccatgaggaagtggctggtcgcagattggcacgactgtcggccacagaagagtagcggaggtcatatcaatgtgattgaggttggcgatgacctatccctccacacagaatcttatatctgctcggccgattgtgtgataactgtcgacaaagagaccgctcagatccgcctgcaaacagataacaccaatcattttgaggtggcagggactacagtaaagtcaggatggttcaaaagcaccacgtacattactcttgaccagacctgcgaacacctgaaggttagttgtggcccgaaatccatccagtttcatgcctgcttcaaccagcacatgtcttgtgtgcgatttttgcaccgtacaattctccccggtagcatcgctaattccatatgccaaaacattgagatcattatcctggtcactctgtcactcgccatcttcatatttttaaccatagtgagtaagacatatgtgtgttacctgcttatgcctatcttcattccaatcgcgtatatatacgggtggatttataataagagctgcaaaaagtgcaaattgtgtggactggtctaccatccctttaccgaatgcggcacgcactgtgtttgcggcgcaagatacgagacttctgataggatgaagctacatcgggcctccgggctctgtcctggatataaaaacctgcgcgctgccagagtgatgtgcaagtcaaaaggtccagcaagcgtacttagtatcatgacagctatcctgattttgaccttcgtgactcccatctctgccatggtcattggcgagtccagcgaagtgtacacactcgacgagctgcctgatgacatggttcagatggcggaaagggtgaatatatattaccagatcattatcatcaactattcgattacctgggcctttttactgttcgggctcgtccttgcatacttctttaagaagtatcagcaccggttcctgtctttttacgctatgtactgtaaagagtgcgacatgtatcacgaacgcgccggattgacgtactggggcgatttcaccaataagtgtcgacaatgcacatgtggtcagtttgaggacgtgactgggctaatggtacataaaaagtcctataactgcataatcaaatacaaggctaagtggattagagatatcctgattacctatctcatcataatgctgatcaaagactcacttctgttcgttggagccacaggcactgattttgcagcctgcattgacgagaagaccgtgacatggaactgtaccggcccattcttgaatctcgggaaatgcgataagagtcagaaaaagatcggatacgctgacattgcggatcaactgaagggtttaggcgcaatcagcgtcctggacataccgatgattaaaaggatgcccgatgaaatctccgggtctctaaagtatattgacggactcgagacttaccacgaacagctgacggccgagtacgcttttcttacacggtattgtgactactatacccagtacactgataacagcggctattcacagaccgtgtggcgtacatacttgcgcagtcatgacttcggtgcctgcgtcgtgtatcctaatcaacacttttgtagatgcgttaaacatggggataagtgtaactccgcaaaatgggacttcgccaatgaaatgaagaccttttacactggccagaaggctaaattcaacaaggatctgaatctcgccctgcttgtgctgcacaaagcattcaggggaacaggcacgagctacatcgcggagtctatggctcggaaggacaaccgatcaatgacccactttgccttggagattaaaaagaaattcccaactaatgcactcctgacagccttaatcgattatattagttacctgcagagcctagctgaaatgtccacctttgagctcgacgaagattgggaggacttcaagtataagcccgaacctacagaggccccacagctgcgctctcatagaactgatcaatacaactttaaaaatgcagactcgaacagcaatgtaaaggtctgcaaaaacatccagaaggtgtcctgtatttcacccaggagtcgggctaaattcgagaatatcatagcctgcggggaacacgcgaacccgtctgtttatatgatgcctaacgtgagcatttaccagtccaattcagagcgcagccattattgtatcgccgattctcactgccttgaagagtacgaggtcgtggaatccgagttgctgaacgctctcaagaagagtaaatgctgggcaaaggaaatggacgacatcgtactgcacaaacagagcgatggattaagatcttgtaggatgaaggacaccggtaattgcaacgtgcaagagaatgattggacgattgttctgtgtgaaaacggcaattactattactccgaggcccatcgtgactatgataaagaccaggatgtcgggcacttttgcctttcaccccggtgtagtaccatccgatacccaattaacaagagacatataaggaattgcgactggcagatcagccactcgacaattgataagatctccgtgcaggagttggctgacattgaacaatataaaaaggccatctctcagaaactccagactagcctgtcaatattcaagtacgtgaaaaccaagaacctacctcatatcaagcccgcatataaatacattacagtcgagggaatcgaaactgttgagggcattgaaaatgcgtttatcgagagtgagataccagccctggctggtaccgccattgggttcaagatcaactcccgcgaaggcaattacctcatggatgtgatcggatatgtgaaatctgcaagctactccgctacgtatacaaagctgtacaccactggccccacaattggggtaaacaccaaacacgacgagaagtgtactggaccttgcccaccgataatcgatcacaaagaaggttggcttacctttgccaaggagcggacatcaacgtggggctgtgaagagttcgggtgcttggcagtcagcgacggatgtgtgtttggcagttgccaagacattatcaaggatgagctggccgtttatagaaaaaccactgaagagttaacaaccgtggaactctgcctgacattctctgacaagacttactgtaccaatcttaacgctattacgcccatcataacagataaattcgaggtccagtttaagaccgtggagtcctatactctgcctaggatcattgcgatcaaaaaccatgaaattaaggttggtcagatcaatgacttgggggtgtacagcaagggctgcggaaacgtacagaaaataaatggcaccaactacgggaatggagtcccaaagttcgattatctctgtcacctggcctcgcgcaaagaggtgattatccgaaagtgctttgacaacgattaccaagcatgtaaattcctacagtcacccccttcttatcggctggaagaacatcagggcacagtgactgtcatcgactacaagaagattctcggtatcataaaaatgaaggctattctgggggatgttaaatataagaattaccagagtaacatcgaaattaatgccgagggaacctgcgccggctgtatcaactgctttgagaatatacactgtgagttcacaattcatacgaccgtggaggcttcctgcccaatcgtaactgactgtgtgagctttcacgatcgtatccttattacacccgacgaacacaaatatgcattgaaggtcgtgtgccaagagaagccgaaactgtctttaaagttcaaaatctgcaacaccaatattgacgccagcatgactatagttgattccaagcctatcctcgaactggcgccagtggaccagacaacctacattagagagaaagatgagaggtgtaagacgtggatgtgccgcgtccgggacgaaggttttcaggtgatccttgagcccttcaagaacctgtttggctcatacatcgggattttctatactggaatactatgtatcatttgcctcctgatcgttatttacatcatattgcctatctgtttcaaactgagagataccttaaggcagcatgaagacgcttataagaaagagatgaagattcgatga

SEQ ID NO: 10954 - RNA, 4332 nt, synthetic construct
  misc_feature 1..4332: note = derived and/or modified CDS sequence (opt3) from INKV(Lovanger)__KU681435.1__GP
  source 1..4332: mol_type = other RNA
atggaggtgctgaacctcatctggcttctgaccttgtgcagcgcctcccccgtcttccagagatgttttcaagacggcgctattgttaagcagaatccttctaaagaagcagtgacagaggtatgcttaaaggatgacgtgtcaatgataaaaactgaagccaagtacatcaaaaacgcgacggggaccttcgctaataacattgccatgaggaagtggctggtcgcagattggcacgactgtcggccacagaagagtagcggaggtcatatcaatgtgattgaggttggcgatgacctatccctccacacagaatcttatatctgctcggccgattgtgtgataactgtcgacaaagagaccgctcagatccgcctgcaaacagataacaccaatcattttgaggtggcagggactacagtaaagtcaggatggttcaaaagcaccacgtacattactcttgaccagacctgcgaacacctgaaggttagttgtggcccgaaatccatccagtttcatgcctgcttcaaccagcacatgtcttgtgtgcgatttttgcaccgtacaattctccccggtagcatcgctaattccatatgccaaaacattgagatcattatcctggtcactctgtcactcgccatcttcatatttttaaccatagtgagtaagacatatgtgtgttacctgcttatgcctatcttcattccaatcgcgtatatatacgggtggatttataataagagctgcaaaaagtgcaaattgtgtggactggtctaccatccctttaccgaatgcggcacgcactgtgtttgcggcgcaagatacgagacttctgataggatgaagctacatcgggcctccgggctctgtcctggatataaatcactgcgcgctgccagagtgatgtgcaagagcaggggtccagcaagtgtactttctatcatgacagctatcctgattttgaccttcgtgactcccatctccgccatggtcattggcgagagctcggaagtgtacacactcgacgagctgcctgatgacatggttcagatggcggaacgggtgaacatatattaccagatcattatcatcaattattctattacctgggcctttttactgttcgggctcgtccttgcatacttctttaaaaagtatcagcaccgcttcctgtccttttacgctatgtactgtaaggagtgcgacatgtatcacgaacgagccggattgacgtactggggcgatttcaccaacaaatgtagacaatgcacatgtggtcagtttgaggacgtgactgggctaatggtacataagaaatcatataattgcataatcaagtacaaagctaagtggattagggatatcctgattacctatctcatcataatgctgatcaaggacagtcttctgttcgttggagccacaggcactgattttgcagcctgcattgacgagaaaaccgtgacatggaactgtaccggcccattcttgaacctcgggcggtgcgataagagccagaaaaagatcggatacgctgacattgcggatcaactgaaaggtttaggcgcaatctccgtcctggacataccgatgattaagcgtatgcccgatgaaatctctgggagcctaaagtatattgacggactcgagacttaccacgaacagctgacggccgagtacgcttttcttacacgctattgtgactactatacccagtacactgataattcaggctatagtcagaccgtgtggagaacatacttgaggtcccatgacttcggtgcctgcgtcgtgtatcctaaccaacacttttgtcggtgcgttaaacatggggataagtgtaatagcgcaaaatgggacttcgccaacgaaatgaagaccttttacactggccagaaagctaagttcaataaggatctgaacctcgccctgcttgtgctgcacaaagcattccgaggaacaggcacgtcttacatcgcggagtcaatggctcgcaaggacaatagaagtatgacccactttgccttggagattaaaaagaaattcccaactaacgcactcctgacagccttaatcgattatattagctacctgcagtccctagctgaaatgtctacctttgagctcgacgaagattgggaggacttcaagtataaacccgaacctacagaggccccacagctgaggtcgcatcggactgatcaatacaattttaagaacgcagacagcaattccaacgtaaaggtctgcaaaaatatccagaaggtgtcatgtattagtccccgctctagagctaaattcgagaacatcatagcctgcggggaacacgcgaatccgagcgtttatatgatgcctaacgtgtccatttaccagtcaaacagcgagaggtctcattattgtatcgccgattcccactgccttgaagagtacgaggtcgtggaaagtgagttgctgaatgctctcaagaaaagcaagtgctgggcaaaggaaatggacgacatcgtactgcacaaacaggccgatggattacgttcttgtcggatgaaggacaccggtaactgcaatgtgcaagagaacgattggacgattgttctgtgtgaaaatggcaactactattactccgaggctcatcgagactatgataaagaccaggatgtcgggcacttttgcctttcacccagatgtagtaccatcaggtacccaattaataagcgccatatacggaactgcgactggcagatcagccactcgacaattgataaaatctccgtgcaggagttggccgacattgaacaatataagaaggcaatctctcagaaactccagactagcctgtcaatattcaagtacgtgaaaaccaagaatctacctcatatcaaacccgcgtataagtacattacagtcgagggagttgaaactgtggagggcatcgaaaacgcctttattgagagtgagatcccagctctggccggtaccgcaatagggttcaagattaattccagagaaggcaactacctcatggatgtgatcggatatgtaaaatctgctagctactccgccacgtatacaaagctgtacaccactggccccacaatcggggtcaataccaaacacgacgagaagtgtactggaccttgcccaccgattatagatcacaaagaaggttggcttacctttgcaaaggagaggacatcaacgtggggctgtgaagagttcgggtgcttggccgtgagcgacggatgtgtttttggcagttgccaagacatcattaaagatgagctggtggtctatcgcaagaccactgaagagttaacaaccgtggaactctgcctgacattctctgacaagacttactgtaccaaccttaatgctatcacgcccattatcacagataaattcgaggttcagtttaagaccgtggagtcctatactctgcctcgaataatcgcgattaaaaaccatgaaatcaaggtaggtcagattaacgacttgggggtctacagcaaaggctgcggaaatgtgcagaagatcaacggcaccaattacgggaacggatggccaaagttcgattatctctgtcacctggcctcgcggaaagaggtgataattcgtaagtgctttgacaatgattacaaagcatgtaagttcctacaatcacccccttcttatagactggaagaacatcagggcacagtcactgttatcgactacaaaaagatcctcggtaccattaagatgaaagctatcctgggggatgtgaagtataaaaactaccagagtaatatagaaattaacgccgagggaacatgcgccggctgtatcaattgctttgagaacattcactgtgagttcacgatccataccactgtagaggcttcctgcccaatagtgacagactgtgtcagctttcacgataggattcttatcacccccgacgaacacaagtatgcattgaaagtggtttgccaggagaagccgaagctgtctttaaaattcaagatctgcaatactaacattgacgccagcatgacaatcgtggattccaaacctattctcgaactggcgccagtcgaccaaaccacgtacatacgcgagaaggatgagcggtgtaaaacttggatgtgcagagtgagggacgaaggttttcaggttatccttgagcccttcaagaatctgtttggctcatacattgggatcttctataccggaatcctatgtattatatgcctcctgatcattatctacattatcttgcctatatgtttcaagctgcgagatacattacgccagcatgaagacgcttataaaaaggagatgaaaatccggtga

SEQ ID NO: 10955 - RNA, 4332 nt, synthetic construct
  misc_feature 1..4332: note = derived and/or modified CDS sequence (opt3) from INKV(Lovanger)__KX554936.1__GP
  source 1..4332: mol_type = other RNA
atggaggtgctgaacctcatctggcttctgaccttgtgcagcgcctcccccgtcttccagagatgttttcaagacggcgctattgttaagcagaatccttctaaagaagcagtgacagaggtatgcttaaaggatgacgtgtcaatgataaaaactgaagccaagtacatcaaaaacgcgacggggaccttcgctaataacattgccatgaggaagtggctggtcgcagattggcacgactgtcggccacagaagagtagcggaggtcatatcaatgtgattgaggttggcgatgacctatccctccacacagaatcttatatctgctcggccgattgtgtgataactgtcgacaaagagaccgctcagatccgcctgcaaacagataacaccaatcattttgaggtggcagggactacagtaaagtcaggatggttcaaaagcaccacgtacattactcttgaccagacctgcgaacacctgaaggttagttgtggcccgaaatccatccagtttcatgcctgcttcaaccagcacatgtcttgtgtgcgatttttgcaccgtacaattctccccggtagcatcgctaattccatatgccaaaacattgagatcattatcctggtcactctgtcactcgccatcttcatttttcttaccatagtgagtaagacatatgtgtgttacctgcttatgcctatcttcattccaatcgcgtatatatacgggtggatttataataagagctgcaaaaagtgcaaattgtgtggactggtctaccatccctttaccgaatgcggcacgcactgtgtttgcggcgcaagatacgagacttctgataggatgaagctacatcgggcctccgggctctgtcctggatataaatcactgcgcgctgccagagtgatgtgcaagagcaggggtccagcaagtgtactttctatcatgacagctatcctgattttgaccttcgtgactcccatctccgccatggtcattggcgagagctcggaagtgtacacactcgacgagctgcctgatgacatggttcagatggcggaacgggtgaacatatattaccagatcattatcatcaattatgggattacctgggcctttttactgttcggactcgtccttgcatacttctttaaaaagtatcagcaccgcttcctgtctttttacgctatgtactgtaaggagtgcgacatgtatcacgaacgagccggcttgacgtactggggtgatttcaccaacaaatgtagacaatgcacatgtgggcagtttgaggacgtgactggactaatggtacataagaaatcctataattgcataatcaagtacaaagctaagtggattagggatatcctgattacctatctcatcataatgctgatcaaggactcacttctgttcgttggcgccacaggcactgattttgcagcctgcattgacgagaaaaccgtgacatggaactgtaccgggccattcttgaacctcggacggtgcgataagagtcagaaaaagatcggttacgctgacattgcggatcaactgaaaggcttaggggcaatcagcgtcctggacataccgatgattaagcgtatccccgatgaaatttccggatctctaaagtatatcgacggcctcgagacttaccacgaacagctgacggccgagtacgcttttcttacacgctattgtgactactatacccagtacactgataatagcggttattcacagaccgtgtggagaacatacttgaggagtcatgacttcggggcctgcgtcgtgtatcctaaccaacacttttgtcggtgcgttaaacatggcgataagtgtaattccgcaaaatgggacttcgccaacgaaatgaagaccttttacactggacagaaagctaagttcaataaggatctgaacctcgccctgcttgtgctgcacaaagcattccgaggcacagggacgagctacatagcggagtctatggctcgcaaggacaatagatcaatgacccactttgccttggagatcaaaaagaaattcccaactaacgcactcctgacagccttaattgattatatcagttacctgcagagcctagctgaaatgtccacctttgagctcgacgaagattgggaggacttcaagtataaacccgaacctacagaggccccacagctgaggtctcatcggactgatcaatacaatcttaagaacgcagactcgaatagcaacgtaaaggtctgcaaaaatattcagaaggtgtcctgtatctcaccccgcagtagagctaaatttgagaacataattgcctgcggagaacacgcgaatccgtctgtttatatgatgcctaacgtgagcatctaccagtccaactcagagaggagccattattgtatcgccgattctcactgcttggaagagtacgaggtcgtggaatccgagctgctcaatgctctgaagaaaagtaagtgctgggcaaaggaaatggacgacattgtattacacaaacaggccgatggtctgcgtagctgtcggatgaaggacaccggcaactgcaatgtgcaagagaacgattggacgatcgttctttgtgaaaatgggaactactattactctgaggctcatcgagactatgataaagaccaggatgtcggacacttctgcttgtcccccagatgttcaaccattaggtacccaataaataagcgccatatccggaactgcgactggcagattagtcacagcacaatcgataaaatttcggtgcaggagctcgccgacatcgaacaatataagaaggcaatatcccagaaactgcagacttctctaagcatctttaagtacgtgaaaaccaagaatctgcctcatattaaacccgcgtataagtacatcacagtcgagggcgttgaaactgtggagggtattgaaaacgccttcatcgagtcagagataccagctctcgccgggaccgcaattggctttaagatcaatagtagagaaggaaactacctgatggatgtgatcggctatgtaaaatccgcttcttacagcgccacgtatacaaagttatacaccactgggcccacaattggagtcaataccaaacacgacgagaagtgtactggtccttgcccaccgataatcgatcacaaagaaggctggttgaccttcgcaaaggagaggacatccacgtgggggtgtgaagagtttggatgcctggccgtgtcagacggctgtgttttcggtagctgccaagacattatcaaagatgagttagctgtgtatcgcaagaccactgaagaactcacaaccgtcgaactgtgccttacatttagtgacaagacttactgtaccaacctgaatgcgattacgcccatcataacagataaattcgaggtgcagttcaagaccgttgagtcttatactttgcctcgaatcattgccatcaaaaaccatgaaattaaggtggggcagatcaacgacctcggcgtatactccaaaggatgcggcaatgtccagaagataaacgggaccaattacggaaacggcctgccaaagtttgattatctatgtcacctggcaagccggaaagaggtgattatccgtaagtgcttcgacaatgattaccaggcttgtaaatttctccaatcgcccccttcatatagactggaggagcatcagggtacagtgactgtcatcgactacaagaaaattcttgggaccatcaagatgaaggccatattgggagatgttaaatataagaactaccagtctaatattgaaatcaacgccgagggcacatgcgctggttgtattaattgcttcgagaacatccactgtgaatttacgatacataccactgtggaggcaagttgcccaattgtaacagactgtgtgtccttccacgataggatcctgatcacccccgacgaacacaaatatgccttaaaggtcgtgtgccaagagaaaccgaagctcagcctgaagtttaaaatttgcaatactaacatcgacgcgtctatgacaattgttgatagcaagcctatacttgaactggctccagtggaccagaccacgtacatccgcgagaaagatgagcggtgtaagacttggatgtgcagagtcagggacgaaggcttccaggtgattctagagccctttaaaaatctcttcgggtcctacatcggaatcttttataccggcattctgtgtataatctgcttgctgattgttatctacattatcttacctatatgtttcaagctccgagatacactgcgccagcatgaagacgcctataagaaagagatgaagatccggtga

SEQ ID NO: 10956 - RNA, 4335 nt, synthetic construct
  misc_feature 1..4335: note = derived and/or modified CDS sequence (opt3) from JSV__AF123487.1__GP
  source 1..4335: mol_type = other RNA
atggaggtgctgaacctcatctggcttctggccttgtgcagcgcttcccccgtcttccagagatgttttcaagacggcgcaattgttaagcagaatccttctaaagaagccgtgaccgaggtatgcttaaaggatgacgtgtcaatgataaaaacagaagcgaagtacgtcaaaaacactacggggaccttcgctaataacatcgccatgaggaagtggctggtggcagattggcacgactgtcggccacagaagagtagcggaggtcatattaatgttatcgaggtgggcgatgacctatccctccacacagaatcttatatttgctcggccgattgtgtcatcactgtggacaaagagaccgctcagatacgcctgcaaacagataacaccaatcattttgaggtagcagggactacagttaagtcaggatggttcaaaagcaccacgtacatcactcttgaccagacctgcgaacacctgaaggtgagttgtggcccgaaatccattcagtttcatgcctgcttcaaccagcacatgtcttgtgtccgatttttgcaccgtacaatcctccccggtagcattgctaattccatctgccaaaacatagagattatcattctggtgactctgtcactcgtgatcttcatctttttaagtattgtcagcaagacctatgtttgttacctgcttatgcctatattcatcccaattgcctttatctatgggtggatatacaataagtcttgcaaaaagtgcaaattgtgtggactggtgtatcatcccttcacagaatgcggcacccactgtgtatgcggcgcgagatacgagacgtccgataggatgaagctacatcgggcatcagggctctgtcctggatacaaaagcctgcgcgccgctagagtgatgtgcaagagtaaaggtccagcctctattctttccatcatgactgcaatcctgattttgacatttgtcacccccatcagcgctatggtgattggcgagtcgtctgaagtttatactctcgacgatctgcctgacgacatggtgcagatggccgagagggtcaacatatactatcagatcattatcatcaattacggggtgacatgggcgttcttactgctcggacttattctggcctatttctttaagaagtaccagcacaaattcttggatttttatgcaatgtactgtgaagagtgcgacatgtaccacgaaaagtccggcctaacccattggggtgatttcacgaacaaatgtcggcaatgcacctgtgggcagtttgaggacgtagctggactgatgatacaccgcaagtcatataattgcctcgttaaatacaaggcccgatggatcagagatattctgatcatgtatcttgctatgattctgatcaaggacagtctcttgttcgtgggcgccagcggcacagattttgcagcctgcatagacgagaaagtcgtgacttggaactgtaccgggccattcctgaacttaggaaggtgcgataagtcccagaaaaagacaaattacgaaggtatcgctaaccaactgaaaggcctaggggtcatttctgtgctcgacatcccgatgattaagaatatgcccgatgagatcagcggatcactgaagtatatagacagtcttgaaacttaccatgagcagttgaccgcggaatatgcatttctgacacggtactgtgactactatacccagtacactgataactccggctatagccgtacggtttggcgcacatacctcagatctcacgacttcggtgcctgcgtggtatatcctaatcatcacctgtgtaggtgcgtcaaatacggggataagtgtaactcagctaaatgggactttgccaatgagatgaagaccttctatactggccagaaagtgaagtttaacaaggatcttaatctggcattgctcgttctgcacaaagccttccggggaaccggcacagcttacgtggccgaggcaatggcgcgaaaggacaacgggagtatggctcatttcgccttagaaattcgcaaaaagtttccaaccaatgcactgctagccgctctcatcgattacattgtctatctgcaaagccttgccgagatcgcaactttcgaattggacgaggattgggaagactttaaatacaagcccgagcctacagagtccacgccacaggctagatctcacaggaacgatcagtataatttcaaaaacgccgaatcgaatagcaacaccaaggtgtgcaagaacgtacagaaagtgctgtgtatatcaccccggtccaaggcgaaatttgagaatatcattgcctgcggagaacatgctaacccgagtgtttacatgatgcctaatgtctctatctatcaaagcaactccgagcgctcacactactgtattgcagacagccactgcctcgagaagtatgaagtggtggagactgaactgttaaatgccctgaaaaagtctaagtgctgggctaaagagatggatgacatcgtccttcataagcagtccgacggtttgagaagttgtaggataaaagatacaggcaactgcaatgttcaggaaaacgactggaccattgtgctctgtgagaatgggaactactactatagcgaggtgcacaaggattacgacaaagatcaggacgtaggacatttctgcctgtctccccgttgtacaactatccggtatccaatctcccgaagacacattaggaagtgcgaatggcaaatctcacatagtaccattgataagataagcgtccaggagctagccgacatcgaacagtacaaaaaggcaatttcgcagaaactgcaaacgtccctctctatctttaagtatgtgcgcaccaaaaatctgcctcacattaagcccgcgtacaagtatatcacagttgagggcgtggaaactatagagggtatcgagaacgccttcattgaaagcgagatcccagctcttgccgggaccgcaattggctttaaaatcaattcacgggaaggaaactacttgatggatgtcataggctacgtgaagagtgcttcctattctgccgtttacacaaaactgtatactaccgggcccacgattggaatcaatacaaagcacgacgagaaatgtaccggtccttgcccagcagtgatcgatcataaggacggctggttaactttcagcaaagaaagaacatccacctgggggtgtgaggagtttggatgcctcgccgtatcagatggctgtgtcttcggtagctgccaggacattataaaggacgaactggctgtgtacaggaagactaccgaggaacttacaacggtggagctgtgcttgacctttagtgataaaacttattgtacaaacctcaacgcgatcaccccgattatcacagacaagttcgaggtccagttcaaaactgttgaatcttacaccctgccccgcgtgattgccatcaagaatcacgagataaaagtagggcaaatcaacgatctaggcgtgtattccaagggatgcggcaatgtccagaaggtgaacgggacgaattacggaaacggcagccctcgatttgactacctgtgtcatctcgcatcgcggaaagaagttattctgcgtaagtgcttcgataatgactatcaggcttgtaaatttcttcagtcaccatctagttacagattggaggaacaccaaggtacagtgaccgtcatcgattataagaaaattctggggactatcaagatgaaggccatattaggagacgtgatttacatcaactatcagaataacatcgagattaatgccgagggtacctgcgctggctgtatcgattgcttcgaaaacatacattgtgagtttacaattcacactaccgttgaagcatcctgccccatcacaacggagtgtgtgagcttccacgacaggattctcatcacccctgatgaacataaatacgccctgaagatagtctgccacgacaaaccaaaggtatctcttaaatttaagatttgcaatactaacgtggacgcggctatgacaatcgttgatagcaagcccatcctggagctagccccggtggaccagaccacttatattcgcgagaaagatgaacggtgtaagacatggatgtgcagagtcagggacgagggcttccaggtgatcctcgaaccttttaaaaatctgttcgggtcctacattggaatattttacaccggcatcttgtcaattatctgtctgttaatcgtagtgtatattatactcccaatctgcttcaagctgcgagatacgcttcgccaacatgaggacgcataccggaaagaaatgaagattagatga

SEQ ID NO: 10957 - RNA, 4335 nt, synthetic construct
  misc_feature 1..4335: note = derived and/or modified CDS sequence (opt3) from JSV(BFS 4474)__KX817319.1__GP
  source 1..4335: mol_type = other RNA
atggaggtgctgaacctcatctggcttctggccttgtgcagcgcttcccccgtcttccagagatgttttcaagacggcgcaattgttaagcagaatccttctaaagaagccgtgaccgaggtatgcttaaaggatgacgtgtcaatgataaaaacagaagcgaagtacgtcaaaaacactacggggaccttcgctaataacatcgccatgaggaagtggctggtggcagattggcacgactgtcggccacagaagagtagcggaggtcatattaatgttatcgaggtgggcgatgacctatccctccacacagaatcttatatttgctcggccgattgtgtcatcactgtggacaaagagaccgctcagatacgcctgcaaacagataacaccaatcattttgaggtagcagggactacagttaagtcaggatggttcaaaagcaccacgtacatcactcttgaccagacctgcgaacacctgaaggtgagttgtggcccgaaatccattcagtttcatgcctgcttcaaccagcacatgtcttgtgtccgatttttgcaccgtacaatcctccccggtagcattgctaattccatctgccaaaacatagagattatcattctggtgactctgtcactcgtgatcttcatctttttaagtattgtcagcaagacctatgtttgttacctgcttatgcctatattcatcccaattgcctttatctatgggtggatatacaataagtcttgcaaaaagtgcaaattgtgtggactggtgtatcatcccttcacagaatgcggcacccactgtgtatgcggcgcgagatacgagacgtccgataggatgaagctacatcgggcatcagggctctgtcctggatacaaaagcctgcgcgccgctagagtgatgtgcaagagtaaaggtccagcctctattctttccatcatgactgcaatcctgattttgacatttgtcacccccatcagcgctatggtgattggcgagtcgtctgaagtttatactctcgacgatctgcctgacgacatggtgcagatggccgagagggtcaacatatactatcagatcattatcatcaattacggggtgacatgggcgttcttactgctcggacttattctggcctatttctttaagaagtaccagcacaaattcttggatttttatgcaatgtactgtgaagagtgcgacatgtaccacgaaaagtccggcctaacccattggggtgatttcacgaacaaatgtcggcaatgcacctgtgggcagtttgaggacgtagctggactgatgatacaccgcaagtcatataattgcctcgttaaatacaaggcccgatggatcagagatattctgatcatgtatcttgctatgattctgatcaaggacagtctcttgttcgtgggcgccagcggcacagattttgcagcctgcatagacgagaaagtcgtgacttggaactgtaccgggccattcctgaacttaggaaggtgcgataagtcccagaaaaagacaaattacgaaggtatcgctaaccaactgaaaggcctaggggtcatttctgtgctcgacatcccgatgattaagaatatgcccgatgagatcagcggatcactgaagtatatagacagtcttgaaacttaccatgagcagttgaccgcggaatatgcatttctgacacggtactgtgactactatacccagtacactgataactccggctatagcaaaacggtttggcgtacatacctccgctctcacgacttcggtgcctgcgtggtatatcctaatcagcatttttgtagatgcgtcaagtacggggataaatgtaactcagctaagtgggacttcgccaatgagatgaaaaccttttatactggccaaaaggtgaagttcaacaaagatctgaatcttgcactgttggttctccacaaggccttcaggggaaccggcacagcttacgtggccgaggcaatggcgcggaaagacaacgggagtatggctcactttgccctggaaattcgaaagaaattcccaaccaatgcattactggccgctctaatcgattacattgtctatctccagagcctggccgagatcgcaacttttgaacttgacgaggattgggaagacttcaagtacaaacccgagcctacagagtccacgccacaggctcgctctcatagaaacgatcagtataattttaagaacgccgaatcgaatagcaacaccaaggtgtgcaaaaacgtacaaaaggtgttgtgtatatcccccaggtcaaaagcgaagttcgagaatatcattgcctgcggagaacacgctaacccgagtgtttacatgatgcctaatgtctctatctatcagagcaactccgagcggtcacattactgtattgcagacagccactgcctggagaaatatgaagtggtggagactgaactcctgaatgccttaaagaagtctaaatgctgggctaaggagatggatgacatcgtcctgcacaaacagtccgacggtcttcgcagttgtagaataaaggatacaggcaactgcaatgttcaggaaaacgactggaccattgtgttgtgtgagaatgggaactactactatagcgaggtgcataaagattacgacaaggatcaagacgtaggacacttttgcctctctcccaggtgtacaactatccgttatccaatctcccggcgacatattagaaagtgcgaatggcagatctcacacagtaccattgataaaataagcgtccaggagctggccgacatcgaacagtacaagaaagcaatttcgcaaaagctacagacgtccctgtctatcttcaaatatgtgaggaccaagaatctccctcatattaagcccgcgtacaaatatatcacagttgagggcgtggaaactatagagggtatcgagaacgcctttattgaaagcgagatcccagctctggccgggaccgcaattggcttcaagatcaattcacgcgaaggaaactaccttatggatgtcataggctacgtgaaaagtgcttcctattctgccgtttacacaaagttgtatactaccgggcccacgattggaatcaatacaaaacacgacgagaagtgtaccggtccttgcccagcagtgatcgatcacaaagacggctggctgacttttagcaaggaacggacatccacctgggggtgtgaggagttcggatgcttagccgtatcagatggctgtgtctttggtagctgccaggacattataaaggacgaactcgctgtgtacagaaaaactaccgaggaactgacaacggtggagctttgcctgaccttcagtgataagacttattgtacaaacttgaacgcgatcaccccgattatcacagacaaattcgaggtccaatttaagactgttgaatcttacaccctccccagggtgattgccatcaaaaatcatgagataaaggtagggcagatcaacgatctgggcgtgtattccaagggatgcggcaatgtccagaaagtgaacgggacgaattacggaaacggcagccctcgcttcgactacctatgtcacctggcatcgcgaaaggaagttattctccggaaatgctttgataatgactatcaggcttgtaagttcctgcaatcaccatctagttaccgtcttgaggaacatcagggtacagtgaccgtcatcgattataaaaagattttggggactatcaagatgaaagccatactgggagacgtgaagtacaaaaactatcagaataacattgagatcaatgccgagggtacctgcgctggctgtatcgattgctttgaaaacattcactgtgagttcacaatccatactaccgttgaagcatcctgccccataacaacggagtgtgtgagctttcacgacagaattttaatcacccctgatgaacacaagtacgccctcaaaattgtctgccatgacaagccaaaggtatctctgaaattcaagatctgcaatactaacgtggacgcggctatgacaatagttgatagcaaacccattcttgagctggccccggtggaccagaccacttatatcagggagaaggatgaacgctgtaaaacatggatgtgccgggtcagagacgagggctttcaagtgatcctagaacctttcaagaatctctttgggtcctacattggaatcttctacaccggcattctgtcaataatctgtttgctgattgtagtgtatatcatcttaccaatttgcttcaagctcagggatacgctgcgacagcacgaggacgcataccgcaaagaaatgaagatacggtga

SEQ ID NO: 10958 - RNA, 4323 nt, synthetic construct
  misc_feature 1..4323: note = derived and/or modified CDS sequence (opt3) from LUMV__AF123484.1__GP
  source 1..4323: mol_type = other RNA
atgatcctggtgttattctttgtcgcccttagcgctgcaggccccgtttaccagagatgcttccaagacggggccattgtgaagcagtccccttctaaacaggcggtaaccgaggtgtgtctgaaggatgacgtctcaatgataaaaacagaagctaggtattttaagaacactacgggaatctacgccaataacgtggcaattcggaaatggttggttgccgattggcacgactgccgcccaaagaaggtgagtggtggccatatcaatgtcattgaggtgggggatgacttaaccctgcacacagaggcttatgtatgtaacgcagattgcatcataggagttgacaaagaaactgcccaggtgcgactacaaaccgatacaaccaatcatttcgaaatcgctggcactacagtcaagagcggttggtttaaatccaccacgtacattactctcgggcagacctgtgagcacctgaaggtgtcttgcggaccgaaatcgatccagttccatgcctgttttaaccagcacatgtcatgcgtgcgtttccttcacagaacaattctgcccggcagcatcgcgaatagtgtctgtcaaaacatagagattatcattttgactgttctcaccctgctgatctttacactcttatccatcctgtctaagacctatatttgctacatacttatgcctatcttcattccattggcatatatctacggcctgatatacaataagagctgtaaaaagtgcaaactatgcgggctcgtgtatcatccctttacggaatgtggaactcactgcgtatgtggtgccaggtacgacacatccgatcggatgaagctgcatcgcgcttcaggcctttgccctgggtataaaagtctgagagccgcaagggtgatgtgtaagagcaaaggaccagcttctgtcttgtccattatcaccgccgtgctcatcctgactttcattacacccatcaacgcgatgattgccggcgagacccaggaaacgtttaagttagaggacctgcctgatgacatgctctcaatggcaatgaagataaatatgtactatatcatgtgcatgcttaactacgttgctacctggagcttcattttctgtgccctgatcatcgctttgatttttaaaaagtatcagcacaaattcctaagttactacgccatgtattgccaggagtgtgacatgtaccacgatcggtctggtctgaagtataatgggggatttacaaacaaatgccgccaatgtacttgcggccagtacgaagacgcaaccggcctcatggcccatcgaaagacatataattgcctgatacagtacaagtccaaatggcttgtgaacttcctgatcacttatattatcttgatgctcattaaggatagcgtcctgatcgtgcacgctgaggggaccgactttgaaaaatgttcgtctgatataaacatcgtatggaattgcacaggaccattcttatccctgggtaactgtgagaagaaacaaaagaaggaatcatacaatgacattgcggcacagctaaaaggcctcgatgccatcagtgttctggacattccgatgatcagcaagatacccgaggatattgctggggcccttagatttatcgaggaacagaactcctaccatgtgcagttgaccgtcgagtatgcaatgctgactaggtactgcgactattacacgcaattctctgataatagcggatattcacagacaacctggcggacttacctccgtagtcacgactttgaagcctgtattctgtatcctaaccagcatttctgccgctgtgtgaaacacggcgacaagtgctccagaagcaattgggattttgctaacgagatgaaaaattactactctggtaagcagtcaaagtataacaaagaccttaatctggccttgatgagtttccaccatgcatttagggggaccagctccttctacacagcgaagctcctgcgggaaaagaaaaccgaggagctcaaaaactatatcgataagatacgaactgaatacccaggcaatgctctgctaaaagccgtcatcgactatattaagtacatgatgggactcacagaggtgtctaacttcaagcacgatgaaatgtgggacgattttatcttcgagaatccctcgacgcgcagctccctgtcaagaaacagtgaatctagctatgactttaaaaccaacattaattccgatcctactaacacatgtaagaatatcaaagcagttacctgcctttcaccaaagagcggcgtgtctttcgactccgtaatagcctgtggggagagtaaccaacccagcatttaccagaaaccgaggaagcaggtctaccagtctaattccgagcaaacacatttttgcttgctggatactcactgcctcgaaggatatgagaccgtgggtgaagaggttctgtcagctatcaagaaaagtaagtgttgggagacggacttcaccgaatacatccagtttaaacagagcgatggcgtgcggtcgtgccgcatgaaggactccggggagtgtacagtcactaccaacaaatggcctattatcttatgcgaaaataacagatattactattctgagctgcacaaggactacgataaggaccaggatattggacatttctgtcttagccccaggtgcaatacaatacgttatccaatcaaccaaaatcacatttcaaactgtacttggcaagtgcggcataataacatcgacaaaattgaagtacacgagttggaggatctcgaacagtaccgaaaggccatcacccagaaactgcagacgagtctaacactgtttaagtactccagaaccaaaaatctccctcatataaagcccatctataagtacattactatcgagggcacagaaaccgcagagggtattgaatctgcttatatcgagagcgagataccagccctggcggggacttccattggcttcaaaatcacctcaaagagcggaaaacaccttttggacgtgatcagttacgttaagtctgcctcctatagcgctgtctacacaaaactgtatacgaccggccccactattggggtgaacacaaagcacgatgaattatgcaccggatcgtgtcctgtgaacgtcccacataatacaggttggctcacttttgcaagggagcgcacctcatcttggggctgcgaagagttcgggtgtctggccataagtgacggatgcgtttttggctcctgccaggatatcattaaagacgaacttacggtgtaccgggaggagacagaagagaccactaacgtggaactgtgtttgaccttcgctgataagacatactgcactaatctcaacgccatcaccccgattatcacagaccagttcgaggtacaatttaagacggtcgaggcatatagcctgcccagaataatcgcggtgaggaatcacgaaattatggttggtcagatcaacgatattggggtgtactctaaaggctgtggaaatgtccagaagatcaacaataccaactatggcaatggggtgcctaaattcgactacctatgccatctggccagccgcaaggaggttataattcgaaaatgttttgacaacgattatcaggcttgcaagttcctccaaactccagcctcctaccggctggaagaggaaggaggctcagtgacagtaatcgactataagaaaatccttggtaccattaagatgaaagcaatcttgggggatgtcaagtacaaaacttttgctgacaatgtggatataacagtggagggagcctgtaccggctgcattaactgtttcgacaatatccactgcgagctgacgattcatagtactgtcgaagcaagctgtcccatcacctcttcctgcacagtttttcacgatcgtatattaattacccctaacgagcacaagtacgccatcaaggtgatctgcaacggtaaaccaggcatttcactccccttcaagatctgtaatactaaagtagacgctgcgatgacactgaccgatgccaagcagattcttgaactggcaccggtggaccagacaacttatataaaagagaaggatgaaagatgcaagacctggatgtgtagggtccgcgacgaggggctacaggtgatctttgagcctttcaaaaacctctttggaagttacattggcatcttctatacgttcgttatctttctggtggtcattttcatagtgatctacattgttttgccaatctgctttaagctgcgggacacattaagacaacatgaagatgcttataaaagggagatgaagattcgatga

SEQ ID NO: 10959 - RNA, 4323 nt, synthetic construct
  misc_feature 1..4323: note = derived and/or modified CDS sequence (opt3) from LUMV(SAAr 1881)__KX817325.1__GP
  source 1..4323: mol_type = other RNA
atgatcctggtgttattctttgtcgcccttagcgctgcaggccccgtttaccagagatgcttccaagacggggccattgtgaagcagtccccttctaaacaggcggtaaccgaggtgtgtctgaaggatgacgtctcaatgataaaaacagaagctaggtattttaagaacactacgggaatctacgccaataacgtggcaattcggaaatggttggttgccgattggcacgactgccgcccaaagaaggtgagtggtggccatatcaatgtcattgaggtgggggatgacttaaccctgcacacagaggcttatgtatgtaacgcagattgcatcataggagttgacaaagaaactgcccaggtgcgactacaaaccgatacaaccaatcatttcgaaatcgctggcactacagtcaagagcggttggtttaaatccaccacgtacattactctcgaccagacctgtgagcacctgaaggtgtcttgcgggccgaaatcgatccagttccatgcctgttttaaccagcacatgtcatgcgtgcgtttccttcacagaacaattctgcccggaagcatcgcgaatagtgtctgtcaaaacatagagattatcattttgactgttctcaccctgctgatctttacactcttatccatcctgtctaagacctatatttgctacatacttatgcctatcttcattccattggcatatatctacggcctgatatacaataagagctgtaaaaagtgcaaactatgcggcctcgtgtatcatccctttacggaatgtgggactcactgcgtatgtggagccaggtacgatacatccgaccggatgaagctgcatcgcgcttcaggtctttgccctggctataaaagtctgagagccgcaagggtgatgtgtaagagcaaagggccagcttctgtcttgtccattatcaccgccgtgctcatcctgactttcattacacccatcaacgcgatgattgccggagagacccaggaaacgtttaagttagaggatctgcctgacgacatgctctcaatggcaatgaagataaatatgtactatatcatgtgcatgcttaactacgttgctacctggagcttcattttctgtgccctgatcatcgctttgatttttaaaaagtatcagcacaaattcctaagttactacgccatgtattgccaggagtgtgatatgtaccacgaccggtctggcctgaagtataatggtgggtttacaaacaaatgccgccaatgtacttgcggacagtacgaagatgcaaccggcctcatggcccatcgaaagacatataattgcctgatacagtacaagtccaaatggcttgtgaacttcctgatcacttatattatcttgatgctcattaaggacagcgtcctgatcgtgcacgctgagggcaccgattttgaaaaatgttcgtctgacataaacatcgtatggaattgcacagggccattcttatccctgggaaactgtgagaagaaacaaaagaaggaatcatacaatgatattgcggcacagctaaaaggtctcgacgccatcagtgttctggatattccgatgatcagcaagatacccgaggacattgctggcgcccttagatttatcgaggaacagaactcctaccatgtgcagttgaccgtcgagtatgcaatgctgactaggtactgcgattattacacgcaattctctgacaatagcgggtattcacagacaacctggcggacttacctccgtagtcacgactttgaagcctgtattctgtatcctaaccagcatttctgccgctgtgtgaaacacggagataagtgctccagaagcaattgggactttgctaacgagatgaaaaattactactctggcaagcagtcaaagtataacaaagatcttaatctggccttgatgagtttccaccatgcatttaggggtaccagctccttctacacagcgaagctcctgcgggaaaagaaaaccgaggagctcaaaaactatatcgacaagatacgaactaaatacccagggaatgctctgctaaaggccgtcatcgattatattaagtacatgatgggcctcacagaagtgtctaacttcaaacacgacgagatgtgggatgactttatcttcgaaaatccctcgacgcgcagctccctgtcaagaaacagtgagtctagctatgattttaagaccaacattaattccgaccctactaacacatgtaaaaatatcaaggcagttacctgcctttcaccaaaaagcggagtgtctttcgattccgtaatagcctgtggcgaaagtaaccaacccagcatttaccagaagccgaggaagcaggtctaccagtctaattccgagcaaacacatttttgcttgctggacactcactgcctcgaggggtatgaaaccgtgggagaggaagttctgtcagctatcaaaaagagtaaatgttgggagacggatttcaccgagtacatccagtttaagcagagcgacggtgtgcggtcgtgccgcatgaaagactccggcgaatgtacagtcactaccaacaagtggcctattatcttatgcgagaataacagatattactattctgaactgcacaaggattacgacaaagatcaggacattgggcatttctgtcttagccccaggtgcaatacaatacgttatccaatcaaccaaaatcacatttcaaactgtacttggcaagtgcggcataataacatcgataagattgaggtacacgaattggaggacctcgagcagtaccgaaaagccatcacccagaagctgcagacgagtctaacactgtttaaatactccagaaccaagaatctccctcatataaagcccatctataaatacattactatcgaaggaacagagaccgcagaaggcattgagtctgcttatatcgaaagcgagataccagccctggcgggtacttccattgggttcaagatcacctcaaaaagcggcaagcaccttttggatgtgatcagttacgttaaatctgcctcctatagcgctgtctacacaaagctgtatacgaccggacccactattggcgtgaacacaaaacacgacgagttatgcaccgggtcgtgtcctgtgaacgtcccacataatacaggatggctcacttttgcaagggaacgcacctcatcttggggttgcgaggagttcggctgtctggccataagtgatgggtgcgtttttggatcctgccaggacatcattaaggatgaacttacggtgtaccggaaggaaacagaggagaccactaacgtggaactgtgtttgaccttcgctgacaaaacatactgcactaatctcaacgccatcaccccgattatcacagatcagttcgaggtacaatttaagacggtcgaagcatatagcctgcccagaataatcgcggtgaggaatcacgagattatggttggccagatcaacgacattggtgtgtactctaaagggtgtggcaatgtccagaagatcaacaataccaactatggaaatggcgtgcctaaattcgactacctatgccatctggccagccgcaaggaggttataattcgaaagtgttttgataacgactatcaggcttgcaaattcctccaaactccagcctcctaccggctggaagaggaagggggatcagtgacagtaatcgattataagaaaatccttggcaccattaagatgaaagcaatcttgggtgacgtcaagtacaagacttttgctgataatgtggacataacagtggagggggcctgtaccggatgcattaactgtttcgataatatccactgcgaactgacgattcatagtactgtcgaggcaagctgtcccatcacctcttcctgcacagtttttcacgaccgtatattaattacccctaacgagcacaaatacgccatcaaggtgatctgcaacggcaaaccaggtatttcactccccttcaagatctgtaatactaaagtagatgctgcgatgacactgaccgacgccaagcagattcttgaactggcaccggtggatcagacaacttatataaaggagaaagacgaaagatgcaagacctggatgtgtagggtccgcgacgagggcctacaggtgatctttgaacctttcaaaaacctctttgggagttacattggaatcttctatacgttcgttatctttctggtggtcattttcatagtgatctacattgttttgccaatctgctttaagctgcgggatacattaagacaacatgaggacgcttataaaagggagatgaagattcgatga

SEQ ID NO: 10960 - RNA, 4329 nt, synthetic construct
  misc_feature 1..4329: note = derived and/or modified CDS sequence (opt3) from MELV__U88057.1__GP
  source 1..4329: mol_type = other RNA
atgatcgccctgattttcctcatagctatcgcagccgcgagccccgtgtaccagagatgctttcaagacggcgggattgtcaagcagaacccttccaaagatgctgttaccgaggtgtgtcttaaggacgatgtatctatgatcaaaacagaagccaagtatatgaaaaatgacactggaacgttctcaaacaatgtggcaatgaggaagtggctggtcgccgattggcacgactgccggccacagaagagtagcggtggccatattaacgtgatcgaggttggggatgacttgtccttacacaccgaggcttacatatgttctgcagattgcatgatctcggtggacaaagagacagcccagattcgcctgcaaactgattcaaccacacattttgaaatcgctggaaccactgtcaagagcggctggttcaaaagtacaacctatattacgctagaccagacttgtgagcacctcaaggtgtcctgcggtccgaaatctatccagtttcatgcctgtttcaatcagcacatgagctgcgtacgatttctgcaccgtaccatacttcccgggtccattgcgaactcaatctgtcaaaatattgagatcatcattctggttacattgactctcctgatattcatctttctgagtattctcagcaagacctacatctgctatatattaatgcctatgttcattccagtggcatacatctatggatggatctacaacaagtcttgtaaaaagtgcaaactgtgcggccttgtctaccatccctttacagaatgtggcacccactgcgtgtgtggggccagatatgagacgtccgataggatgaagttgcatcggtcaagcggactgtgccctggttacaaaagtctacgcgctgccagagtgatgtgtaagtctaaaggcccagcatccattctcagcgtcctgactgctgttcttatcctgacattcgtgacccccatgaatgccttgactctcgggtcgtctgaagagaactataagctggagaatttacctgacgacatgctggatatggcggaaaggattgacatatactatctctccatcattcttaactactcaatcacatggggactggtaatcttgctaggcctgacctttattctcttccggcgcttccagcaccgatttctgaattgctatgccatgtactgtagtgagtgcgatatgtaccacgacaagaacggtcttgtgagaaatggggatttcacgaacaaatgtaggcagtgcacctgtggacagtatgaagacgcagctggcctgataatccatcaaaagagctacaactgcttgattaaatataaggccaaatggatccggaatattctcctgacatacatcatattaatcctgattaaggattccgtcctactcacttctgctgagggcccagactttagcgtgtgcatcgaacagaaggccatttcatggaactgtaccgggccgttcctgaatcttggacgttgcgagaaaacacagaagaaagcaagttatgccactatcgctacccaattgcgctccatagatgcgattagcgttctggacatccccatgattgcaaagatccctgaggatatatctggtgccctcaaatacatcgaatcactgaagacatatcacgagcagcttaccgctgaatacgccatgctgactagatactgtgactattacacgcagtttagtgacaacagcggctattcccagacatcttggaggaagttcttgcggtcgcatgattttgagagctgcattatctacccaaatcaacacttctgtcgatgcgtgaaacaggacgaaaagtgttcctcagcaaaatgggattttgccagtgagatgaaggggttctatctcaacaaacaggctaagtttaataaggacctgaacttagccctgtctaccttccataaagcatttcgcggaactcccattagctacgtcaccgagctaatctccaagaataaaaactcaagcctcctgatgtatgtgtctgaaataaagagaaaattccctggcaatgcgcttttggtagctctgctcgatttcattatgtacctgcagtccttaagtgagatcagcggttttgaactgggggacgagtgggaagatttcaagtacgacccagagcccacagagccggcccttatgcctaggtctcaccggtccgatcaatataactttaaaaatgcagcctcagttagtaagaccaagacttgcgaaaacatcaaacgcgtgttgtgtctcagccccagatcgagggctacattcgacgatgtcgtggcctgcggcgagtttgcaaatccatccgtctacatgctgcctaacattacgatctatcagtctaacattgaacgtagccactactgtatagctgactcacattgcctagaggagttcgaactggtgaagcccgagctcctgaccgcccttaaaaagagtacttgctgggcgggagaaatcgatgacattgttttgcacaaacagtccgacggcctgcggtcttgtcgaatcaaggatacagggacctgcgacgtgttaggaaatgagtggacaattgtactctgtgaaaacaataacttttattacagcgaggtccatagagattatgacaaggatcaggacatcggtcacttctgcctgtccccaaggtgtaatataatccgctaccccattaaccctcggcacatcagaacttgcaaatggcaaatttcacatagcaccatcgataagataacggtgcacgagcttgccgacattgaacagtacaaaaaggctatcacccagaaactgcagaatagtttgtctatctttaagtataagaggactaaaaacctcccacatattaagccgatatacaaatatatcgcaattgagggcacagaaaccgttgaggggatcgaaaatgcctacattgagtccgagatccccgctctggccggaacagcaataggcttcaagatcaacagcaaagatggtaatcacctaatggacgtgattgggtatgtcaagtcggcgtcatactctagtacttataccaagctgtacacgacaggccctaccatcggaattaacactaaacatgatgaaaagtgtacaggctcctgcccaacccaagtgaaacacaagactgggtggctcacctttgccaaagagcgcacaagcacgtggggatgtgaagagttcggttgcctggctatctctgacggctgtgtatttgggagctgccaggatataattaaggacgaacttaccgtgtaccgaaaaactacagacgaggttaccgagttggaactgtgcttaacattcgccgataagacttattgtaccaatctcaacgcagtcacgcccatcatcacagacaagttcgaggtgcagtttaaaaccgtggaatcctactcactgcctcggattatcgctgtcaagaatcacgagataaaagttggacaaattaacgatatcggcgtgtatagtaagggttgcgggaacgtgcagaaagtaaatggcactagctacggaaacggcgtcccaaagttcgactatctttgtcatctggcctctcgtaaggaggtgaccattagaaaatgctttgataatgactaccaggcatgtaagttcctacagacaccctcctcatataggctcgaagaacaccaagggactgttaccatcatagattacaaaaagattctgggaagtatcaaaatgaaggccatcttgggcgacgtgaagtacaaaaactatgctagcaatattgatatcaacgcggaaggttcctgcgccgggtgtattaattgctttgagaacatacattgtgagttcacaatccactctacggtcgaaacctcgtgccagattgagagcgactgtacttcatttcatgatcgcgtgctgatcacaccgaatgaacacaagtacgcattaaaactcatctgccacgacaagcctgcttccagtctgaaattcaagatttgcaacaccaaggttgaggccgccatgactcttgtggacgctcggccaataatcgaactggcacccgtagatcagacagcctatattagagagaaagacgaaaggtgtaagacctggatgtgccgagtccgcgatgagggaatccaggtgatttttgagcctttcaaaaatttgtttggctcttacatcggtatattctatgcgatcgtgatttgtatcattgtcctcttcctgatcgtttacatagtgctacccatttgctttaagctgaaagacacgcttaagcaacatgaagatgcttataagcgggagatgaaaatcagatga

SEQ ID NO: 10961 - RNA, 4326 nt, synthetic construct
  misc_feature 1..4326: note = derived and/or modified CDS sequence (opt3) from SAV__AF123486.1__GP
  source 1..4326: mol_type = other RNA
atgatccccctcctcttccttgtgaccctggtcagcgccggccctgtttttcagagatgcttccaagacggggctattgtgaagcagaacccatccaaagaggcagtaacagaagtgtgtataaaggatgacgtctctatgatcaaaactgaggccaggtacgtgcgcaattcaagtggagtttttagcaacaatgtggcgttgaggaagtggttagtctccgattggcacgactgcaaaccgaagaaggtgtctggtggccatattaacgtaatcgaagttgggaatgatctgacgctacacaccgagtcgtatgtgtgttcagctgactgcacaattggaatcgataaagaaactgcccagatacgactccagaccgacacaaccaaccatttcgaggtcgcaggcactacagttaagagcggttggtttaaaagtaccacgtacatcactctggatcaaacctgtgagcaccttaaggtgtcctgcgggcccaaatctattcagttccatgcctgttttaatcagcacatgagctgcgtccgtttcctgcacagaacaatcttgcctggatccatggctaactcaatttgtcagaatatcgaaataattatcctcactaccctggcactgctcatatttttactgcttacaatcttgagtaagacctatatctgctacctgctaatgccaattttcatacccatcgcccatctctatggcctgatttacaacaagagctgtaaaaagtgccaactttgcggcctggtttatcacccttttacggagtgtgggactcattgcgtgtgtggagctaggtacgaaacatctgaccggatgaaattgcaccgcgcctccggtctctgcccaggctacaagtcactgagagcggcaagggtaatgtgtaaaagcaaggggcccgccagtaatttatctatcataaccgctgtgctgactctcacattcgtcacccctattaacggacttacgatcggcgattccaaagaggtgctgaatccagacgagttgccggatgacatgctagaaatggcccagaagctgaacatgtatcagctcatctgcattatcaattacaccgcaacatggagcattataatcattggtctggctgtgttttatatcttcaagaaataccagcaccggttctataactactatgccatgtactgtcaagagtgcgacatgtaccatgaacgctcggggcttaagtggaacggagattttactaataaatgtcgacagtgcacctgtggcgagtatgaagacgcggccggcctgatctctcacagaaagtcctacaactgcttgctccagtataaagttaagtgggtcatgaatttcctgacaatttacgtggcattaataatcctgaaggattcaactctaattgtacaagctgccgggaccgactttagtgattgcatcgagacagaggaactgaactggaattgtaccggacccttcctgaaccttggtaattgcgagaaaaagcagaaaaaggaaagctattccaacattgctgagcagttgaaaggcctgcaggccatctctgtgctcgacatacctctgatcgcacggattccagaagatatcagcgggggacttcggtacattgagtcaatccgtactcatcacgcccagctgacggctgagtatgcgatgttgacacgctactgtgactaccataagctctttggcgataatagtggttattcccagaccacttggagaatgtacctgaggagccacgacttcggggcatgcatattatatcccaaccagcacttttgtcggtgcgtgaagcatggcgaaaaatgttcttcaagtagctgggatttcgcctccgagatgaagaattactattctggaaaacagggcaagtttaacaaagacctgaatctagctctccaatcgattcaccatgccttccgagggaccagctcctcatacatcgcaacaattctgagtgaaaagcgcaacgaccagcttgtcgagtatatggaaaagttgagagagaaatttatcggaaatgccctgctcagggctgtgctggatttcataacctacatgaagtctttaactgagatgacaaactttaaacacgacgagttctgggatgagttcgtccatctgcctgccccaacgaaggcacccagcatgcggcgctccggtaacgaaaattacgactttaaagcgccgaccagccctgctggcactaagtcatgcaaaaacatcaagaatgtggtttgtctttctcccagatccggggccagttatgaaggaattgtggcatgcggcgagccaagcgcccctcagatcttcaagatgccctctgaatccatttaccacaacaatgctgatcagtcaatgtattgtatcgccgacacacactgcttgcaagattacagtccagtagaggacgaggaactcaacgcaattaaaaagagcaaatgctgggaaaccgagtttacaaatgctgtccccttcaagcagtcggatggtattaggtcctgtcgtatgcgggactctgggaactgcaatgtgactaccaacctgtggcctgttatgcagtgtgatgacggcaaattttattacagcgagcatcagaaggattatgacaaggaccaagatatcggacacttctgcctatcaccacgatgtaatatggtgagatttccgatcagtgagaaaaacattctggcctgcgactggatcgtctcccatcccaatattgataagatagacgtgcactctctcgaagatctggaacagtacaaaaaggcgatcacgcagaaacttcaaaccagcttgtccattttcaagtacgccaagacaatgaacctgcctcacgtaaaaccaatctataagtacatttcaatcgagggcactgaaaccgctgagggggtggagaatgcatttatagaaagcgagatccccgccttagctggaacaagtattggtttcaaagttaactctaaggacggcaaacatatcatggatattatcgggtatgtcaagactgcctcctacagctcggtgtataccaagctctacacgacatcacctaccactggagtgaacacaaaacacgacgaactgtgtaccggcccatgccccaagcagatagagcataaaaatggttggattactttttctaaggaaaggaccagttcctgggggtgtgaggagttcggctgccttgcaatcagcgatggatgtgtctttggctcttgccaggacatcattaaagatgaaatgagcgtttatcgcaaggagacagaagagacgaccatagtggagctgtgcttgactttctccgacaaaacatactgtgtggaactcaacccggtaacccctatcattacagatctgttcgaggtccagtttaagactgtggaatcatacaccctaccacggatcgttgcggtgaagaatcacgaggtcatggtggggcaaattaacgacctgggagtttatagtaaaggctgcggtaatgtgcagaaggtaaacgggacggtctacggaaatggcgtgcccaaattcgactatctctgtcatctggccagcagaaaggaagtgatcataaggaaatgctttgataacgactaccaggcttgtaagttccttcagtctccttcctcatatcgcttggaggaggatgccagtacagtcagcatcattgactacaagaaaatcctgggtaccattaagatgaaagcaatcttaggcgatgttcgatataagactttttccgaatctatagacatttcggctgaggggacctgcacaggatgtgtgaattgcttcgaaaacatccactgtgagtttactatccacagcaccgtagaagcctcatgccccgtggtctccacatgtactctcttccatgatcggattctgatcggcccagacaatcacaaatacgcaatgaaggtgatatgcaccgaggcccctaagacgagtctttcttttaaaatttgcaacacaaaggttgatgctgcgatcaccattgtggacagcaaacccatcgtcgagctggccccagtggatcaaactgcatacatacgtgaaaaggacgacagatgtaaaacatggatgtgcagggttcgcgatgaggggatgcaagtgctatccgaaccgttcaagaatctctttggatcatatattggcatcttctacaccggtctggctgtcttgatcattgccctgatcgccgtatatattgtgatgcctatatgtttcaaggttaaagacatcttaaagaaacatgatgacgcttaccggagagagctcaagattaggtga

SEQ ID NO: 10962 - RNA, 4326 nt, synthetic construct
  misc_feature 1..4326: note = derived and/or modified CDS sequence (opt3) from SAV(20230)__KX817331.1__GP
  source 1..4326: mol_type = other RNA
atgatccccttactcttccttgtgaccctggtcagcgccggccctgtttttcagagatgcttccaagacggggctattgtgaagcagaacccatccaaagaggcagtaacagaagtgtgtataaaggatgacgtctctatgatcaaaactgaggccaggtacgtgagaaattcaagtggagtttttagcaacaatgtggcgttgcgcaagtggttagtctccgattggcacgactgcaaaccgaagaaggtgtctggtggccatattaacgtaatcgaagttgggaatgatctgacgctacacaccgagtcgtatgtgtgttcagctgactgcacaattggaatcgataaagaaactgcccagatacgactccagaccgacacaaccaaccatttcgaggtcgcaggcactacagtcaagagcggttggtttaaaagtaccacgtacatcactctggatcaaacctgtgagcaccttaaggtgtcctgcgggcccaaatctattcagttccatgcctgttttaatcagcacatgagctgcgtgcgtttcctgcacagaacaatcttgcctggatccatggctaactcaatttgtcagaatatcgaaataattatcctcactaccctggcactgctcatttttctgctgcttacaatcttgagtaagacctatatctgctacctgctaatgccaattttcatacccatcgcctatctctacggcctgatttataacaagagctgtaaaaagtgccaactttgcggcctggtttaccatccttttacggagtgtgggactcactgcgtgtgtggagctaggtacgaaacatctgaccggatgaaattgcatcgcgcctccggtctctgcccaggctataagtcactgagagcggcaagggtaatgtgtaaaagcaaggggcccgccagtatcttatctataattaccgctgtgctgatcctcactttcgtcacacctatcaatggacttaccattggcgattccaaagaggtgtttaacctggacgagttgccagatgacatgctagaaatggcccagaagctgaatatgtaccagctcatctgcattataaactatacggcaacctggagcatcattatcatcggtctggctgttttctacattttcaagaaatatcagcaccggttttacaattattacgccatgtactgtcaagagtgcgacatgtatcacgaacgctcggggcttaagtggaacggagatttcacaaacaaatgtcgacagtgcacttgtggcgagtacgaagacgcggccggcctgatatctcataagaaatcctataattgcttgctccagtacaaggtgaagtgggtcatgaactttctgaccatctatgtggcattaattatcctgaaagattcaacactaattgtacaagctgccgggactgacttcagtgattgcatcgagaccgaggaactcaattggaactgtacaggaccgtttctgaatcttggtaactgcgagaagaaacagaagaaagaaagctactccaatatagctgagcagttgaagggcctgcaggccatctctgttctcgacattcccctgatcgcacggattcctgaagatatcagcgggggacttaggtatatagagtcaattcggacccaccatgcccaactgactgctgagtacgcgatgttgacgcgttactgtgactattacaaactcttcggcgataacagtggttattcccagacaacctggcgcatgtacctgagaagccacgactttgaagcatgcatcttatatccaaataggcatttctgtcggtgcgtgaaacacggggagaagtgttcttcaagtagctgggattttgcctccgaaatgaaaaactactattctggcaagcagggaaaattcaataaggacctgaacctagctctccagtcgattcaccatgcctttcgaggcactagctcctcatacatcgcaaccatactgagtgagaagcgcaatgaccaacttgtcgaatacatgaaaaagttgagagagaaattcatcgggaacgccctgctcagggctgtgctggattttattacatatatgaagtctttaaccgagatgactaatttcaaacacgacgagttctgggatgaatttgtccatctgcccgcccctacaaaggcaccaagcatgcggcgctccggaaacgaaaactacgacttcaaagcgcccacgtcaccggctggtaccaagagctgcaagaatatcaaaaacgtggtttgtctttctcctagatccggcgccagttatgaggggattgtggcatgcggagagcccagcgccccacagatctttaagatgccttctgaatccatataccacaataacgctgatcagtcaatgtattgtattgccgacactcactgcttgcaggattacagtcccgtagaggacgaggaactcaatgcaatcaaaaagagcaaatgctgggaaacagagttcaccaacgctgtcccatttaagcaatcggatggcatcaggtcctgtcgtatgcgggactctggtaattgcaacgtgacaactaatctgtggcccgttatgcagtgtgatgacgggaagttctattacagcgagcatcagaaagattacgacaaggaccaggatattggccacttttgcctatcacctcgatgtaacatggtgagattcccaatcagtgaaaagaatattctggcctgcgactggatagtctcccatccgaacatcgataagattgacgtgcactctctcgaggatctggaacaatataaaaaggcgatcacccagaaacttcagacgagcttgtccatttttaagtacgccaagaccatgaatctgccccatatcaaacctatatataagtacatctcaattgagggaacagaaactgctgagggcgtagagaacgcattcatcgaaagcgagattccagccttagctgggaccagtatcggatttaaagttaattctaaggacggtaagcacataatggatattatcggctatgtgaaaacagcctcctacagctcggtctatactaagctctacaccacggggcccacaaccggagtgaacactaaacacgacgaactgtgtacaggcccttgcccaaagcaaatcgagcataaaaacggttggattaccttctcaaaggaaaggacttctagttgggggtgtgaggagtttggctgccttgcaatatccgatggatgtgtgttcggcagctgccaggacatcattaaagatgaaatgtctgtctaccgcaaggagaccgaagagacaacgatcgttgagctgtgcttgaccttcagcgacaagacttattgtgtggaactcaatcccgtgacaccgattatcaccgatctgtttgaggtacagttcaaaacagtcgaatcctacactctacctcggatagtggcggttaagaaccacgaggtgatggtcgggcagatcaatgacctgggagtgtattcaaaaggctgcggtaacgttcaaaaggtgaatgggaccgtatacggaaacggcgtcccaaaatttgactatctctgtcatctggccagtagaaaggaagtgattatcaggaagtgcttcgataatgactaccaggcttgtaaatttcttcagagcccctcttcctatcgcttggaggaggatgcctcaacggtgagtattatcgactacaagaaaatactgggtacaattaagatgaaagcaatcttaggcgatgtccgatacaagaccttcagcgaatccatcgacatttctgctgaggggacttgcaccggatgtgttaactgctttgaaaatatccactgtgagttcacaatacattcgactgtggaagccagctgccctgtagtgtcaacctgtacactctttcacgatcggattctgatcggccccgacaaccacaagtatgcaatgaaagtcatttgcacggaggccccaaagacctcccttagtttcaaaatctgcaatactaaggtggatgctgcgataacaattgttgactctaaacctatcgtggagctggcccccgtcgatcagaccgcatacatccgtgaaaaggacgacagatgtaagacttggatgtgcagggtgcgcgatgaggggatgcaagttctactcgaaccatttaaaaacctgttcggaagctatattggcatcttctacacaggtttggctgtgctgattatagccttaatcgccgtctatattgtaatgccgatctgttttaaggtgaaagacatcctcaagaaacatgatgacgcttaccggagagagctgaagattaggtga

SEQ ID NO: 10963 - RNA, 4329 nt, synthetic construct
  misc_feature 1..4329: note = derived and/or modified CDS sequence (opt3) from SDNV__AF123490.1__GP
  source 1..4329: mol_type = other RNA
atgatctgcattctgctccttatagccctggctagcgcatcccccgtgtaccagagatgtttccaagacggcgccatcgtcaagcagtatcctgcgaaagatgctgttaccgaggtgtgcttgaaggacgatgtatctatgattaaaacacaggccaactacatgaagaatactacggggaccttttcaaacaatgtggcaatgaggaaatggttagtcgccgactggcacgattgtcggccacagaagagtagcggaggtcatatcaacgtgattgaagttggcgacgatctgtccctacacacagaggcttatatctgctctgcagactgtgtgatatcgatcgataaggaaactgcccaaattcgcctccagaccgactcaacaaatcatttcgaggtcagcgggaccactgtgaaaagtggatggtttaagtccacaacctacatcacgctggatcagacttgcgaacaccttaaagtatcttgtggcccgaagtctattcagttccatgcttgctttaaccaacacatgtcctgtgttcgattcctgcaccgtaccatcttgcccggttcaatggccaatagtatatgccagaacattgagatcattatcctcgtgacactgactctgatgatctttattctcttaaccataatcagcaaaacatatatttgttacatcctgatgcctatattcattccaatcgcgtatatctacgggtggatttacaataagtcttgcaagaaatgcaaactttgtggattggtctatcatccctttaccgagtgcggcacgcactgtgtgtgcggcgcaagatacgaaacttccgacaggatgaagctgcatcggtcaagcgggctatgtcctggatataagagtctccgcgccgctagagtgatgtgcaaatctaggggtccagcctccatcctgagcattcttacagcagtcctgatattgaccttcgttactcccatgtcggctctcgtgatcggcagctccgaggaactgtacaagttagatgagctgcctgacgacatgattgatatggccgagaaagtaaacctctattaccttgtgatcgtcctgaattattcagcgacatgggggttgctactgctcatgggaatcctggcccttctgtttaagaagtaccagcacattttcttgaactactatgcaatgtactgtaccgaatgcgacatgtatcacgataaaaaggagctcacgtacaatggcgacagtccaaccaacgcttggcagtgtacatgcggtcaatatgaagatgccactgggctgatagtgcatcagaaaagctacaattgtttagttaagtataaagtgaagtggatcaagaacattctgatcatgtacattgtcctaaccctcatcaaagactccgtgctgatagcttctgccgagggaccggattttgcaacatgcatcgaagagaagactattacctggaactgcacaggccccttccttaatttgggccggtgtgacaaaacccagaagaaaactgattacgccacgatcgctagccaactgaaggggattgacgcgatctcaatactcgatgtacctatgattagtaagatcccagaggacatttccggagcactgaaatatatcgaaagccttaagacataccacgagcagctgaccgccgaatatgctatgttcactcgctactgcgactattacacccagttttctgataactcaggttatagtcagacaacctggcgaacttacttgagaagccatgacttcgaggtttgtatagcctaccccaatcaacacttttgtaggtgcgtgaaaaacggcgaaaagtgctcctctgcacagtgggatttcgccacagagatcaaagggtattacacgggacggcagaataagtttaacaaggacctcaatctggctttaatgaccttccatactgcctttcgtggcacagcaacctcgtatgtcacagagctgattagcaaaggtaagaactcctcactactcatgtacgcgagtgctatcaaatctaagttcaatgggaacgccctgcttaaagcattgctggattttatgatgtatctccagagcctgggcgaaatttccggattcaagttaactgacgagtgggaagattttaaatacgaggaagaacctaccgagcaaacgctgatgccacgcggccacagagggggacagtataatttcaagaacgccgcttcaaatggtaagaccaaagtgtgtaagaacgtcaaaaaggtgctttgcttgagccccaggtctcgggccacatttgacgatgttatcgcatgtggcgaacacgctaatccgtccgtgtacatgatacctaacactaccatttaccagagtaacacagagcgaagccattattgcatcgccgactctcactgtctcgaagagtacgagctggtaaaacccgaactactgactgcgctcaagaagtcccgctgctgggccggggatatcgacaccattgtcctgcataaacagtcagatggacttagaagttgcaggatcaaggacacgggcagctgtaatgtgatgggtaacgactggacaattgttttgtgcgaggataataaatattactattcggaagtgcaccaagactacgataaggaccaggatgtcgggcacttctgtctgtccccacggtgcaacaccatacgctatcctatctctcccagacatattaatagctgtaaatggcagatctcacacagtactattggcaagatctccgtgcatgagttagctgacatagaacagtacaagaaagcaatctctcaaaagctccagacaagcctgtccattttcaaatacgccaagaccaaaaaccttccacacatcaagcccgtatataagtacattgctatcgagggaactgagaccgtggaaggcgttgagaatgcctttatagaatcagagattcctgcactggcggggacagccatcggattcaaaatcaacagcaaggaaggttatcatttgatggatattataggctacgtcaaaagtgcttcttattccagcacgtacaccaagctctatactacagggccaaccatcggaattaatacaaaacacgacgagaagtgcactggctcgtgtccgggtaccatccaccataaaacggggtggctgacattttcaaaggagaggacctctacttggggctgcgaagagttcggatgtctagccgtgagtgatggctgcgtgtacgggtcctgtcaggacattatcaaggatgaactgaccgtctaccgtaaaataagcgacgaggttacagaagtggagctctgcctgactttttctgataagacctattgcacaaaccttaatgcagtgacgcccatcattaccgacaaattcgaggtacaatttaagactgtcgaaagctactccttgcctcggatcgtgggagttcgaaaccacaaaattcagatcggccagataaatgacattggtgtgtattcaaaggggtgtggaaacgtccagaaggtgaatggcacaaactacggtaacggcgttccaaaattcgattatctgtgccatttagctagtagaaaggaggtgatcatcaggaaatgttttgacaatgattaccaagcctgcaagttcctccagacccccgcaagctatcgcctggaggagcaccaggggactgtaacaattatcaactacaaaaagatacttggatctattaagatgaaaccttactgggtcatgctgcggtataagaattacgccaactccctagacatcaatgctgagggcacctgttcagggtgcgtgggatgttttgaaaacattcattgcgagttcacgatccacactaccatagaagcgagttgtcagattgagagcgattgcacaacctttcacgacagaatcctcgtgactccaaatgaacataaatatgccctgaaggtcatctgtcacgataaacccaagacaattttcaacttcaagatctgcaataccgagattgaggcagctatagccatcgttgacgccaaaccgattatcgaattggctcctgtggatcaaacagcatacatcagggagaaggacgaacgctgcaaaacttggatgtgtcgagtacgggatgagggcattcaggtgctgttagaaccatttaagaacctcttcggttcctatatagggatcttttacaccattctgatcgtcattttcatccttgtgataatcatttatatcattctgcccatctgctttaaattgcaggacacgctcaagcagcatgaggacgcctacaagcgtgagatgaaaataagatga

SEQ ID NO: 10964 - RNA, 4329 nt, synthetic construct
  misc_feature 1..4329: note = derived and/or modified CDS sequence (opt3) from SDNV(BeAr103645)__KX817334.1__GP
  source 1..4329: mol_type = other RNA
atgatctgcattctgctccttatagccctggctagcgcatcccccgtgtaccagagatgtttccaagacggcgccatcgtcaagcagtatcctgcgaaagatgctgttaccgaggtgtgcttgaaggacgatgtatctatgattaaaacacaggccaactacatgaagaatactacggggaccttttcaaacaatgtggcaatgaggaaatggttagtcgccgactggcacgattgtcggccacagaagagtagcggaggtcatatcaacgtgattgaagttggcgacgatctgtccctacacacagaggcttatatctgctctgcagactgtgtgatatcgatcgataaggaaactgcccaaattcgcctccagaccgactcaacaaatcatttcgaggtcagcgggaccactgtgaaaagtggatggtttaagtccacaacctacatcacgctggatcagacttgcgaacaccttaaagtatcttgtggcccgaagtctattcagttccatgcttgctttaaccaacacatgtcctgtgttcgattcctgcaccgtaccatcttgcccggttcaatggccaatagtatatgccagaacattgagatcattatcctcgtgacactgactctgatgatctttattctcttaaccataatcagcaaaacatatatttgttacatcctgatgcctatattcattccaatcgcgtatatctacgggtggatttacaataagtcttgcaagaaatgcaaactttgtggattggtctatcatccctttaccgagtgcggcacgcactgtgtgtgcggcgcaagatacgaaacttccgacaggatgaagctgcatcggtcaagcgggctatgtcctggatataagagtctccgcgccgctagagtgatgtgcaaatctaggggtccagcctccatcctgagcattcttacagcagtcctgatattgaccttcgttactcccatgtcggctctcgtgatcggcagctccgaggaactgtacaagttagatgagctgcctgacgacatgattgatatggccgagaaagtaaacctctattaccttgtgatcgtcctgaattattcagcgacatgggggttgctactgctcatgggaatcctggcccttctgtttaagaagtaccagcacattttcttgaactactatgcaatgtactgtaccgaatgcgacatgtatcacgataaaaaggagctcacgtacaatggcgactttaccaacaaatgtcggcagtgcacatgtggtcaatatgaagatgctactgggctgatagtgcatcagaagagttacaattgcttagttaaatataaggtgaagtggatcaaaaacattctgatcatgtacattatcctaaccctcataaaggacagcgtcctgatcgcctccgctgagggaccagatttcgccacatgcattgaagagaaaactatcacctggaactgtacaggcccgttccttaatttgggccgctgcgacaagacccagaaaaagactgattacgcaacgattgcctctcaactgaaggggatcgacgctataagcattctcgatgtgcccatgatctcaaaaattcctgaggacatcagtggagcgctgaagtatatagaatcccttaaaacataccacgagcagctgaccgcagaatatgccatgtttactcgatactgtgactattacacccagttcagcgataactctggttattcacagacaacctggagaacttacttgaggagtcatgactttgaggtatgcatcgcttacccaaatcaacacttctgtcggtgcgttaagaacggcgaaaaatgtagctccgcccagtgggattttgcaacagagattaaggggtattacacgggaaagcagaataaattcaacaaggacctcaatctggccttaatgacctttcatactgctttccgtggcacagccacctcttatgtgacagagctgatctcgaaaggtaagaacagctccctactcatgtacgcatcagcgattaaaagtaagtttaatgggaacgctctgcttaaagccttgctggatttcatgatgtatctccagtctctgggcgaaatcagcggatttaagttaactgacgagtgggaagatttcaagtacgaggaggaacccaccgagcaaacgctgatgcctcgcggccacagagggggacagtataattttaaaaacgcagcctccaattcaaagaccaaagtctgcaagaacgtgaaaaaggtcctttgtttgagcccaaggtctcgggctacattcgacgatgtgatagcctgcggtgaacacgcaaatccctccgtttacatgattccgaacactaccatctaccagagtaacacagagcgaagccattattgtatcgctgactctcactgcctcgaagagtacgagctggtgaagcctgaactactgactgccctcaaaaagtcccgctgctgggcgggcgatattgacaccatcgtactgcataaacagtcagatgggcttagaagttgtaggattaaggacacgggaagctgcaatgtcatgggcaacgactggacaatagtgttgtgtgaggataataaatattactattcggaagttcaccaagactacgataaggaccaggatgtgggtcacttctgcctgtcccccagatgtaacaccatccgctatccaatttctcctagacatatcaatagctgcaagtggcagatttcacacagtactatcgggaaaatatccgtccatgagttagccgacatcgaacagtacaagaaagctatttctcaaaagctccagacaagcctgtccatctttaaatacgcaaagaccaagaaccttccccacattaaaccagtgtataagtacatcgccatagagggcactgagaccgtagaaggagtggagaatgctttcattgaatcagagatccccgccctggcaggcacagcgatcgggtttaaaattaacagcaaggaaggaaatcatttgatggatataatcggttatgttaaaagtgcctcttactccagcacgtataccaagctctacactacaggccctaccattgggatcaacacaaaacacgacgagaagtgtactggatcgtgcccaggcaccattcaccataagacgggttggctgacattctcaaaagagaggacctctacttgggggtgtgaagagtttggctgcctagctgtcagtgatggatgtgtgtatggctcctgccaggacatcataaaggatgaactgaccgtgtaccgtaaaatcagcgacgaggtcacagaagttgagctctgcctgactttctctgataagacctactgtacaaatcttaacgccgtgacgccgattatcaccgacaaatttgaggtgcaattcaagactgtagaaagctattccttgccccggattgtcggggtgcgaaatcacaagatccagataggacagattaacgacatcggcgtttactcaaaaggttgcgggaatgtgcagaaggtcaacggaacaaactatggcaatggtgtgcctaaatttgattacctgtgtcatttagcaagtagaaaggaggttatcattaggaaatgcttcgacaacgattatcaggcttgtaagtttctccaaaccccagccagctaccgcctggaggaacaccagggcactgtgacaatcatagactataagaaaattcttgggtctatcaagatgaaagcaattctgggagatgtacggtacaagaattacgccaactccctagacatcaatgctgaggggacctgcgcgggctgtgtcggatgcttcgaaaacatacattgtgagtttacgattcacactaccatcgaagcctcatgccagatcgagagtgattgtacaaccttccacgaccggattctcgtgactcccaatgaacataaatatgcactgaaggtgatctgccacgataagcctaaaacaattttgaacttcaagatatgcaataccaaaatcgaggctgccattacaatcgtcgacgccaagccaatcattgagctggctcccgttgatcaaactgcatacataagggaaaaagacgagcgctgtaagacctggatgtgccgagtgcgggacgaaggcatccaggtattactcgagccgtttaagaacctgttcggtagctatattgggatcttttacacgattcttatcgtgatattcatcctggtcattatcatttatatcatattgcctatttgttttaaactccaggatacactgaagcagcatgaagacgcctacaaacgtgagatgaagatcagatga

SEQ ID NO: 10965 - RNA, 4326 nt, synthetic construct
  misc_feature 1..4326: note = derived and/or modified CDS sequence (opt3) from SSHV__EU262553.1__GP
  source 1..4326: mol_type = other RNA
atgatctgcattctgatactcttcgccgtgaccgctgcaagccccgtctaccagagatgttttcaagacggcgccatcgttaagcagaacccttccaaagaggcggtgacagaagtatgccttaaggatgacgtgtctatgattaaaactgaggctaggtatatcaagaatgccacgggggtcttctcaaacaatgtggcaattcggaaatggctggttagtgattggcacgactgtcgcccaaagaagatcaccggaggtcatataaacgtgatcgaagtcggcgatgacttgagcttacacacagagtcctacgtgtgctctgccgattgtactattggggtagacaaagaaaccgctcaggttcgactgcagacagataccactaatcattttgagatcgcaggaacaaccgtgaagtcgggctggttcaaatcaacgacttatattaccctagaccaaacatgcgagcacctcaaggtcagctgtggtccgaaaagtatccagtttcatgcctgcttcaaccagcacatgtcctgtgtgcgttttctgcacagaactatacttcccgggtctattgctaatagcatctgccagaacattgaaatcatcattctggtgaccttgacactcctgatattcatcctgctctccgtcttatcaaagacctacatttgttatctgcttatgcctgtttttatcccaatagcctacgcgtatggaattatctacaataagagttgcaaaaagtgcaaattgtgtggcctggtgtaccatcccttcacggagtgcggcactcactgtgtatgcggggcaaggtatgatacaagcgaccggatgaagctacatcgcgcctctggactctgtcctggttacaaatccctgagagctgccagggtgatgtgcaagtcaaaaggcccagcaagcatccttagtgtcattaccgctatcctgattttgacttttgtgacacccataaactctatggttgtgggggaatccaaggaggtcttcgagctcgaacaactgcctgatgacatgttagacatggccctgcggatcaatttttattacttcgtgtgtattatgaactatgcggtaacctggggactcatcatcattggccttctgataggtttgctattcaagaaataccagcaccgctttagcaatctgtatgccatgtactgcgaggaatgtgatatgtaccacgaccgatcggggctcaagagaaacggagatttcacgaataaatgcaggcagtgtacctgcggccagtatgaggacgcaacaggcctgatgactcatcggaagacctacaactgccttgttcgttataaagctaagtgggtgatgaactttctgatcgcctacatgttgctcacactgattaaggattctgctatcgtcgtgcaagccgcagggactgacttcaccacatgtttagaaaccgagaatattaactggaattgcactggaccatttctgaacctaggtaattgtcagaaacagcaaaagaaagagccgtatgccaacatcgctacgcagctcaagggcctgcaggcgatatccgtccttgatatgcccatgatcgcatcaattcctgaagacatcgccggggctttgcgctacattgaggaaaaagagacattccacgtgcagctgaccgccgaatatgcaatgctcagtagatactgcgattactatgcccaatttagcgacaattccggatactctcagactacctggagggtttatctgcggagccatgatttcgacgcttgtatcctttacccaaaccagcacttttgccgatgtgtgaagcatggcgacaagtgctcaagttccaatcgcgatttcgccaacgagatgaaaaattattacagcggtaagcagaacaaatttgacaaggatctgaatttggcactcatggcgctgcaccacgctttcagagggacatcttcagcctatatagcaaccatgttaagtaaaaagagcaacgacgatctgattgcctacactaataagatcaaagagaagtttcccggcaacgctctactcaaagccattgtagactacatcgcatatatgaagtccctgtctgaaatgtcgagcttcaaatacgatgagttctgggacgatcttttgtataagtccgctcctacaaaagccccatcactgagtaggggatctgaacccagctacaactttaagctcgtcgtgtcctcacggagcataaagtcttgtaaaaatgttaagtccgtggtctgcctgagtccgcgcagcggcgtgtcttatgactccatcattgcgtgtggggatcctaacggaccctcagtatacagaaaaccaagtgacggtgtgttccaaagcaatgccgatcagtcgacgtattgcttagctgactcccattgcctggaggactttgaagttgtctctcaggaggagcttgatgcaatcaagaaaagcaagtgttgggaagccgagtaccctgacgtgaagttgtcaaaactcaccgatggcgtgaagagttgcaggatgaaagactccgggaactgtaatgtcgctgccaaccgttggcccattatccagtgcgaaaatgataagttctactattctgagctgcaaaaagactacgataagactcaggacataggacacttttgtctaagcccaggctgctccacagttcggttccccattaaccctaagcatatctcaaattgtaactggcaagtgagccgaagttctatcgcaaaaattgatgtgcacaatatcgaggacattgatcagtatagaaaggcgataacccagaaactgcagacatccctcagcctgtttaagtacgccaaaactaagaaccttccacacatcaagccgatttataaatacatcaccattgaaggtacggagaccgctgaagggatcgagtcggcctatatagaatcagagatccccgcattggctggcacatctattggattcaagatcaccagtaaagagggcaagcatctgttagacgtaattgggtacgtcaaatccgccagctactctagcatctatactaagctctacacaactggacctacctccggtataaatacgaaacacgatgaactgtgcacaggcccatgtcccgcaaagattaaccatcagaccgggtggcttacttttgccaaggagaggacatcaagttggggatgcgaagagttcggctgtctggctatcagcgacggttgcgtgtttgggtcttgccaagacatcattcgcgatgaattgaccgtttatcggaaagagactgacgaggtgaccgatgtcgaactctgtctgacattctccgacaagacgtactgcaccaatctaaaccctataactccaatcattacagatctgtttgaggtgcagttcaaaaccgttgaaacatattcactccccagaatcgtggcgattcagaaccacgagatcaagataggccaggtaaatgacctgggagtctacagtaaaggctgtgggaacgtgcaaaaggtgaatggaactgtctatggcaacggtgttccgaagttcgattacctttgccatttggccagcaggaaagaagtgatcgtacgcaagtgttttgacaatgattaccaggcatgcaaattcctgcagtcccctgcttcttatcgattagaggaggactcggggaccgtgacggtcattgattacaagaaaatcctcggaacaattaagatgaaggccatcctgggcgacgtgaaatataagacctttgccgacaacgttgatatgactgctgaaggtagctgtaccggctgcataaattgtttcgagaacattcactgcgaacttacactgcacactaccatcgaggcatcatgtccaatcgtgtccacatgcacggtctttcatgaccggattctagtgacccccaatgagcacaaatacgccctcaaggttgtgtgcactgaaaaacctgggaacacactgaccatccgtatatgtaatactaaggtcgaggcgagtttggctctggtagatgccaagcccattttagaactcgcaccagtggaccagacagcctatatcagagagaaagatgaaaggtgcaagacctggatgtgtcgcgttcgggacgagggactgcaagtgattcttgagcctttcaaaaacctgtttggctcttacatcgggatattctatacgtttattatcagcatcattgctttgctcatcattatatacatcgtcctgcccatttgcttcaagctaagagatactctgaggaaacatgaagacgcatacaagcgagagatgaagatccgctga

SEQ ID NO: 10966 - RNA, 4326 nt, synthetic construct
  misc_feature 1..4326: note = derived and/or modified CDS sequence (opt3) from SSHV__K02539.1__GP
  source 1..4326: mol_type = other RNA
atgatctgcattctgatactcttcgccgtgaccgctgcaagccccgtctaccagagatgttttcaagacggcgccatcgttaagcagaacccttccaaagaggcggtgacagaagtatgccttaaggatgacgtgtctatgattaaaactgaggctaggtatatcaagaatgccacgggggtcttctcaaacaatgtggcaattcggaaatggctggttagtgattggcacgactgtcgcccaaagaagatcaccggaggtcatataaacgtgatcgaagtcggcgatgacttgagcttacacacagagtcctacgtgtgctctgccgattgtactattggggtagacaaagaaaccgctcaggttcgactgcagacagataccactaatcattttgagatcgcaggaacaattgtgaagtcgggctggttcaaatcaaccacgtatatcactctagaccaaacctgcgagcacctcaaggtcagctgtggtccgaaaagtatacagtttcatgcctgcttcaaccagcacatgtcctgtgtgcgttttctgcacagaacaattcttcccgggtctatcgctaatagcatttgccagaacatcgaaatcattatactggtgactttgaccctcctgatcttcattctgctctccgtcttatcaaagacatacatctgttatctgcttatgcctgtttttataccaattgcctacgcgtatggaatcatctacaataagagttgcaaaaagtgcaaattgtgtggcctggtgtaccatcccttcaccgagtgcggcacgcactgtgtatgcggggcaaggtatgatactagcgaccggatgaagctacatcgcgcctctggactctgtcctggttacaaatccctgagagctgccagggtgatgtgcaagtcaaaaggcccagcaagcattcttagtgtcatcacagctattctgatattgacctttgtgactcccatcaactctatggttgtgggggaatccaaggaggtcttcgagctcgaacaactgcctgatgacatgttagacatggccctgcggattaatttttattacttcgtgtgtatcatgaactatgcggtaacatggggactcatcattataggccttctgatcggtttgctattcaagaaataccagcaccgctttagcaatctgtatgccatgtactgcgaggaatgtgatatgtaccacgaccgatcggggctcaagagaaacggagatttcaccaataaatgcaggcagtgtacgtgcggccagtatgaggacgcaaccggcctgatgacacatcggaagacttacaactgccttgttcgttataaagctaagtgggtgatgaactttctgattgcctacatgttgctcaccctgatcaaggattctgctattgtcgtgcaagccgcagggacagacttcactacctgtttagaaacagagaatatcaactggaattgcaccggaccatttctgaacctaggtaattgtcagaaacagcaaaagaaagagccgtatgccaacatagctactcagctcaagggcctgcaggcgatctccgtccttgatatgcccatgattgcatcaatccctgaagacattgccggggctttgcgctacatcgaggaaaaagagacgttccacgtgcagctgacagccgaatatgcaatgctcagtagatactgcgattactatgcccaatttagcgacaattccggatactctcagaccacttggagggtttatctgcggagccatgatttcgacgcttgtatactttacccaaaccagcacttttgccgatgtgtgaagcgcggcgacaagtgctcaagttccaatggtgatttcgccaacgagatgaaaaattattacagcgggaagcagaacaaatttgacaaggatctgaatttggcactcatggcgctgcatcacgctttcagaggcacctcttcagcctatattgcaacaatgttaagtaaaaagagcaacgacgatctgatcgcctacaccaataagattaaagagaagtttcccggaaacgctctactcaaagccatcgtagactacatagcatatatgaagtccctgtctgaaatgtcgagcttcaaatacgatgagttctgggacgatcttttgtataagtccgctcctactaaagccccatcactgagtaggggctctgaacccagctacaactttaagctcgtcgtgtcctcacggagcatcaagtcttgtaaaaatgttaagtccgtggtctgcctgagtccgcgcagcggggtgtcttatgactccattatcgcgtgtggagatcctaacggtccctcagtatacagaaaaccaagtgacggcgtgttccaaagcaatgccgatcagtcgacatattgcttagctgactcccactgcctggaggactttgaagttgtctctcaggaggagcttgatgcaattaagaaaagcaagtgttgggaagccgagtaccctgacgtgaagttgtcaaaactcacggatggggtgaagagttgcaggatgaaagactccggaaactgtaatgtcgctgccaaccgttggcccatcatacagtgcgaaaatgataagttctactattctgagctgcaaaaagactacgataagacccaggacattggccatttttgtctaagcccaggttgctccactgttcggttccccatcaaccctaagcacatctcaaattgtaactggcaagtgagccgaagttctattgcaaaaatcgatgtgcataatattgaggacatagatcagtatagaaaggcgatcacacagaaactgcagacctccctcagcctgtttaagtacgccaaaacaaagaaccttccacacattaagccgatctataaatacattactatcgaagggaccgagacggctgaaggcatagagtcggcctatatcgaatcagagattcccgcattggctggaacctctatcggcttcaagattacaagtaaagaggggaagcacctgttagacgtaatcggatacgtcaaatccgccagctgctctagcatatacactaagctctataccacaggtcctacttccggcattaataccaaacatgatgaactgtgtacggggccatgccccgcaaagatcaaccaccagacaggatggcttacctttgccaaggagaggacttcaagttggggctgtgaagagttcggttgcctggctatcagcgacgggtgcgtgtttggctcttgtcaagacattatacgcgatgaattgacagtttaccggaaagagaccgacgaggtgactgatgtcgaactctgcctgaccttctccgacaagacatattgtacgaatctaaaccctatcaccccaattatcactgatctgtttgaggtgcagttcaaaacagttgaaacctactcactccccagaattgtggcgatccagaaccatgagataaagatcggacaggtaaatgacctgggcgtctatagtaaagggtgcggaaacgtgcaaaaggtgaatggcacagtctacggtaacggggttccgaagttcgattatctttgtcacttggccagcaggaaagaagtgattgtacgcaagtgctttgacaatgattaccaggcatgtaaattcctgcagtcccctgcttcttaccgattagaggaggactcgggaactgtgaccgtcatcgattataagaaaattctcggcacgatcaagatgaaggccatactgggtgacgtgaaatacaagacatttgccgacaacgttgatatgaccgctgaaggcagctgcactgggtgtattaattgcttcgagaacatccattgtgaacttaccctgcacacaactatcgaggcatcatgcccaattgtgagtacctgcacagtctttcacgaccggatcctagtgacgcccaatgagcataaatatgccctcaaggttgtgtgtaccgaaaaacctggaaacactctgacaatacgtatttgcaataccaaggtcgaggcgtccttggctctggtagatgccaagcccatcttagaactcgcaccagtggaccagactgcctacattagagagaaagatgaaaggtgtaagacatggatgtgccgcgttcgggacgagggcctgcaagtgatccttgagcctttcaaaaacctgtttgggtcttatataggaattttctacacctttatcatcagcattatcgctttgctcattataatctatattgtcctgcccatctgtttcaagctaagagatacgctgaggaaacacgaagacgcatacaagcgagagatgaagatccgctga

SEQ ID NO: 10967 - RNA, 4335 nt, synthetic construct
  misc_feature 1..4335: note = derived and/or modified CDS sequence (opt3) from SORV__AF123488.1__GP
  source 1..4335: mol_type = other RNA
atggaggtgctgagcctcatctggcttctgaccttgtgctccgcctctcccgtcttccagagatgttttcaagacggcgctattgttaagcagaacccttcaaaagaagcagtgacagaggtatgcttaaaggatgacgtgagtatgataaaaactgaaacgaagtacgtcaaaaataccacagggactttcgccaacaatatcgcgatgaggaagtggctggtggctgattggcacgactgtcggccacagaagtcctccggaggtcatattaacgttatcgaggtgggcgatgacctatctctccacaccgaatcgtatatttgctcagccgattgtgtcatcacagtggacaaagagaccgcacagatacgcctgcaaactgataatacaaaccattttgaggtagccgggaccacggttaagagcggatggttcaaaagtactacctacatcacacttgaccagacttgcgaacacctgaaggtgtcctgtggcccgaaatctattcagtttcatgcttgcttcaatcagcacatgagctgtgtccgatttttgcaccgtaccatcctccccggttccattgcaaactcaatctgccaaaatatagagattatcattctggtgacactgagtctcgtgatcttcatctttttaaccattgtcagcaagacgtatatatgttacctgcttatgcctatcttcattccaatcgcctttatatatgggtggatttacaacaagtcttgcaaaaagtgcaaattgtgtggactggtttatcatcccttcactgaatgcggcacacactgtgtgtgcggcgctagatacgagacctccgataggatgaagctacatcgggcctcagggctctgtcctggatacaaaagcctgcgcgcggcaagagtaatgtgcaagagtaaaggtccagcctctatcctttccatcctgactgctattttgatcctcacatttgtgacccccattagcgccatggtcgtgggcgagtcgaatgaaatatatacgctggacgatttacctgacgacatggttcagatggcagagaggatcaacatttactatcagatcctgatcattaattacggggtgacctgggctttcctccttctgggattggtcctagcctatttctttaagaagtaccagcacaaattcctggattattacgcgatgtactgtgaagagtgcgacatgtatcacgaaaagtctggcatgacatactggggtgattttactaacaaatgtcggcaatgcacctgtgggcagttcgaggacgccacaggactcatggtgcataagaaatcctataattgcctggtaaagtacaaggcaaaatggatacgcaacatccttattgcttatctgatgatcatgttggttaaggattcactcctgtttgtgggcgccactcgagctgacttcgccagttgcgtcgatgagaaaaccgtgacatggaactgtaccggcccatttttaaatctggggagatgcgacaagactcagaaaaagacgggatacaaggatattgcaaaccaactaaaaggtctcggcgtcatcagcatactggacatcccgatgattgaaaagatgcccgatgagatctccgggtctcttaaatatattgacagcttggaaacataccacgagcagctgaccgccgaatacgctttcctcactaggtattgtgactactatacccagtacacagataattcaggatatagtcagaccgtgtggcggacttacctgcgttcccatgactttggcgcgtgcgttgtgtatcctaaccaacacttctgtcgctgcgtaaagtacgatgacaaatgtaatagcgcaaagtgggattttgccaacgagatgaagacattctacacgggtagaaaagtcaagtttaataaagaccttaacctggctttgctcgtgctgcataaggccttcagggggaccggcactgcatatatcgccgaggctatggcccggaaagataatggatctatggcacacttcgcgttagaaatacgaaagaaatttccaacaaacgctctgctagccgcactcattgactacatcgtttatctgcagtcacttgccgagattagtaccttcgaattggaggaagattgggaggactttaagtacaagcccgagcctacagaaagcactctgcagccacgctcccacagatctgatcagtataatttcaaaaacgctgactcgaatagcaacgtgaaggtctgcaaaaatgtgaagaaagtactctgtgtgtcccccaggtcacgggccaagtttgagaacatcatagcatgcggcgaacatgctaacccgagtgtttacatgatgcctaatatctctatttatcaaagcaactccgagcgctcacactactgtatcgccgatagccattgcctggaggaatacgagattgtcaataccgaattactgacggcgcttaagaaatctagatgctgggccaaggagatggacgacgtggtgttgcacaaacagtccgatgggctcaggagttgtcgtatcaaggacaccggaagctgcaacgtcctgggtaatgattggacaatagttctatgtgaaaacggcaattattactattctgagattcacaaagactacgataaggaccaggatgtggggcatttctgcctgagcccccggtgttcaactatccgatatccaatcaacagaaggcacattcgcaagtgcgactggcagatcagtcatagcaccattgataaaatatcggtgcaagagctcgctgacatcgaacagtacaagaaagcaatttcccagaagctgcagacatctcttagcatctttaaatatgtaaagactaagaatttgcctcacattaaacccgcctacaagtacatcaccgtcgagggaacggaaacaatagagggcatcgaaaacgctttcattgagtcagagatcccagccctggcaggtaccgcgattgggtttaaaatcaatagtcgggaaggcaactatttaatggatgtgataggatacgttaagtccgcctcttatagcgctacttacacaaaactctataccactggccccaccattgggatcaatacaagacatgacgagaagtgtacgggaccttgcccagtgaccatcgatcacaaagacggttggctgactttctccaaggaaaggacatcaacctggggctgtgaggaatttgggtgccttgccgtcagcgacggatgtgtgttcggcagttgccaagatattataaaggacgagctggcagtttaccgcaaaacaactgaggaattgaccacggtggagctctgcctgacattttctgataagacctattgtactaacctaaatgctatcaccccgattatcacagacaaattcgaagtacagttcaagactgtcgagtcctacaccctgccccgaattatcgccgtgaaaaaccacgagataaaggtgggtcagatcaacgatctcggggtctacagcaagggctgcggaaatgttcaaaaagtgaacggcacaaattatgggaacggagtacctaagtttgactacctgtgtcatcttgcatcgcggaaagaagtgattttgcgtaagtgcttcgataatgactatcaggcctgtaaatttctgcagtcaccagcttcttacagattagaggaacaccagggcacggtcaccgtgatcgattataagaagattctcggtagtatcaaaatgaaggcgatactgggggacgttaaatacaagaactatcaatccaatattgagatcaacgccgaaggaacttgcgcaggctgtgtgaattgcttcgagaacatccattgtgagtttacaattcacaccactgtcgaaacaagctgccccatcgtgaccgattgtgtttctttccatgacaggatacttattacgcctgacgagcacaaatacgctctgaagatcgtgtgccaggataagccaaaagtcagcctaaagtttaaaatttgcaatactaacatcgacgcctccatgaccatagtagattcaaagcccattctcgaactggccccggtggaccagacagcttacatcaaagagaaggatgaacgctgtaagacctggatgtgccgggttagagacgagggtttccaggtgatcttggagccttttaaaaatctgttcggcagttatattgggatcttttacactggaattttaagcgtcatatgtctcctgatcgtgatttatatcgtacttccaatctgcttcaagctgagggatacattgaaacaacacgaagacgcatacaagaaagagatgaagattcgatga

SEQ ID NO: 10968 - RNA, 4335 nt, synthetic construct
  misc_feature 1..4335: note = derived and/or modified CDS sequence (opt3) from SORV(SORV-252)__JN815081.1__GP
  source 1..4335: mol_type = other RNA
atggaggtgctgagcctcatctggcttctggccgtctgctccgctaaccccgttttccagagatgttttcaagacggcgcaattgtgaagcagaatccttctaaagaagccgtaaccgaggtgtgcttgaaggatgacgtctcaatgataaaaacagaagcgaagtacgtgaaaaacactacggggaccttcagtaataacgttgctatgaggaagtggttagtggccgattggcacgactgtcggccacagaaaagctccggaggtcatatcaatgtcattgaggtgggcgatgacctgtctctacacacagaatcgtatatctgctcagcagattgtgtaattactgttgacaaagagaccgcccagatccgcctccaaacagatagcaccaaccattttgaggtggctgggactacagtcaagagtggatggttcaaatccaccacgtacataactctggaccagacctgcgaacaccttaaggtgtcttgtggcccgaaaagcatccagtttcatgcatgcttcaatcagcacatgtcctgtgtgcgatttctgcaccgtacaattttgcccggttcaatcgccaacagtatttgccaaaatatcgagataattatcctcgtcactctgagcctgattatcttcatctttctcaccattgtttctaagacatatatatgttacttactgatgcctatcttcattccaatcgcttttatatatgggtggatttacaacaagtcctgcaaaaagtgcaaactttgtggattggtgtatcatcccttcaccgaatgcggcacgcactgtgtatgcggcgccagatacgagacttcagataggatgaagctgcatcgggcgagcgggctatgtcctggatacaaaagtctccgcgcagccagagtgatgtgcaagtctaaaggtccagcttccatcctgagcatccttacagccgtcctgattttgacctttgtgactcccatctcggcaattataatcgacgagtctaaggaaatttatacactcgatgacctgcctgacgatatggttcagatggctgagaggatcaatatctactatcagattttactgataaactacggcgtgacctgggccttcctccttctggggttgatcctagcgtatttctttaagaaataccagcacaagttcctggactattacgccatgtactgtgaagagtgcgatatgtatcacgaaaaatccggaatgacgtactggggcgactttaccaataagtgtcggcaatgcacatgtggtcagtatgaggatgcagctgggctcatggtccataaaaagtcatacaactgcctgattaagtataaagccaagtggatcaaaaatattcttatcctgtacttgataatgatcctcgtgaaggacagtctgttattcgtaggagctactggcaccgattttgccgcatgcattgacgagaaaagcgttacatggaactgtactggcccattcctgaacctagggcgctgcgataagccgcagaagaaagcctcctttaaggacatcgctaatcaactcaaaggactgggtgtgatttctgtccttgatatccccatgatagaaaagatgcctgacgacattagcggctcattgaaatatatcgatagtctgcgaacctaccacgagcagctcacagcggaatacgcattcctgaccagatattgtgactactatgcccagtacactgataactccgggtatagccagacggtgtggaggacataccttcggtctcatgactttggagcttgcgtcgtgtatccaaatcaacacttctgtcgttgcgttaagtacggcgataagtgtaactcagccaaatgggactttgcaaatgagatgaagagtttctacaccggtcagaaagccaagtttaacaaagatctgaatttggctctcctggtgttacataaggccttccgcgggactggcaccgcatatattgcggaaacactggctagaaaagacaacggaagcatggtacacttcgccctagagatcaggaagaagtttcccaccaatgcactcctggccgctcttatagattacatcgtctatttgcagtccctggccgagatttctactttcgaacctgaggaagactgggaggattcgaaataccagccagaacccacagagagcgtgctccaaccgcgggcacaccgatccgaccagtataactttaagaatgctgattcaaacagtaatgttaaagtgtgcaagaacatcaaaaaggtcctgtgtatttctcctcgcagcagagccaagttcgagaatatcatagcgtgcggcgaacatgccaacccctccgtgtacatgatgccaaacacgtcaatttatcagagcaattctgagaggtcccactactgtatcgctgacagtcattgcttagaagagtacgagatcgtaaacaccgaactgcttactgcatttaaaaagagccggtgctgggccaaagagattgacgatatcgtgttgcacaagcagtctgacgggctccgctcctgtagaattaaagatacaggatcatgcaatgttctgggtaacgactggaccatagtcctatgtgaaaatggcaactattactatagtgaggtgcacaaggattacgacaaggatcaagacgtggggcatttctgcctgagccctaggtgtaatacaatccgttatcccatttcgcggcgacacatcggagaatgcaactggcagattactcattccaccatcgataaaatatctgtccaggagctcgctgacatcgagcagtacaagaaagccattagccaaaagctgcagacgtcacttagtatctttaaatatgttaagaccaagaatttgccacacattaaacccgcatacagatacatcacagtgggcggtactgaaaccatagagggggtggaaaacgcgttcattgagtccgaaatccctgccctggctggcacagccatcggatttaagattaattctagggagggcaactatttaatggatgtaatagggtacgtcaaaagcgcatcctattcagctacttacaccaagctctatacgacaggaccaaccatcggtattaatactaaacatgacgagaagtgtacaggcagctgcccggtgaccatcaaccacaaagatgggtggctgactttcagtaaggaacgcacctctacatggggatgtgaggaatttggctgccttgccgtttccgacggttgtgtgttcgggagctgccaggacattatcaaggatgagctggcagtctaccggaaaacgaccgaagagttgactacagtggagctctgcctgaccttttcggacaagacatattgtactgatctaaatgccataacccccatcattacggacaaattcgaagttcaattcaagacagtggagtcatacaccctgcctagaatcattgctgtaaagaaccacgaaatcaggactggccagataaacgatctcggagtctactctaagggctgcgggaatgtgcagaaggtgaacggaaccagttatggcaatggtgtcccaaaatttgactacctgtgtcatcttgcgtcccgcaaggaggttattttgcgaaaatgcttcgataacgactatcaggcctgtaagtttctgcaaagccccgcatcttaccggttagaggaacaccaggggacagtgactgtaatcgattataaaaagatcctcggaagcattaagatgaaagctatgctgggcgacgtgaagtacaaaaattatcagtccaacatcgagataaatgccgaaggtacctgcgccggctgtattgattgcttcgagaacatccattgtgaatttacaattcacacgaccgtcgaggcttcatgccctatcactacagactgtgtgagtttccatgaccgtatacttattaccccagaggaacacaagtacgcactgaaaatcgtttgccaggataagcccaaggtgagcctaaaatttaagatctgcaatactaacgtcgaggcctctatgacaattatcgactccaaaccgattctcgaactggcgcctgtggatcaaaccacgtacataaaggagaaagacgaaagatgtaagacttggatgtgcagggttcgcgatgaggggttccaggtgatcttggagccatttaagaatctgttcggatcatatattggcatcttttacaccggggtcttaagtatcatttgtctcctgatagtaatctatattatccttcccatttgctacaaactgcgggacacattgaagcagcacgaagatgcttataaaaaggagatgaaaatcagatga

SEQ ID NO: 10969 - RNA, 4335 nt, synthetic construct
  misc_feature 1..4335: note = derived and/or modified CDS sequence (opt3) from SORV(NJO-94F)__KX817337.1__GP
  source 1..4335: mol_type = other RNA
atggaggtgctgagcctcatctggcttctgaccttgtgctccgcctctcccgtcttccagagatgttttcaagacggcgctattgttaagcagaacccttcaaaagaagcagtgacagaggtatgcttaaaggatgacgtgagtatgataaaaactgaaacgaagtacgtcaaaaataccacagggactttcgccaacaatatcgcgatgaggaagtggctggtggctgattggcacgactgtcggccacagaagtcctccggaggtcatattaacgttatcgaggtgggcgatgacctatctctccacaccgaatcgtatatttgctcagccgattgtgtcatcacagtggacaaagagaccgcacagatacgcctgcaaactgataatacaaaccattttgaggtagccgggaccacggttaagagcggatggttcaaaagtactacctacatcacacttgaccagacttgcgaacacctgaaggtgtcctgtggcccgaaatctattcagtttcatgcttgcttcaatcagcacatgagctgtgtccgatttttgcaccgtaccatcctccccggttccattgcaaactcaatctgccaaaatatagagattatcattctggtgacactgagtctcgtgatcttcatctttttaaccattgtcagcaagacgtatatatgttacctgcttatgcctatcttcattccaatcgcctttatatatgggtggatttacaacaagtcttgcaaaaagtgcaaattgtgtggactggtttatcatcccttcactgaatgcggcacacactgtgtgtgcggcgctagatacgagacctccgataggatgaagctacatcgggcctcagggctctgtcctggatacaaaagcctgcgcgcggcaagagtaatgtgcaagagtaaaggtccagcctctatcctttccatcctgactgctattttgatcctcacatttgtgacccccattagcgccatggtcgtgggcgagtcgaatgaaatatatacgctggacgatttacctgacgacatggttcagatggcagagaggatcaacatttactatcagatcctgatcattaattacggggtgacctgggctttcctccttctgggattggtcctagcctatttctttaagaagtaccagcacaaattcctggattattacgcgatgtactgtgaagagtgcgacatgtatcacgaaaagtctggcatgacatactggggtgattttactaacaaatgtcggcaatgcacctgtgggcagttcgaggacgccacaggactcatggtgcataagaaatcctataattgcctggtaaagtacaaggcaaaatggatacgcaacatccttattgcttatctgatgatcatgttggttaaggattcactcctgtttgtgggcgccactcgagctgacttcgccagttgcgtcgatgagaaaaccgtgacatggaactgtaccggcccatttttaaatctggggagatgcgacaagactcagaaaaagacgggatacaaggatattgcaaaccaactaaaaggtctcggcgtcatcagcatactggacatcccgatgattgaaaagatgcccgatgagatctccgggtctcttaaatatattgacagcttggaaacataccacgagcagctgaccgccgaatacgctttcctcactaggtattgtgactactatacccagtacacagataattcaggatatagtcagaccgtgtggcggacttacctgcgttcccatgactttggcgcgtgcgttgtgtatcctaaccaacacttctgtcgctgcgtaaagtacggtgataaatgtaatagcgcaaagtgggactttgccaacgagatgaagacattctacacggggagaaaagtcaagtttaataaagatcttaacctggctttgctcgtgctgcataaggccttcaggggcaccggaactgcatatatcgccgaggctatggcccggaaagacaatggctctatggcacacttcgcgttagaaatacgaaagaaatttccaacaaacgctctgctagccgcactcattgattacatcgtttatctgcagtcacttgccgagattagtaccttcgaattggaggaagactgggaggattttaagtacaagcccgagcctacagaaagcactctgcagccacgctcccacagatctgaccagtataatttcaaaaacgctgattcgaatagcaacgtgaaggtctgcaaaaatgtgaagaaagtactctgtgtgtcccccaggtcacgggccaagtttgagaacatcatagcatgcggggaacatgctaacccgagtgtttacatgatgcctaatatctctatttatcaaagcaactccgagcgctcacactactgtatcgccgacagccattgcctggaggaatacgagattgtcaataccgaattactgacggcgcttaagaaatctagatgctgggccaaggagatggatgacgtggtgttgcacaaacagtccgacggactcaggagttgtcgtatcaaggataccggtagctgcaacgtcctgggcaatgactggacaatagttctatgtgaaaacgggaattattactattctgagattcacaaagattacgacaaggatcaggacgtgggacatttctgcctgagcccccggtgttcaactatccgatatccaatcaacagaaggcacattcgcaagtgcgattggcagatcagtcatagcaccattgacaaaatatcggtgcaagagctcgctgatatcgaacagtacaagaaagcaatttcccagaagctgcagacatctcttagcatctttaaatatgtaaagactaagaatttgcctcacattaaacccgcctacaagtacatcaccgtcgagggcacggaaacaatagagggtatcgaaaacgctttcattgagtcagagatcccagccctggcagggaccgcgattggctttaaaatcaatagtcgggaaggaaactatttaatggacgtgataggctacgttaagtccgcctcttatagcgctacttacacaaaactctataccactgggcccaccattggaatcaatacaagacatgatgagaagtgtacgggtccttgcccagtgaccatcgaccacaaagatggctggctgactttctccaaggaaaggacatcaacctgggggtgtgaggaatttggatgccttgccgtcagcgacggctgtgtgttcggtagttgccaagacattataaaggatgagctggcagtttaccgcaaaacaactgaggaattgaccacggtggagctctgcctgacattttctgacaagacctattgtactaacctaaatgctatcaccccgattatcacagataaattcgaagtacagttcaagactgtcgagtcctacaccctgccccgaattatcgccgtgaaaaaccacgagataaaggtggggcagatcaacgacctcggcgtctacagcaagggatgcggcaatgttcaaaaagtgaacgggacaaattatggaaacggcgtacctaagtttgattacctgtgtcatcttgcatcgcggaaagaagtgattttgcgtaagtgcttcgacaatgattatcaggcctgtaaatttctgcagtcaccagcttcttacagattagaggaacaccagggtacggtcaccgtgatcgactataagaagattctcgggagtatcaaaatgaaggcgatactgggagatgttaaatacaagaactatcaatccaatattgagatcaacgccgaaggcacttgcgcaggttgtgtgaattgcttcgagaacatccattgtgagtttacaattcacaccactgtcgaaacaagctgccccatcgtgaccgactgtgtttctttccatgataggatacttattacgcctgacgagcacaaatacgctctgaagatcgtgtgccaggacaagccaaaagtcagcctaaagtttaaaatttgcaatactaacatcgatgcctccatgaccatagtagactcaaagcccattctcgaactggccccggtggatcagacagcttacatcaaagagaaggacgaacgctgtaagacctggatgtgccgggttagagatgagggcttccaggtgatcttggagccttttaaaaatctgttcgggagttatattggaatcttttacactggcattttaagcgtcatatgtctcctgatcgtgatttatatcgtacttccaatctgcttcaagctgagggacacattgaaacaacacgaagatgcatacaagaaagagatgaagattcgatga

SEQ ID NO: 10970 - RNA, 4323 nt, synthetic construct
  misc_feature 1..4323: note = derived and/or modified CDS sequence (opt3) from TAHV__AF123485.1__GP
  source 1..4323: mol_type = other RNA
atgatgttcgtgctgtttttcatcgccctcagcgctgcatcccccgtctaccagagatgctttcaagacggcgccattgttaagcagaacccttctaaacaggcggtgaccgaggtatgtcttaaggatgacgtgtcaatgataaaaacagaagctaggtatttccggaatgccactgggacgtacgcaaacaatgtcgccatccgcaagtggctggtgagtgattggcacgactgccgaccgaaaaaggttagcggaggtcatattaacgtgatcgaggtcggcgatgacttgaccttacacacagaggcttatgtgtgtaatgcagattgcactattggggtagacaaggagaccgcccaggttcgtctgcaaacagataccactaaccattttgaaatcgctggaacaaccgtgaaatccggctggttcaagtctacgacttacataaccctagaccagacatgtgagcacctcaaagtctcgtgcggtccaaagtcaatccagtttcatgcctgtttcaatcagcacatgagctgcgtgagatttctgcacaggactattcttcccgggagtatcgcgtcctctatttgtcaaaacgtggagatcataattctgaccgtcttgacactcctgatcttcattctgctcagcatcttatccaaaacctatatctgctacattctgatgcctatatttatcccacttgcatatatttacggagttatctacaataagtcatgtaagaaatgcaagttgtgcggcctggtgtatcatcccttcacggaatgtggcactcactgcgtatgtggggcccggtacgagacaagtgatcgcatgaaactacatagagctagcggactctgccctggttataagtctctgagggccgcacgggtgatgtgtaaatccaagggcccagcttcaatacttagcattatcaccgccgtcctgatcttgacttttgtgacacccattaacgcgatggttgccggggacacccaggaaacgttcaaactcgaggatctgcctgacgacatgttaagtatggcaatgaaggtgaatatgtactatatcatgtgcatgattaactacgctgtcacctggtctttcatactgtgtgccctccttatcgctctgttgtttaagaaatatcagcaccgcttcctaaatttttacgccatgtactgccacgagtgtgatatgtatcatgaccgatccggactgaagtacaacggcgatttcacaaataaatgcagacagtgtacttgcggtcaatatgaagacgcagccgggctcctgacccacaggaagacatacaactgccttgtgcagtataaaagcaagtggctgactaactttttgattgtatacatcatcctcatgctgattaaggattcggttttaatagtgcatgctgacggaaccgatttcgagaaatgttctggcgaagtcgacatcacatggaattgcaccggcccatttctgaacctagggaattgtgagaagaaacagaagaaagaatcctataacaatattgcgactcaactcaagggactggatgcaatctcagtgcttgacattccgatgatcagtaagatacccgaggatatcgccggtgctttgcggttcattgaggaacagcgtagctaccacgtccagctgacggccgagtacgcaatgctcacacgctattgcgactactatacccagtttactgacaactccggctactctcaaaccacatggagagtgtatctgaggagccatgatttcaaagcctgtatcctttaccctaatcagcacttttgccggtgtgttaagcacggggacaaatgctcaagttccaactgggatttcgctaatgaaatgaagaactattacagcggaaaacagtctaagtttgacaaggatctgaatttggccctcatgtcactgcatcacgcattccgaggcaccagtagcttctacattgcgaaattactgaaggagaaaaagaacgaagacctagtgacttatgctgagaaaatcaagggtaaatacccagggaatgccctcctgaaggcaataattgattatatcaagtacatggaggaccttacagaaatgaacaattttaaacatgatgagatgtgggacgatttcatttttgaagtaccccctacgaagtccccatctatccgcagattggagtcgagctatgacttcaaaaccaacgtcaactccaatccctcacacatatgtaagaacatcaaaactgtggtttgcctgagtccgaagtctggcgtgagctacgattccattatcgcctgtggagaaccttcacagcccagcatttataggaagccagactctcaagtctttcagtccaatgctgaccagacacacttctgcctcagtgatacccattgcctggagaactacgagacagtgggcgaagagatcatagacgccattaaaaagagcaaatgttgggaaactgagtttaccgagtacatccagttcaagcaatctgatggggtacggtcctgccgcatgaaagactcaggagaatgtacggtgaccacaaatagatggcctatcattttatgcgataacgacaagttttattacagtgagctgcagaaggattatgacaaagatcaggacatcggtcacttctgtcttagccccaggtgcaatactattcgtcatccaataaaccggaagcacatctcgaattgtacctggcaggtttcccataacaatattgataaaatcgaagtccacgagttggaagacctcgagcaatacaagaaagcaattacacagaagctgcagacttctctaaccctgtttaagtatagcaaaacgaagaacctcccccacatcaaacctatgtacaagtatataacaatcgagggcaccgaaactgctgaggggctggaatcagcctacattgagagtgaaatcccagcgcttgccggaacatccattggcttcaaaatcacctctaagagcggtaaacatttgctggatgtgatagggtacgtgaagtccgcttcatatagcgcagtctacactaagttatataccacaggcccgacgattggagttaataccaaacacgacgagctctgcactggcccctgtcctgtgaacgtgccacatgggacaggatggctgacctttgccaaggagcgaacaagttcttggggttgcgaagagttcggctgtcttgctatctccgacgggtgcgtattcggaagctgccaagatatcattaaagacgaaataactgtctacagaaaggagaccgaagagacgacagatgtggagctgtgtttgacctttgccgacaaaacttattgcaccaatctcaacgcaatcacacccattatcactgatcagttcgaagttcagtttaagaccgtggaggcgtactcgctgcctaggattatcgccgtccgcaaccacgaaataatggtgggccagatcaatgacattggtgtttattcaaaggggtgtggcaacgtgcaaaaagtaaataacacaaattacggaaacggcgtcccaaagttcgattacctatgccatctggcttctcggaaagaggtgatcgtgagaaagtgttttgacaatgattatcaggcctgcaaattcctccagacgcccgcaagttacaggctggaggaagaagggggatccgtcaccgttattgactataagaagatccttggcactataaaaatgaaggctattttgggtgatgtgaaatacaagacatttgccgacaacgtagacctgaccgtggaaggggtctgtactggatgcatcaattgtttcgagaacatccactgcgaattaacaattcacagcaccgtggaggcatcttgtccggttgtgagctcctgcacggtctttcatgatcgcatcctcataactcctaatgagcacaaatatgccattaaggtgatctgcaacgaaaagccaggccccaccctgcctttcaaaatttgttcagctaagacagacgcggccatgacccttgcagatgctaaacccatcctggagctagccccagttgaccagactacatacataaaggaaaaagatgagcgatgcaagacctggatgtgtcgggtgcgtgacgaaggttttcaagtcattttcgagcctttcaagaatctctttggcagttatatcgggatcttctacacatttattatcagcctgatggccattttcatagtaatctacattgtgttgcccatctgctttaaactgagagatactttaaggcagcatgaggacgcttataagcgcgaaatgaaaatccggtga

SEQ ID NO: 10971 - RNA, 4323 nt, synthetic construct
  misc_feature 1..4323: note = derived and/or modified CDS sequence (opt3) from TAHV__AF229129.1__GP
  source 1..4323: mol_type = other RNA
atgatgttcgtgctgtttttcatcgccctcagcgctgcatcccccgtctaccagagatgctttcaagacggcgccattgttaagcagaacccttctaaacaggcggtgaccgaggtatgtcttaaggatgacgtgtcaatgataaaaacagaagctaggtatttccggaatgccactgggacgtacgcaaacaatgtcgccatccgcaagtggctggtgagtgattggcacgactgccgaccgaaaaaggttagcggaggtcatattaacgtgatcgaggtcggcgatgacttgaccttacacacagaggcttatgtgtgtaatgcagattgcactattggggtagacaaggaaaccgcccaggttcgtctgcaaacagataccactaaccattttgaaatcgctggaacaaccgtgaaatccggctggttcaagtctacgacttacataaccctagaccagacatgtgagcacctcaaagtctcgtgcggtccgaagtcaatccagtttcatgcctgtttcaatcagcacatgagctgcgtgagatttctgcacaggactattcttcccgggagtatcgcgtcctctatttgtcaaaacgtggagatcataattctgaccgtcttgacactcctgatcttcattctgctcagcatcttatccaaaacctatatctgctacattctgatgcctatatttatcccacttgcatatatttacggagttatctacaataagtcatgtaagaaatgcaagttgtgcggcctggtgtatcatcccttcacggaatgtggcactcactgcgtatgtggggcccggtacgagacaagtgatcgcatgaaactacatagagctagcggactctgccctggttataagtctctgagggccgcacgggtgatgtgtaaatccaagggcccagcttcaatacttagcattatcaccgccgtcctgatcttgacttttgtgacacccattaacgcgatggttgccggggacacccaggaaacgttcaaactcgaggatctgcctgacgacatgttaagtatggcaatgaaggtgaatatgtactatatcatgtgcatgattaactacgctgtcacctggtctttcatactgtgtgccctccttatcgctctgttgtttaagaaatatcagcaccgcttcctaaatttttacgccatgtactgccacgagtgtgatatgtatcatgaccgatccggactgaagtacaacggcgatttcacaaataaatgcagacagtgtacttgcggtcaatatggggacgcagccggactcctgacccacaggaagacatacaactgccttgtgcagtataaaagcaagtggctgactaactttttgattggctacatcatcctcatgctgattaaggattcggtattactggttcatgctgacggcaccgatttcgaaaaatgttctggggaggcggacataacatggaattgcaccggaccatttctatccctcggtaactgtgaaaagaaacagaagaaagagtcatataataacatcgcaactcaactgaagggccttgatgccattagtgtgttggacatcccgatgattagcaagatccccgaagatatagctggggccctgcggttcatcgaggagcagcgttcctaccacgtccagctcacggcagaatacgccatgctgacacgctattgcgactactatacccagtttactgacaattctggatacagccaaaccacatggagagtgtatcttaggtcacatgatttcgaggcttgtattctgtaccctaaccggcacttttgccgatgtgtcaaacacggcgacaagtgcagttccagcaattgggatttcgccaacgaaatgaaaaattattactctggtaagcagtcaaaatttaacaaggacttgaatctcgcactgatgagtttacatcacgcgttccgcgggaccagctccttctacatcgctaagctgctaaaagagaagaaaaacgaagatctcgtgacttatgccgagaagattaaaggcaagtacccaggaaatgcactgcttaaagccatcatagactatattaagtacatgaagggcttgacagagatgaacaattttaaacatgatgaaatgtgggacgatttcatctttgaggttccccctacgaagtctccatcggtgagaaggctggaaagctcctatgacttcaaaaccaacgtaaactcaaatcccagtcacatttgtaagaacatcaaaactgtcgtgtgcctctctccaaagagcggggtttcctacgattcaataatcgcttgtggagagcctagccagccctctatttatcggaagccagactcccaggtgtttcaaagtaatgccgatcagacacacttctgcctgagcgacacccattgcttagaaaactacgagacagtcggtgaggaaatcattgacgcaatcaaaaagtctaaatgttgggagactgaatttaccgagtacacgcagctgaagcagtccgatggcgtgcgctcatgcagaatgaaagacagtggggagtgtaccgtaacaactaataggtggcctataattctttgcgataacgacaagttctattacagcgaattgcaaaaggattatgacaaagatcaggacatcggacacttttgtctctcgccccgttgcaataccatccggcatccaattaaccgaaagcacatctccaattgtacatggcaagtgaaccataataacattgataaaatagaggttcacgaactggaggacctagaacagtacaagaaagctatcactcaaaagctgcagacctctctcacgctgttcaagtatagcaaaacaaagaatcttccccacattaaacctatgtacaagtatatcaccattgagggcactgagacagccgaaggtatcgagtcagcgtacatagaaagtgagatcccagccttggctgggacctccattggctttaaaatcacttctaagagcggaaaacatctgttagatgtcattggctacgtgaagtccgcatcatatagcgccgtgtacaccaagctctatacaacggggccgaccatcggagtcaacactaaacacgacgaactgtgcacaggtccctgtcctgttaatgtgccacatggcaccgggtggcttacattcgctaaggagagaaccagttcttggggatgcgaggaatttggctgtctggccatatccgatggttgcgtgttcgggagctgccaggacattatcaaagacgagatcactgtatacaggaaggaaacggaggaaacaaccgatgtcgagttgtgtctcactttcgcagacaaaacctattgcacaaacctgaacgcgattactcccataatcaccgatcaatttgaggtgcagttcaagacagttgaagcctactcgctacctcgcattatcgctgtgcggaatcacgagattatggtcggccagatcaacgacataggagtgtattcaaagggctgtgggaatgttcagaaagtgaacaatacgaactacggaaatggcgccccaaagtttgattacctgtgccatctcgcatctagaaaagaagtaatcgtcaggaagtgtttcgacaacgattatcaggcttgcaaatttctgcagacccccgccagttaccgccttgaggaggaaggtgggtccgtgactgtgattgactataagaagatcttgggaacaattaaaatgaaggcaatcctgggcgatgtcaaatacaagaccttcgccgacaatgttgatttaactgtggagggtgtatgtacaggctgcgtgaactgttttgaaaatatacactgcgagagcaccattcactctacggtcgaagctagctgtccggtgatctcctcatgcactgttttccatgaccgaatcctcattacccctaacgagcacaaatatgcgatcaaggtgatatgcaatgagaagccagggcccacactgccttttaaaatttgtagtgccaagaccgacgcagctatgactcttgccgatgccaaacccatcctggaactagctccagtcgaccagacaacctacattaaggagaaagtggaacggtgcaagacatggatgtgtcgtgttagagatgagggattccaggtgatctttgaacctttcaagaacctcttcggcagctatatagggatcttttacactttcattatctctctgatggcaatttttatcgtcatttacatagtattgcccatctgcttcaaactgagggacaccttacgccaacatgaggatgcctataagcgggagatgaaaattagatga

SEQ ID NO: 10972 - RNA, 4323 nt, synthetic construct
  misc_feature 1..4323: note = derived and/or modified CDS sequence (opt3) from TAHV(22595-6)__HM036218.1__GP
  source 1..4323: mol_type = other RNA
atgatgttcgtgctgtttttcatcgccctcagcgctgcatcccccgtctaccagagatgctttcaagacggcgccattgttaagcagaacccttctaaacaggcggtgaccgaggtatgtcttaaggatgacgtgtcaatgataaaaacagaagctaggtatttccggaatgccactgggacgtacgcaaacaatgtcgccatccgcaagtggctggtgagtgattggcacgactgccgaccgaaaaaggttagcggaggtcatattaacgtgatcgaggtcggcgatgacttgaccttacacacagaggcttatgtgtgtaatgcagattgcactattggggtagacaaggaaaccgcccaggttcgtctgcaaacagataccactaaccattttgaaatcgctggaacaaccgtgaaatccggctggttcaagtctacgacttacataaccctagaccagacatgtgagcacctcaaagtctcgtgcggtccaaagtcaatccagtttcatgcctgtttcaatcagcacatgagctgcgtgagatttctgcacaggactattcttcccgggagtatcgcgtcctctatttgtcaaaacgtggagatcataattctgaccgtcttgacactcctgatcttcattctgctcagcatcttatccaaaacctatatctgctacattctgatgcctatatttatcccacttgcatatatttacggagttatctacaataagtcatgtaagaaatgcaagttgtgcggcctggtgtatcatcccttcacggaatgtggcactcactgcgtatgtggggcccggtacgagacaagtgatcgcatgaaactacatagagctagcggactctgccctggttataagtctctgagggccgcacgggtgatgtgtaaatccaagggcccagcttcaatacttagcattatcaccgccgtcctgatcttgacttttgtgacacccattaacgcgatggttgccggggacacccaggaaacgttcaaactcgaggatctgcctgacgacatgttaagtatggcaatgaaggtgaatatgtactatatcatgtgcatgattaactacgctgtcacctggtctttcatactgtgtgccctccttatcgctctgttgtttaagaaatatcagcaccgcttcctaaatttttacgccatgtactgccacgagtgtgatatgtatcatgaccgatccggactgaagtacaacggcgatttcacaaataaatgcagacagtgtacttgcggtcaatatgaagacgcagccgggctcctgacccacaggaagacatacaactgccttgtgcagtataaaagcaagtggctgactaactttttgattgtatacatcatcctcatgctgattaaggattcggttttaatagtgcatgctgacggaaccgatttcgagaaatgttctggcgaagcggacatcacatggaattgcaccggcccatttctgaacctagggaattgtgagaagaaacagaagaaagaatcctataacaatattgcaactcaactcaagggactggatgccatctcagtccttgacattccgatgatcagtaagatacccgaggatatcgctggtgccttgcggttcattgaggaacagcgtagctaccacgtgcagctgacggcagagtacgccatgctcacacgctattgcgactactatacccagtttactgacaactccggctactctcaaaccacactgagagtctatcttaggagccatgatttcaaggcttgtatcctgtaccctaatcagcacttttgccggtgtgtgaaacacggggacaaatgctcaagttccaactgggatttcgccaatgaaatgaagaactattacagcggaaaacagtctaagtttgacaaggatttgaatctcgcactgatgtcattacatcacgcgttccgaggcaccagtagcttctacattgctaaactgctaaaggagaaaaagaacgaagacctcgttacttatgccgagaaaatcaagggtaaatacccagggaatgcactgcttaaggccataattgattatatcaagtacatggaggacttgacagaaatgaacaattttaaacatgatgagatgtgggacgatttcatttttgaagtgccccctacgaagtccccatctatccgcagactggagtcgagctatgacttcaaaaccaacgtaaactccaatccctcacacatatgtaagaacatcaaaactgtcgtgtgcctcagtccgaagtctggcgttagctacgattccattatcgcttgtggagaaccttcacagcccagcatttataggaagccagactctcaagtgtttcagtccaatgccgaccagacacacttctgcctgagtgatacccattgcttagagaactacgagacagtcggcgaagagatcatagacgcaattaaaaagagcgaatgttgggagactgagtttaccgaatacatccagttcaaacaatctgatggggtgcggtcctgccgcatgaaggactcaggagagtgtacggtaaccacaaatagatggcctatcattctgtgcgataacgacaaattttattacagtgaacttcagaaggattatgacaaggatcaggacatcggtcacttctgtttgagccccaggtgcaatactattcgtcatccaataaaccggaaacacatctcgaattgtacctggcaagtgtcccataacaatattgataagatcgaggttcacgaactcgaggacctggagcagtacaaaaaggctattacacagaaactacagacttctctgaccctctttaagtatagcaagacgaaaaacctgccccacatcaagcctatgtacaaatatataacaatcgaaggcaccgagactgccgaagggattgagtcagcgtacatcgaaagtgagattccagcccttgctggaacatccatcggcttcaagataacctctaaaagcggtaagcatttgctggatgtcattgggtacgtgaaatccgcatcatatagcgccgtgtacactaagttatataccacaggcccgacgatcggagtcaataccaagcacgacgagctctgcactggcccctgtcctgttaacgtgccacatgggacaggatggctgacctttgctaaagaacgaacaagttcttggggttgcgaggagttcggctgtcttgccatctccgacgggtgcgtgttcggaagctgccaagatattataaaggacgaaatcactgtatacagaaaagaaaccgaggagacgacagatgtcgaactgtgtttgacctttgcagacaagacttattgcaccaatctcaacgcgattacacccatcattactgatcagttcgaggtgcagtttaaaaccgttgaagcctactcgctgcctaggatcatagctgtgcgcaaccacgagatcatggtcggccagattaatgacatcggtgtgtattcaaaggggtgtggcaacgttcaaaaggtgaataacacaaattacggaaacggcgtaccaaaattcgattacctatgccatctggcctctcggaaggaggtcattgtgagaaaatgttttgacaatgattatcaggcatgcaagttcctccagacgcccgctagttacaggctggaagaggaagggggatccgtgaccgtcatcgactataaaaagatacttggcactattaagatgaaagccatcttgggtgatgttaagtacaaaacatttgcagacaacgtggacctgaccgtagagggggtgtgtactggatgcatcaattgtttcgaaaacattcactgcgagttaacaatccacagcaccgtcgaggcctcttgtccggtggttagctcctgcacggtgtttcatgatcgcatactcattactcctaatgaacacaagtatgctatcaaagtcatttgcaacgagaagccaggccccaccctgcctttcaagatctgttcagcgaaaacagacgccgcaatgacccttgctgatgccaagcccatactggaactagccccagtggaccagactacatacattaaagagaaggatgaacgatgcaaaacctggatgtgtcgggttcgtgacgagggttttcaagtgatcttcgagcctttcaagaatctctttggcagttatatcgggattttctacacatttatcattagcctgatggctatattcatcgtcatttacatcgtattgcccatctgctttaagctgagagatactttaaggcagcatgaagacgcatataaacgcgagatgaagattcggtga

SEQ ID NO: 10973 - RNA, 4323 nt, synthetic construct
  misc_feature 1..4323: note = derived and/or modified CDS sequence (opt3) from TAHV(92' Bardos)__HM036209.1__GP
  source 1..4323: mol_type = other RNA
atgatgttcgtgctgtttttcatcgccctcagcgctgcatcccccgtctaccagagatgctttcaagacggcgccattgttaagcagaacccttctaaacaggcggtgaccgaggtatgtcttaaggatgacgtgtcaatgataaaaacagaagctaggtatttccggaatgccactgggacgtacgcaaacaatgtcgccatccgcaagtggctggtgagtgattggcacgactgccgaccgaaaaaggttagcggaggtcatattaacgtgatcgaggtcggcgatgacttgaccttacacacagaggcttatgtgtgtaatgcagattgcactattggggtagacaaggagaccgcccaggttcgtctgcaaacagataccactaaccattttgaaatcgctggaacaaccgtgaaatccggctggttcaagtctacgacttacataaccctagaccagacatgtgagcacctcaaagtctcgtgcggtccaaagtcaatccagtttcatgcctgtttcaatcagcacatgagctgcgtgagatttctgcacaggactattcttcccgggagtatcgcgtcctctatttgtcaaaacgtggagatcataattctgaccgtcttgacactcctgatcttcattctgctcagcatcttatccaaaacctatatctgctacattctgatgcctatatttatcccacttgcatatatttacggagttatctacaataagtcatgtaagaaatgcaagttgtgcggcctggtgtatcatcccttcacggaatgtggcactcactgcgtatgtggggcccggtacgagacaagtgatcgcatgaaactacatagagctagcggactctgccctggttataagtctctgagggccgcacgggtgatgtgtaaatccaagggcccagcttcaatacttagcattatcaccgccgtcctgatcttgacttttgtgacacccattaacgcgatggttgccggggacacccaggaaacgttcaaactcgaggatctgcctgacaatatgttaagtatggcaatgaaggtgaacatgtactatatcatgtgcatgattaattacgctgtcacctggtctttcatactgtgtgccctccttatcgctctgttgtttaagaaatatcagcaccgcttcctaaacttttacgccatgtactgccacgagtgtgacatgtatcatgatcgatccggactgaagtacaatgaagacttcacaaacaaatgcagacagtgtacttgcggccaatatgaggatgcagccggtctcctgacccacaggaagacatacaactgccttgtgcagtataaaagcaagtggctgactaatttcttgattgtatacatcatcctcatgctgattaaggactcggttttaatagtgcatgctgatgggaccgacttcgaaaaatgttctggagaggcggatatcacatggaactgcaccggcccatttctgaatctaggcaactgtgaaaagaaacagaagaaagagtcctataataacattgcaactcaactcaaggggctggacgccatctcagtccttgatattagtatgatcagcaagataccggaggacatcgctggagccttgcggttcattgaagaacagcgttcctaccacgtgcagctgacggcagaatacgccatgctcacacgctattgcgattactatacccagtttactgacaattctggttacagccaaaccacatggagagtctatctgaggtcacatgacttcgaggcttgtatcctttaccccaaccagcacttttgccggtgtgtgaaacacggcgataagtgcagttccagcaattgggacttcgccaacgaaatgaaaaatttttattctgggaagcagtcaaaattcgataaggacctgaacttggcactcatgagtctgcatcacgcgttccgaggaaccagctccttttacattgctaagttactgaaagagaagaaaaatgaggatctagttacttacgccgaaaagatcaaaggcaagtatcctggtaacgcactcctgaaagccataattgactacatcaagtatatggaggatcttacagaaatgaataacttcaagtacgacgagatgtgggatgactttattttcgaagtgccacccacgaaatctccttcgatccgcagattggagagctcctatgattttaagaccaacgtaaattcaaacccaagtcatatatgtaaaaatatcaagactgtcgtgtgcctgtctcccaaaagcggggtttcctacgactcaattatcgcttgtggcgagccgagccagccttctatttataggaagcccgattcccaagtgttccagagtaacgccgaccagacacacttttgcctcagcgacacccactgcctggaaaattacgagacagtcggagaagagatcatagatgcaattaagaaatctaagtgttgggagactgaatttaccgagtacatccagtttaaacaatccgacggcgtgcggtcatgccgcatgaaggatagtggggaatgtacggtaaccacaaacagatggccaatcattttatgcgacaatgataaattctattacagcgagctgcagaaggactatgataaggaccaggatatcggacatttttgtctttcgcctaggtgcaacactattcgtcaccccataaatcggaaacatatctccaactgtacctggcaagtgtctcacaataacattgacaagatcgaagttcatgagttggaggatctcgaacagtacaaaaaggctattacacagaaactgcagactagcctaaccctgttcaagtattcaaagacgaaaaatctcccacacatcaagcccatgtacaaatatataacaatcgagggtaccgaaactgccgagggcattgaaagtgcgtacatcgagtccgagattcctgccctggctgggacatctatcggatttaagataaccagcaaatccggcaagcaccttttggacgtcattggttacgtgaaatcagcaagctatagtgccgtgtacactaagctgtataccacagggccaacgatcggcgtcaacaccaagcatgatgaattatgcactggaccgtgtcccgttaatgtgcctcacggcacagggtggctcaccttcgctaaagagcgaacatcttcctggggatgcgaagagttcggttgtctggccatcagcgacggctgcgtgtttgggtcgtgccaagacattataaaggatgaaatcactgtatacagaaaagagaccgaggaaacgacagacgtcgagctttgtctgaccttcgcagataagacttattgcaccaacttgaacgcgattacaccaatcattactgaccagtttgaagtgcagttcaaaaccgttgaggcctactcactccccaggatcatagctgtgcgcaatcatgagatcatggtcggacagattaacgatatcggcgtgtattctaagggttgtgggaatgttcaaaaggtgaacaatacaaactacggcaatggagtacctaaatttgactacctgtgccacctagccagtcggaaggaagtcattgtgagaaaatgtttcgataacgactatcaggcatgcaagtttctgcagacgccagcttcctacaggctcgaggaagagggcgggagcgtgaccgtcatcgattataaaaagatactgggaactattaagatgaaagccatccttggcgacgttaagtacaaaacattcgcagataatgtggacttgaccgtagaaggtgtgtgtactgggtgcatcaactgttttgagaatattcattgcgagctgacaatccactctaccgtcgaagccagctgtcccgtggtttcctcatgcacggtgttccacgaccgcatattaattactccgaacgagcataagtatgctatcaaagtcatttgcaatgaaaagcctggaccaaccctcccctttaagatctgtagtgcgaaaacagatgccgcaatgaccctggctgacgccaagcctatacttgagctggcccccgtggatcagactacatacattaaagaaaaggacgagcgatgcaaaacctggatgtgtcgggttcgtgatgagggcttccaagtgatcttcgaaccatttaagaacctattcggtagctatatcggcatcttttacacattcattatttctctcatggctatatttatcgtcatttacatcgtactgcctatctgcttcaagttgagagacactctgaggcagcacgaggatgcatataaacgcgaaatgaagattcggtga

SEQ ID NO: 10974 - RNA, 4323 nt, synthetic construct
  misc_feature 1..4323: note = derived and/or modified CDS sequence (opt3) from TAHV(92' Bardos)__HM036212.1__GP
  source 1..4323: mol_type = other RNA
atgatgttcgtgctgtttttcatcgccctcagcgctgcatcccccgtctaccagagatgctttcaagacggcgccattgttaagcagaacccttctaaacaggcggtgaccgaggtatgtcttaaggatgacgtgtcaatgataaaaacagaagctaggtatttccggaatgccactgggacgtacgcaaacaatgtcgccatccgcaagtggctggtgagtgattggcacgactgccgaccgaaaaaggttagcggaggtcatattaacgtgatcgaggtcggcgatgacttgaccttacacacagaggcttatgtgtgtaatgcagattgcactattggggtagacaaggagaccgcccaggttcgtctgcaaacagataccactaaccattttgaaatcgctggaacaaccgtgaaatccggctggttcaagtctacgacttacataaccctagaccagacatgtgagcacctcaaagtctcgtgcggtccaaagtcaatccagtttcatgcctgtttcaatcagcacatgagctgcgtgagatttctgcacaggactattcttcccgggagtatcgcgtcctctatttgtcaaaacgtggagatcataattctgaccgtcttgacactcctgatcttcattctgctcagcatcttatccaaaacctatatctgctacattctgatgcctatatttatcccacttgcatatatttacggagttatctacaataagtcatgtaagaaatgcaagttgtgcggcctggtgtatcatcccttcacggaatgtggcactcactgcgtatgtggggcccggtacgagacaagtgatcgcatgaaactacatagagctagcggactctgccctggttataagtctctgagggccgcacgggtgatgtgtaaatccaagggcccagcttcaatacttagcattatcaccgccgtcctgatcttgacttttgtgacacccattaacgcgatggttgccggggacacccaggaaacgatcaaactcgaggatctgcctgacgacatgttaagtaccgcaatgaaggtgaatatgtactatattatgtgcatgataaactacgctgtcacatggtctttcatcctgtgtgccctccttattgctctgttgttcaagaaatatcagcaccgctttctaaatttctacgccatgtactgccacgagtgtgatatgtatcatgaccgatccggactgaagtacaacgaagattttactaataaatgcagacagtgtacctgcggccaatatgaggacgcagccggtctcctgacacacaggaagacttacaactgccttgtgcagtataaaagcaagtggctgaccaacttcttgatcgtatacatcattctcatgctgataaaggattcggttttaatcgtgcatgctgacgggacagattttgaaaaatgttctggagaggcggacattacctggaattgcactggcccattcctgaacctaggcaattgtgaaaagaaacagaagaaagagtcctataacaatatcgcaacgcaactcaaggggctggatgccatttcagtccttgacatcagtatgataagcaagatcccggaggatattgctggagccttgcggtttatcgaagaacagcgttcctaccacgtgcagctgacagcagaatacgccatgctcacccgctattgcgactactatactcagttcaccgacaactctggttacagccaaacaacctggagagtctatctgaggtcacatgattttaaggcttgtattctttaccccaatcagcacttctgccggtgtgtgaaacacggcgacaaatgcagttccagcaactgggattctgccaatgagatgaagaacttttattcagggaatcagagtaaattcgacaaggatctgaacttggcactcatgagcctgcatcacgcgtttcgaggaacttcctctttctacatcgctaagttactgaaagaaaagaaaaatgaggacctagttacatacgccgagaagataaaaggcaagtatcctggtaacgcactcctgaaagccattatcgattacattaagtatatggaagaccttacggagatgaataacttcaagtacgatgaaatgtgggacgattttatcttcgaggtgccacccaccaaatcgcctagcatacgcagattggaatcctcatatgactttaagactaacgtaaatagtaacccatctcatatctgtaaaaatattaagacagtcgtgtgcctgagccccaaatccggggtttcatacgatagcatcattgcttgtggcgagccgtctcagccttccatctataggaagcccgacagtcaagtgttccagagcaacgccgaccagacccacttttgcctctctgatacacactgcctggagaattacgaaactgtcggagaggaaataattgacgcaatcaagaaatccaagtgttgggagaccgagttcacggaatacatccagtttaaacaatcagatggcgtgcggagttgccgcatgaaggacagcggggagtgtaccgtaacaactaacagatggccaattatcttatgcgataatgacaaattctattactcggaactgcagaaggattatgacaaggatcaggacattggacatttttgtctttcccctaggtgcaacaccatacgtcaccccatcaatcggaaacatatttctaactgtacatggcaagtgagccacaataacatcgataagattgaggttcatgaattggaggacctcgagcagtacaaaaaggctatcactcagaaactgcagacctcactaacgctgttcaagtatagtaagaccaaaaatctcccacacataaagcccatgtacaaatatatcacaattgaaggtactgagacagccgaaggcatcgagtccgcgtacattgaatctgagatccctgccctggctgggaccagcataggatttaagattacttccaaatcaggcaagcaccttttggatgtcatcggttacgtgaaaagcgcaagttattctgccgtgtacaccaagctgtatacaacggggccaaccatcggcgtcaacactaagcatgacgagttatgcacaggaccgtgtcccgttaatgtgcctcacggcaccgggtggctcacattcgctaaagaacgaacttccagctggggatgcgaggaatttggttgtctggccatttcggacggctgcgtgttcgggtcatgccaagatataatcaaggacgagattaccgtatacagaaaagaaacggaggagacaaccgatgtcgaactttgtctgactttcgcagacaagacctattgcacaaacttgaacgcgatcactccaattatcaccgatcagtttgaggtgcagttcaaaacagttgaagcctactctctccccaggataatcgctgtgcgcaatcatgagattatggtcggacagatcaacgacattggcgtgtatagtaagggttgtgggaatgttcaaaaggtgaacaatacgaactacggcaatggagtacctaaatttgattacctgtgccacctagcctcccggaaggaggtcatcgtgagaaaatgtttcgacaacgattatcaggcatgcaagtttctgcagaccccagctagctacaggctcgaagaggaaggcgggtctgtgactgtcatagactataaaaagattctgggaacaatcaagatgaaagccatccttggcgatgttaagtacaaaaccttcgcagacaatgtggacttgactgtagagggtgtgtgtacagggtgcattaactgttttgaaaatatccattgcgagctgaccatacacagcacggtcgaggcctcctgtcccgtggtttcaagttgcactgtgttccacgatcgcattttaatcaccccgaacgaacataagtatgctattaaagtcatctgcaatgagaagcctggaccaacactcccctttaagatatgtagcgcgaaaaccgacgccgcaatgactctggctgatgccaagcctattcttgaactggcccccgtggaccagacaacctacatcaaagagaaggatgaacgatgcaaaacatggatgtgtcgggttcgtgacgagggcttccaagtgatctttgagccattcaagaacctattcggttcttatattggcatcttttacactttcattatatccctcatggctatctttattgtcatctacatcgtactgcctatttgcttcaagttgagagataccctgaggcagcacgaagacgcatataaacgcgagatgaagatacggtga

SEQ ID NO: 10975 - RNA, 4323 nt, synthetic construct
  misc_feature 1..4323: note = derived and/or modified CDS sequence (opt3) from TAHV(Souche D C14019-29)__HM036215.1__GP
  source 1..4323: mol_type = other RNA
atgatgttcgtgctgtttttcatcgccctcagcgctgcatcccccgtctaccagagatgctttcaagacggcgccattgttaagcagaacccttctaaacaggcggtgaccgaggtatgtcttaaggatgacgtgtcaatgataaaaacagaagctaggtatttcaagaatgccactgggacgtacgcaaacaatgtcgccatccggaaatggctggtgagtgattggcacgactgccgcccaaagaaggttagcggaggtcatattaacgtgatcgaggtcggcgatgacttgaccttacacacagaggcttatgtgtgtaatgcagattgcactattggggtagacaaagagaccgcccaggttcgactgcaaacagataccactaaccattttgaaatcgctggaacaaccgtgaagtccggctggttcaaatctacgacttacataaccctagaccagacatgtgagcacctcaaggtctcgtgcggtccgaaatcaatccagtttcatgcctgtttcaatcagcacatgagctgcgtgcgttttctgcacagaactattcttcccgggagtatcgcgtcctctatttgtcaaaacgtggagatcataattctgaccgtcttgacactcctgatcttcattctgctcagcatcttatccaagacctatatctgctacattctgatgcctatatttatcccacttgcatatatttacggagttatctacaataagtcatgtaaaaagtgcaaattgtgcggcctggtgtatcatcccttcacggaatgtggcactcactgcgtatgtggggccaggtacgagacaagtgatcggatgaagctacatcgcgctagcggactctgccctggttataaatctctgagagccgcaagggtgatgtgtaagtccaaaggcccagcttcaatacttagcattatcaccgccgtcctgatcttgacttttgtgacacccattaacgcgatggttgccggggacacccaggaaacgttcaagctcgaggatctgcctgacgacatgttaagtatggcaatgaaggtgaatatgtactatatcatgtgcatgattaactacgctgtcacctggtctttcatactgtgtgccctccttatcgctctgttgtttaaaaagtatcagcaccggttcctaaatttttacgccatgtactgccacgagtgtgatatgtatcatgaccgctccggactgaaatacaacggcgatttcacaaataagtgccgacagtgtacttgcggtcaatatgaagacgcagccgggctcctgacccacagaaaaacatacaactgccttgtgcagtataagagcaagtggctgactaactttttgattgtatacatcatcctcatgctgattgaggattcggttttaatagtgcatgctgacggaaccgatttcgaaaaatgttctggcgaggcggacatcacatggaattgcaccggcccatttctgaacctagggaattgtgaaaagaaacagaagaaagagtcctataacaatattgcaactcaactcaagggactggatgccatctcagtccttgacattccgatgatcagtaagatacccgaggatatcgctggtgccttgaggttcattgaagaacagcggagctaccacgtgcagctgacggcagaatacgccatgctcacacgttattgcgactactatacccagtttactgacaactccggctactctcaaaccacatggcgcgtctatctgagaagccatgatttcgaggcttgtatcctttaccctaataggcacttttgccggtgtgtgaaacacggggacaagtgctcaagttccaactgggatttcgccaatgaaatgaaaaactattacagcggaaagcagtctaaatttaataaggacctgaacttggcactcatgtcactgcatcacgcgttccgaggcaccagtagcttctacattgctaagttactgaaagagaagaaaaatgaggatctagttacttatgccgaaaagatcaaaggtaagtacccagggaacgcactcctgaaagccataattgactatatcaagtacatgaaggatcttacagagatgaataactttaaacatgacgaaatgtgggaggatttcatttttgaagtgccccctacgaagtccccatctgtacgcagattggagtcgagctatgacttcaaaaccaacgtcaattccaacccctcacacatctgtaagaatataaaaactgtggtttgcctgagtccgaagtctggcgtgagctacgattccatcattgcttgtggagagccttcacagcccagcatctataggaagccagactctcaggtctttcaatccaacgccgatcagacacacttctgcctcagtgacacccattgcctggaaaattacgagacagtgggcgaagagattatcgacgcaattaaaaagagcaaatgttgggagactgaatttaccgagtacatacagttcaagcagtctgatggggtacggtcctgccgcatgaaagactcaggagaatgtacggtggctaccaacagatggcctatcatcttatgcgataataacaagttttattacagtgagctgcaagaagactatgataaggaccaggatattggtcacttctgtcttagccccaggtgcaatacaatccgtcatccaattaaccggaaacacatatcgaattgtacttggcaggtttcccataacaatatcgacaagattgaggtccacgagttggaagatctcgagcagtacaaaaaggccatcacccaaaaactgcagacatctctaactctgtttaagtatagcaagaccaaaaacctcccccacattaagcctatgtacaaatatatcacgatagaaggcacagagaccgcggaagggatcgagtcagcctacattgagagtgaaatcccagctctggcaggaacttccattggcttcaagatcacatctaaaagcggtaagcatcttttggacgtgatagggtacgtgaaatccgcctcatatagcgctgtctacaccaagctgtatactaccggcccgacaattggagttaatacgaagcacgatgagttatgcaccggcccctgtcctgtgaacgtgccacatgggactggatggctcacatttgccaaagaacgaaccagttcttggggttgcgaggagttcggctgtctggcaatctccgacgggtgcgtattcggaagctgccaggatatcattaaggacgaaataacagtctacagaaaagagactgaagagaccacggacgtggaactttgtctgacatttgcggataagacctattgcactaacttgaatgccatcacccccattatcacagaccaattcgaggttcagtttaaaactgtggaggcttactcgctccctaggattatcgccgtccgcaaccacgaaataatggtgggccagatcaatgatattggtgtttattcaaaggggtgtggcaacgtgcagaaggtaaataacaccaattacggaaacggcgtcccaaaattcgactacctgtgccatctagcatctcggaaggaggtgatcgtgagaaaatgttttgataatgactatcaggcttgcaagttcctgcaaacacccgccagttacaggctcgaagaggaagggggatccgtcacggttattgattataaaaagatcctgggcaccataaagatgaaagcaattcttggtgacgtgaagtacaaaacttttgccgataacgtagacttgacagtggagggggtctgtaccggatgcatcaattgtttcgagaacatccactgcgaactgactattcacagcacagtggaggcttcttgtccggttgtgagctcctgcaccgtctttcatgatcgcatcttaataacgcctaatgaacacaagtatgcgattaaagtgatctgcaacgagaagccaggccccattctccctttcaagatctgttcagccaaaactgacgcagctatgaccctggccgacgccaagcccatacttgaactggctccagttgatcagacaacctacattaaagagaaggacgagcgatgcaaaacttggatgtgtcgggtgcgtgatgaaggttttcaggtcatcttcgagcctttcaagaatctatttggcagttatatcgggattttctacacatttatcattagcctcatggcaatattcatcgtaatttacatcgtgctgcccatctgctttaagattagagacaccttgaggcaacatgaagatgcctataaacgcgagatgaagatacggtga

SEQ ID NO: 10976 - RNA, 4323 nt, synthetic construct
  misc_feature 1..4323: note = derived and/or modified CDS sequence (opt3) from TAHV(1014)__GQ386833.1__GP
  source 1..4323: mol_type = other RNA
atgatgttcgtgctgtttttcatcgccctcagcgctgcatcccccgtctaccagagatgctttcaagacggcgccattgttaagcagaacccttctaaacaggcggtgaccgaggtatgtcttaaggatgacgtgtcaatgataaaaacagaagctaggtatttccggaatgccactgggacgtacgcaaacaatgtcgccatccgcaagtggctggtgagtgattggcacgactgccgaccgaaaaaggttagcggaggtcatattaacgtgatcgaggtcggcgatgacttgaccttacacacagaggcttatgtgtgtaatgcagattgcactattggggtagacaaggaaaccgcccaggttcgtctgcaaacagataccactaaccattttgaaatcgctggaacaaccgtgaaatccggctggttcaagtctacgacttacataaccctagaccagacatgtgagcacctcaaagtctcgtgcggtccgaagtcaatccagtttcatgcctgtttcaatcagcacatgagctgcgtgagatttctgcacaggactattcttcccgggagtatcgcgtcctctatttgtcaaaacgtggagatcataattctgaccgtcttgacactcctgatcttcattctgctcagcatcttatccaaaacctatatctgctacattctgatgcctatatttatcccacttgcatatatttacggagttatctacaataagtcatgtaagaaatgcaagttgtgcggcctggtgtatcatcccttcacggaatgtggcactcactgcgtatgtggggcccggtacgagacaagtgatcgcatgaaactacatagagctagcggactctgccctggttataagtctctgagggccgcacgggtgatgtgtaaatccaagggcccagcttcaatacttagcattatcaccgccgtcctgatcttgacttttgtgacacccattaacgcgatggttgccggggacacccaggaaacgttcaaactcgaggatctgcctgacgacatgttaagtatggcaatgaaggtgaatatgtactatatcatgtgcatgattaactacgctgtcacctggtctttcatactgtgtgccctccttatcgctctgttgtttaagaaatatcagcaccgcttcctaaatttttacgccatgtactgccacgagtgtgatatgtatcatgaccgatccggactgaagtacaacggcgatttcacaaataaatgcagacagtgtacttgcggtaagtatgaagacgcagccgggctcctgacccacaggaaaacatacaactgccttgtgcaatataagagcaagtggctgactaactttttgattgtatacatcatcctcatgctgattaaagattcggttttaatagtgcatgctgacggaaccgatttcgagaagtgttctggcgaagcggacatcacatggaattgcaccggcccatttctgaacctagggaattgtgagaaaaagcagaaaaaggaatcctataacaatattgcaactcagctcaagggactggatgccatctcagtccttgacattccgatgatcagtaaaatacccgaggatatcgctggtgccttgcggttcattgaggaacaacgtagctaccacgtgcagctgacggcagagtacgccatgctcacacgctattgcgactactatacccagtttactgacaactccggctactctcagaccacatggagagtctatctgaggagccatgatttcgaggcttgtatcctttaccctaatcaacacttttgccggtgtgtgaagcacggggacaaatgctcaagttccaactgggatttcgccaatgaaatgaagaactattacagcggaaaacagtctaagtttgacaaggatctgaatttggcactcatgtcactgcatcacgcgttccgaggcaccagtagcttctacattgctaaattactgcgcgaaaagaaaaacgaggacctagttacttatgtggagaagatcaaaggtaagtacccagggaatgccctcctgaaagcaataattgattatatcaagtacatgaagggccttacagaaatgaacaattccaaacatgacgagatgtgggatgactttattttcgaagtaccccctacgaagtctccatcggtcagaaggttggagagctcctatgattttaaaaccaacgtgaactcaaatcccagtcacatctgtaagaacataaaaactgttgtgtgcctgtctccaaagagcggagtctcctacgactcaatcattgcctgtggcgaacctagccagccctctatctatcggaagccagattcccaggtgttccaaagtaatgctgaccagacacacttttgcctcagcgacacccattgcctggagaacttcgagacagtaggggaagagattatcgatgccattaaaaagtctaaatgttgggaaactgagtttaccgagtacattcagttcaagcagtccgacggagtgcgctcatgcagaatgaaagatagtggtgaatgtacggttaccacaaataggtggcctatcatcttatgcgacaacgataagttttactatagcgagctgcaaaaggactacgataaaggccaggacattgggcacttctgtctttcgccccgttgcaatactatccggcatccaattaaccgaaagcacatatccaattgtacctggcaggtcaaccataataacatcgataaaattgaagtgcacgagttggaagacctcgagcagtataagaaagcaatcacacaaaagctgcagacttctctaaccctgtttaagtacagcaaaacgaagaatctcccccacattaaacctatgtataagtacatcacaatagagggaaccgaaactgctgagggcatcgaatcagcctatattgagagtgaaatcccagcgctggccggtacatccattgggttcaaaatcacctctaagagcggcaaacatcttttggatgtgataggatacgtcaagtccgcttcatacagcgcagtttatactaagctgtacaccacaggcccgacgattggggtgaacaccaaacacgacgagttatgcactggaccctgtcctgtgaatgtaccacatggtacaggctggctcacctttgccaaggagagaacaagttcttgggggtgcgaagagttcggatgtctggctatctccgatggctgcgtcttcggtagctgccaggacatcattaaagacgaaataactgtgtataggaaggagaccgaagagacgacagatgttgagctttgtctgacctttgccgacaaaacttactgcaccaacttgaacgcaatcacacccattatcactgatcaattcgaagtgcagtttaagaccgtcgaggcgtattcgctccctcgcattatcgccgtgcggaatcacgaaataatggttgggcagatcaacgacattggcgtgtactcaaagggatgtggcaatgtacagaaagtcaacaatacaaactatgggaatggagtgccaaagttcgattacctgtgccatctagcttctagaaaagaggtgatcgtcaggaagtgtattgacaacgattaccaagcctgcaaatttctgcagacgcccgcaagttatcgcctcgaggaagagggcggttccgttaccgtgatcgactacaagaagatactggggactattaaaatgaaggctatccttggagatgtaaaatataagacattcgccgacaatgtggatttgaccgtcgaaggcgtgtgtactggttgcatcaactgttttgagaatattcactgcgaactgacaatccacagcaccgttgaggcatcttgtccggtggtcagctcctgcacggtgttccatgaccgaatattaattactcctaacgagcacaaatacgccatcaaggttatttgcaatgaaaagccaggccccaccctcccttttaaaatctgttcagctaagacagacgcggccatgaccctggcagatgctaaacccatacttgagctggccccagtggaccagactacatatattaaggaaaaagatgagcggtgcaagacctggatgtgtcgtgtcagagacgaagggttccaggtaatctttgagcctttcaagaacctattcggaagttacatcggcatattttatacattcatcattagcctcatggccatatttatcgtgatttacatcgttctgcccatctgcttcaaattgagggatactctgcgccaacatgaggacgcttacaagcgggaaatgaaaattagatga

SEQ ID NO: 10977 - RNA, 4323 nt, synthetic construct
  misc_feature 1..4323: note = derived and/or modified CDS sequence (opt3) from TAHV(105)__GQ386829.1__GP
  source 1..4323: mol_type = other RNA
atgatgttcgtgctgtttttcatcgccctcagcgctgcatcccccgtctaccagagatgctttcaagacggcgccattgttaagcagaacccttctaaacaggcggtgaccgaggtatgtcttaaggatgacgtgtcaatgataaaaacagaagctaggtatttccggaatgccactgggacgtacgcaaacaatgtcgccatccgcaagtggctggtgagtgattggcacgactgccgaccgaaaaaggttagcggaggtcatattaacgtgatcgaggtcggcgatgacttgaccttacacacagaggcttatgtgtgtaatgcagattgcactattggggtagacaaggagaccgcccaggttcgtctgcaaacagataccactaaccattttgaaatcgctggaacaaccgtgaaatccggctggttcaagtctacgacttacataaccctagaccagacatgtgagcacctcaaagtctcgtgcggtccaaagtcaatccagtttcatgcctgtttcaatcagcacatgagctgcgtgagatttctgcacaggactattcttcccgggagtatcgcgtcctctatttgtcaaaacgtggagatcataattctgaccgtcttgacactcctgatcttcattctgctcagcatcttatccaaaacctatatctgctacattctgatgcctatatttatcccacttgcatatatttacggagttatctacaataagtcatgtaagaaatgcaagttgtgcggcctggtgtatcatcccttcacggaatgtggcactcactgcgtatgtggggcccggtacgagacaagtgatcgcatgaaactacatagagctagcggactctgccctggttataagtctctgagggccgcacgggtgatgtgtaaatccaagggcccagcttcaatacttagcattatcaccgccgtcctgatcttgacttttgtgacacccattaacgcgatggttgccggggacacccaggaaacgttcaaactcgaggatctgcctgacgacatgttaagtatggcaatgaaggtgaatatgtactatatcatgtgcatgattaactacgctgtcacctggtctttcatactgtgtgccctccttatcgctctgttgtttaagaaatatcagcaccgcttcctaaatttttacgccatgtactgccacgagtgtgatatgtatcatgaccgatccggactgaagtacaacggcgatttcacaaataaatgcagacagtgtacttgcggtcaatatgaagacgcagccgggctcctgacccacaggaagacatacaactgccttgtgcagtataaaagcaagtggctgactaactttttgattgtatacatcatcctcatgctgattaaggattcggttttaatagtgcatgctgacggaaccgatttcgagaaatgttctggcgaagcggacatcacatggaattgcaccggcccatttctgaacctagggaattgtgagaagaaacagaagaaagaatcctataacaatattgcaactcaactcaagggactggatgccatctcagtccttgacattccgatgatcagtaagatacccgaggatatcgctggtgccttgcggttcattgaggaacagcgtagctaccacgtgcagctgacggcagagtacgccatgctcacacgctattgcgactactatacccagtttactgacaactccggctactctcaaaccacatggagagtctatctgaggagccatgatttcgaggcttgtatcctttaccctaatcagcacttttgccggtgtgtgaaacacggggacaagtgctcaagttccaactgggatttcgccaatgaaatgaaaaactattacagcggaaagcagtctaaatttgacaaggatctgaatttggcactcatgtcactgcatcacgcgttccgaggcaccagtagcttctacattgctaagttactgaaagaaaagaaaaacgaggacctagttacttatgccgagaagatcaaaggtaagtacccagggaatgcactcctgaaagccataattgattatatcaagtacatgaaggaccttacagaaatgaacaattttaaacatgatgagatgtgggacgatttcatttttgaagtgccccctacgaagtccccatctgtacgcagattggagtcgagctatgacttcaaaaccaacgtcaactccaatccctcacacatctgtaagaacataaaaactgtggtttgcctgagtccgaagtctggcgtgagctacgattccatcattgcttgtggagaaccttcacagcccagcatctataggaagccagactctcaagtctttcagtccaatgccgaccagacacacttctgcctcagtgatacccattgcctggagaactacgagacagtgggcgaagagattatcgacgcaattaaaaagagcaaatgttgggaaactgagtttaccgagtacatacagttcaagcaatctgatggggtacggtcctgccgcatgaaagactcaggagaatgtacggtgaccacaaatagatggcctatcatcttatgcgataacgacaagttttattacagtgagctgcagaaggattatgacaaagatcaggacattggtcacttctgtcttagccccaggtgcaatactatccgtcatccaattaaccggaagcacatatcgaattgtacctggcaggtttcccataacaatatcgataaaattgaagtccacgagttggaagacctcgagcaatacaagaaagctatcacacagaagctgcagacttctctaaccctgtttaagtatagcaaaacgaagaacctcccccacattaaacctatgtacaagtatatcacaatagagggcaccgaaactgccgaggggatcgaatcagcgtacattgagagtgaaatcccagccctggctggaacatccattggcttcaaaatcacctctaagagcggtaaacatcttttggatgtgatagggtacgtgaagtccgcatcatatagcgccgtctacactaagctgtataccacaggcccgacgattggagttaataccaaacacgacgagttatgcactggcccctgtcctgtgaacgtgccacatgggacaggatggctcacctttgctaaggagcgaacaagttcttggggttgcgaagagttcggctgtctggccatctccgacgggtgcgtattcggaagctgccaagatatcattaaagacgaaataactgtctacagaaaggagaccgaagagacgacagatgtggagctttgtctgacctttgcagacaaaacttattgcaccaatttgaacgcgatcacacccattatcactgatcagttcgaagttcagtttaagaccgtggaggcctactcgctccctaggattatcgctgtccgcaaccacgaaataatggtgggccagatcaatgacattggtgtttattcaaaggggtgtggcaacgtgcaaaaagtaaataacacaaattacggaaacggcgtcccaaagttcgattacctgtgccatctagcctctcggaaagaggtgatcgtgagaaagtgttttgacaatgattatcaggcatgcaaattcctgcagacgcccgctagttacaggctcgaggaagaagggggatccgtcaccgttattgactataagaagatcctgggcactataaaaatgaaggccattcttggtgatgtgaaatacaagacatttgcagacaacgtagacttgaccgtggaaggggtctgtactggatgcatcaattgtttcgagaacatccactgcgaactgacaattcacagcaccgtggaggcctcttgtccggttgtgagctcctgcacggtctttcatgatcgcatcttaataactcctaatgagcacaaatatgctattaaggtgatctgcaacgaaaagccaggccccaccctccctttcaaaatttgttcagcgaagacagacgccgcaatgaccctggctgatgccaaacccatccttgagctggccccagttgaccagactacatacataaaggaaaaagatgagcgatgcaagacctggatgtgtcgggtgcgtgacgaaggttttcaagtcattttcgagcctttcaagaatctatttggcagttatatcgggatcttctacacatttattatcagcctcatggctattttcatagtaatctacattgtgctgcccatctgctttaaattgagagatactctgaggcagcatgaggacgcatataagcgcgaaatgaaaatccggtga

SEQ ID NO: 10978 - RNA, 4323 nt, synthetic construct
  misc_feature 1..4323: note = derived and/or modified CDS sequence (opt3) from TAHV(106)__GQ386830.1__GP
  source 1..4323: mol_type = other RNA
atgatgttcgtgctgtttttcatcgccctcagcgctgcatcccccgtctaccagagatgctttcaagacggcgccattgttaagcagaacccttctaaacaggcggtgaccgaggtatgtcttaaggatgacgtgtcaatgataaaaacagaagctaggtatttccggaatgccactgggacgtacgcaaacaatgtcgccatccgcaagtggctggtgagtgattggcacgactgccgaccgaaaaaggttagcggaggtcatattaacgtgatcgaggtcggcgatgacttgaccttacacacagaggcttatgtgtgtaatgcagattgcactattggggtagacaaggagaccgcccaggttcgtctgcaaacagataccactaaccattttgaaatcgctggaacaaccgtgaaatccggctggttcaagtctacgacttacataaccctagaccagacatgtgagcacctcaaagtctcgtgcggtccgaagtcaatccagtttcatgcctgtttcaatcagcacatgagctgcgtgagatttctgcacaggactattcttcccgggagtatcgcgtcctctatttgtcaaaacgtggagatcataattctgaccgtcttgacactcctgatcttcattctgctcagcatcttatccaaaacctatatctgctacattctgatgcctatatttatcccacttgcatatatttacggagttatctacaataagtcatgtaagaaatgcaagttgtgcggcctggtgtatcatcccttcacggaatgtggcactcactgcgtatgtggggcccggtacgagacaagtgatcgcatgaaactacatagagctagcggactctgccctggttataagtctctgagggccgcacgggtgatgtgtaaatccaagggcccagcttcaatacttagcattatcaccgccgtcctgatcttgacttttgtgacacccattaacgcgatggttgccggggacacccaggaaacgttcaaactcgaggatctgcctgacgacatgttaagtatggcaatgaaggtgaatatgtactatatcatgtgcatgattaactacgctgtcacctggtctttcatactgtgtgccctccttatcgctctgttgtttaagaaatatcagcaccgcttcctaaatttttacgccatgtactgccacgagtgtgatatgtatcatgaccgatccggactgaagtacaacggcgatttcacaaataaatgcagacagtgtacttgcggtcaatatgaagacgcagccgggctcctgacccacaggaagacatacaactgccttgtgcagtataaaagcaagtggctgactaactttttgattgtatacatcatcctcatgctgattaaggattcggttttaatagtgcatgctgacggaaccgatttcgagaaatgttctggcgaagcggacatcacatggaattgcaccggcccatttctgaacctagggaattgtgagaagaaacagaagaaagaatcctataacaatattgcaactcaactcaagggactggatgccatctcagtccttgacattccgatgatcagtaagatacccgaggatatcgctggtgccttgcggttcattgaggaacagcgtagctaccacgtgcagctgacggcagagtacgccatgctcacacgctattgcgactactatacccagtttactgacaactccggctactctcaaaccacatggagagtctatctgaggagccatgatttcgaggcttgtatcctttaccctaatcagcacttttgccggtgtgtgaaacacggggacaagtgctcaagttccaactgggatttcgccaatgaaatgaaaaactattacagcggaaagcagtctaaatttgacaaggatctgaatttggcactcatgtcactgcatcacgcgttccgaggcaccagtagcttctacattgctaagttactgaaagaaaagaaaaacgaggacctagttacttatgccgagaagatcaaaggtaagtacccagggaatgcactcctgaaagccataattgattatatcaagtacatgaagggccttacagaaatgaacaattttaaacatgacgagatgtgggatgacttcatttccgaagtgccccctacgaagtctccatcggtacgcagattggagagctcctatgattttaaaaccaacgtcaactcaaatcccagtcacatctgtaagaacataaaaactgtggtttgcctgtctccaaagagcggagtgtcctacgactcaatcattgcttgtggcgaacctagccagccctctatctataggaagccagattcccaagtcttccagagtaatgccgaccagacacacttttgcctcagcgacacccattgcctggagaactacgagacagtgggggaagagattatcgatgcaattaaaaagtctaaatgttgggaaactgagttcaccgagtacatacagtttaagcaatccgacggagtacggtcatgccgcatgaaagatagtggtgaatgtacggtgaccacaaatagatggcctatcatcttatgcgacaacgataagttctattacagcgagctgcagaaggactatgataaagaccaggatattggccacttttgtctttcgcccaggtgcaatactatccgtcatccaattaaccggaagcacatatccaattgtacctggcaggtttctcataacaatatcgacaaaattgaagtccacgagttggaagatctcgagcaatacaagaaagctatcacacagaagctgcagactagcctaaccctgttcaagtattcaaaaacgaagaacctcccccacattaaacctatgtacaagtatatcacaatagaggggaccgaaactgccgagggaatcgaaagtgcgtacattgagtccgaaatcccagccctggctggcacatctattggttttaaaatcaccagcaagtccgggaaacatcttttggacgtgataggctacgtgaagtcagcaagctatagtgccgtctacactaagctgtataccacaggaccgacgattgatgttaataccaaacacgacgagttatgcactggcccctgtcctgtgaacgtgccacatgggacaggatggctcaccttcgctaaggagcgaacatcttcctggggttgcgaagagtttggctgtctggccatcagcgacgggtgcgtattcggatcgtgccaagatatcattaaagacgaaataactgtctacagaaaggagaccgaagagacgacagatgtggagctttgtctgaccttcgcagacaaaacttattgcaccaatttgaacgcgatcacacccattatcactgatcagtttgaagttcagttcaagaccgtggaggcctactcactccctaggattatcgctgtccgcaaccacgaaataatggtgggccagatcaatgacattggtgtttattctaaggggtgtggcaacgtgcaaaaagtaaataacacaaattacggaaacggcgtcccaaagtttgattacctgtgccatctagccagtcggaaagaggtgatcgtgagaaagtgtttcgacaatgattatcaggcatgcaaatttctgcagacgcccgcttcctacaggctcgaggaagaagggggaagcgtcaccgttattgactataagaagatcctgggcactataaaaatgaaggccattcttggtgatgtgaaatacaagacattcgcagacaacgtagacttgaccgtggaaggggtctgtactggatgcatcaattgttttgagaacatccactgcgaactgacaattcactctaccgtggaggccagctgtccggttgtgtcctcatgcacggtcttccatgatcgcatcttaataactcctaatgagcacaaatatgctattaaggtgatctgcaacgaaaagccaggccccaccctcccttttaaaatttgtagtgcgaagacagacgccgcaatgaccctggctgatgccaaacccatccttgagctggccccagttgaccagactacatacataaaggaaaaagatgagcgatgcaagacctggatgtgtcgggtgcgtgacgaaggtttccaagtcatttttgagcctttcaagaatctattcggcagctatatcgggatcttttacacattcattatctctctcatggctatttttatagtaatctacattgtgctgcccatctgcttcaaattgagagatactctgaggcagcatgaggacgcatataagcgcgaaatgaaaatccggtga

SEQ ID NO: 10979 - RNA, 4323 nt, synthetic construct
  misc_feature 1..4323: note = derived and/or modified CDS sequence (opt3) from TAHV(181)__GQ386831.1__GP
  source 1..4323: mol_type = other RNA
atgatgttcgtgctgtttttcatcgccctcagcgctgcatcccccgtctaccagagatgctttcaagacggcgccattgttaagcagaacccttctaaacaggcggtgaccgaggtatgtcttaaggatgacgtgtcaatgataaaaacagaagctaggtatttccggaatgccactgggacgtacgcaaacaatgtcgccatccgcaagtggctggtgagtgattggcacgactgccgaccaaagaaggttagcggaggtcatattaacgtgatcgaggtcggcgatgacttgaccttacacacagaggcttatgtgtgtaatgcagattgcactattggggtagacaaggaaaccgcccaggttcgtctgcaaacagataccactaaccattttgaaatcgctggaacaaccgtgaaatccggctggttcaagtctacgacttacataaccctagaccagacatgtgagcacctcaaagtctcgtgcggtccgaagtcaatccagtttcatgcctgtttcaatcagcacatgagctgcgtgagatttctgcacaggactattcttcccgggagtatcgcgtcctctatttgtcaaaacgtggagatcataattctgaccgtcttgacactcctgatcttcattctgctcagcatcttatccaaaacctatatctgctacattctgatgcctatatttatcccacttgcatatatttacggagttatctacaataagtcatgtaagaaatgcaagttgtgcggcctggtgtatcatcccttcacggaatgtggcactcactgcgtatgtggggcccggtacgagacaagtgatcgcatgaaactacatagagctagcggactctgccctggttataagtctctgagggccgcacgggtgatgtgtaaatccaagggcccagcttcaatacttagcattatcaccgccgtcctgatcttgacttttgtgacacccattaacgcgatggttgccggggacacccaggaaacgttcaaactcgaggatctgcctgacgacatgttaagtatggcaatgaaggtgaatatgtactatatcatgtgcatgattaactacgctgtcacctggtctttcatactgtgtgccctccttatcgctctgttgtttaagaaatatcagcaccgcttcctaaatttttacgccatgtactgccacgagtgtgatatgtatcatgaccgatccggactgaagtacaacggcgatttcacaaataaatgcagacagtgtacttgcggtcaatatggggacgcagccggactcctgacccacaggaagacatacaactgccttgtgcagtataaaagcaagtggctgactaactttttgattggctacatcatcctcatgctgattaaggattcggtattaatagttcatgctgacggcaccgatttcgaaaaatgttctggggaggcggacatcacatggaattgcaccggaccatttctgaacctaggtaattgtgaaaagaaacagaagaaagagtcctataacaatattgcaactcaactcaagggcctggatgccatctcagtgcttgacattccgatgatcagtaagatacccgaagatatcgctggggccttgcggttcattgaggagcagcgtagctaccacgtccagctgacggcagaatacgccatgctcacacgctattgcgactactatacccagtttactgacaactccggatactctcaaaccacatggagagtgtatctgaggagccatgatttcgaggcttgtatcctttaccctaatcggcacttttgccgatgtgtcaaacacggcgacaagtgctcaagttccaactgggatttcgccaatgaaatgaaaaactattacagcggtaagcagtctaaatttgacaaggatctgaatttggcactcatgtcactgcatcacgcgttccgcgggaccagtagcttctacattgctaagttactgaaagagaagaaaaacgaagacctagtgacttatgccgagaagatcaaaggcaagtacccaggaaatgcactcctgaaagccataattgattatatcaagtacatgaagggccttacagagatgaacaattttaaacatgacgaaatgtgggatgacttcatttttgaggttccccctacgaagtccccatctgtgagaaggttggaatcgagctatgatttcaaaaccaacgtaaactccaatccctcacacatctgtaagaacataaaaactgtcgtgtgcctgagtccgaagtctggggttagctacgactccatcattgcttgtggagagccttcacagcccagcatctatcggaagccagattctcaggtgtttcaatccaatgccgaccagacacacttctgcctcagtgacacccattgcctggaaaactacgagacagtcggtgaggaaattatcgatgcaattaaaaagagcaaatgttgggagactgaatttaccgagtacatacagttcaagcagtctgacggcgtgcgctcctgcagaatgaaagattcaggggagtgtacggtaaccacaaataggtggcctatcatcttatgcgacaacgataagttttattacagtgaactgcaaaaggactatgataaagaccaggatattggacacttctgtcttagcccccgttgcaatactatccggcatccaattaaccgaaagcacatatcgaattgtacctggcaagtgaaccataataacatcgacaaaattgaggttcacgaattggaggatctcgaacagtacaagaaagctatcacacagaagctgcagacttccctaaccctgtttaagtattctaaaacgaagaatctcccccacattaaacctatgtacaagtatatcacaatagagggcaccgagactgccgaaggtatcgagagcgcgtacattgaatcagagatcccagccctggctgggacaagtattggcttcaaaatcacctccaagtctggaaaacatcttttggacgtcataggctacgtgaaaagcgcatcctattcagccgtgtacactaagctgtataccacagggccgacgattggagtcaacaccaaacacgatgaattatgcactggtccctgtcctgttaatgtgccacatggcacagggtggctcacctttgctaaggagagaacaagcagttggggatgcgaggagttcggctgtctggccatctctgacggttgcgtgttcgggtcctgccaggacatcattaaagatgaaataactgtatacaggaaggaaaccgaggaaacgacagacgtcgagctttgtctgacctttgcagataaaacttattgcaccaacttgaacgcgatcacacccattatcactgaccaattcgaggtgcagtttaagaccgttgaagcctacagcctccctcgcattatcgctgtgcggaatcacgagataatggtcggccagatcaacgatattggagtgtattcgaagggctgtgggaatgttcagaaagtgaacaatacaaactacggaaatggcgtaccaaagttcgactacctgtgccatctagcctcaagaaaagaagtcatcgtgaggaagtgttttgataacgactatcaagcatgcaaattcctgcagacgcccgcttcttaccgcctcgaggaggaaggtgggagtgtgaccgtcattgattataagaagatcctgggaactataaaaatgaaggccattcttggcgacgttaaatacaagacatttgcagataatgtggacttgaccgtagagggtgtgtgtactggctgcatcaactgtttcgaaaatatccactgcgagctgacaattcactccaccgtcgaagccagctgtccggtggtttctagctgcacggtgtttcatgaccgaatcttaataactcctaacgagcacaaatatgctattaaggtcatctgcaatgagaagccagggcccaccctccctttcaaaatttgttccgcgaagacagatgccgcaatgaccctggctgacgccaaacccatccttgaactggccccagtggatcagactacatacataaaggagaaagacgaacggtgcaagacctggatgtgtcgtgttagagatgagggatttcaggtgattttcgaacctttcaagaacctatttggctcatatatcgggatcttctacacatttattatcagtctcatggctattttcatagtcatctacattgtactgcccatctgctttaaattgagggacactctgcgccaacatgaggatgcatataagcgggagatgaaaatcagatga

SEQ ID NO: 10980 - RNA, 4323 nt, synthetic construct
  misc_feature 1..4323: note = derived and/or modified CDS sequence (opt3) from TAHV(236)__GQ386832.1__GP
  source 1..4323: mol_type = other RNA
atgatgttcgtgctgtttttcatcgccctcagcgctgcatcccccgtctaccagagatgctttcaagacggcgccattgttaagcagaacccttctaaacaggcggtgaccgaggtatgtcttaaggatgacgtgtcaatgataaaaacagaagctaggtatttccggaatgccactgggacgtacgcaaacaatgtcgccatccgcaagtggctggtgagtgattggcacgactgccgaccgaaaaaggttagcggaggtcatattaacgtgatcgaggtcggcgatgacttgaccttacacacagaggcttatgtgtgtaatgcagattgcactattggggtagacaaggaaaccgcccaggttcgtctgcaaacagataccactaaccattttgaaatcgctggaacaaccgtgaaatccggctggttcaagtctacgacttacataaccctagaccagacatgtgagcacctcaaagtctcgtgcggtccaaagtcaatccagtttcatgcctgtttcaatcagcacatgagctgcgtgagatttctgcacaggactattcttcccgggagtatcgcgtcctctatttgtcaaaacgtggagatcataattctgaccgtcttgacactcctgatcttcattctgctcagcatcttatccaaaacctatatctgctacattctgatgcctatatttatcccacttgcatatatttacggagttatctacaataagtcatgtaagaaatgcaagttgtgcggcctggtgtatcatcccttcacggaatgtggcactcactgcgtatgtggggcccggtacgagacaagtgatcgcatgaaactacatagagctagcggactctgccctggttataagtctctgagggccgcacgggtgatgtgtaaatccaagggcccagcttcaatacttagcattatcaccgccgtcctgatcttgacttttgtgacacccattaacgcgatggttgccggggacacccaggaaacgttcaaactcgaggatctgcctgacgacatgttaagtatggcaatgaaggtgaatatgtactatatcatgtgcatgattaactacgctataacctggtctttcatcctgtgtgccctccttattgctctgttgtttaagaaatatcagcaccgcttcctaaatttttacgccatgtactgccacgagtgtgatatgtatcatgaccgatccggactgaagtacaacggcgatttcacaaataaatgcagacagtgtacttgcggtcaatatgaagacgcagccgggctcctgacccacaggaagacatacaactgccttgtccagtataaaagcaagtggctgactaactttttgatcgtgtacatcattctcatgctgataaaggattcggtattaatcgttcatgctgacggaaccgatttcgagaaatgttctggcgaagcggacattacatggaattgcaccggcccatttctgaacctagggaattgtgagaagaaacagaagaaagaatcctataacaatatcgcaactcaactcaagggactggatgccatttcagtgcttgacatgccgatgatcagtaagatacccgaggatatcgctggtgccttgcggttcattgaggaacagcgtagctaccacgtccagctgacggcagagtacgccatgctcacacgctattgcgactactatacccagtttactgacaactccggctactctcaaaccacatggagagtgtatctgaggagccatgatttcgaggcttgtatcctttaccctaatcagcacttttgccggtgtgtcaaacacggggacaagtgctcaagttccaactgggatttcgccaatgaaatgaaaaactattacagcggaaagcagtctaaatttgacaaggatctgaatttggcactcatgtcactgcatcacgcgttccgaggcaccagtagcttctacattgctaagttactgaaagaaaagaaaaacgaggacctagtgacttatgccgagaagatcaaaggtaagtacccagggaatgcactcctgaaagccataattgattatatcaagtacatgaaggaccttacagaaatgaacaattttaaacatgatgagatgtgggacgatttcatttttgaagttccccctacgaagtccccatctgtgcgcagattggagtcgagctatgacttcaaaaccaacgtaaactccaatccctcacacatctgtaagaacataaaaactgtcatctgcctgagtccgaagtctggcgtgagctacgattccattatcgcttgtggagaaccttcacagcccagcatttataggaagccagactctcaagtttttcagtccaatgccgaccagacacacttctgcctcagtgatacccattgcctggagaactacgagacagtgggcgaagagatcatagacgcaattaaaaagagcaaatgttgggaaactgagttaaccgagtacatccagtttaagcaatctgatggggtccggtcctgccgcatgaaagactcaggagaatgtacggtgaccacaaatagatggcctatcattctgtgcgataacgacaagttctattacagtgagcttcagaaggattatgacaaagatcaggacatcggtcacttttgtttgagccccaggtgcaatactattcgtcatccaataaaccggaagcacatctcgaattgtacctggcaggtatcccataacaatattgataaaatcgaagtgcacgagctcgaagacctggagcaatacaagaaagctattacacagaagctacagacttctctgaccctcttcaagtatagcaaaacgaagaacctgccccacatcaaacctatgtacaagtatataacaatcgagggcaccgaaactgccgaggggattgaatcagcgtacatcgagagtgaaattccagcccttgctggaacatccatcggctttaaaataacctctaagagcggtaaacatttgctggatgttattgggtacgtcaagtccgcatcatatagcgccgtgtacactaagttatataccacaggcccgacgatcggagtgaataccaaacacgacgagctctgcactggcccctgtcctgtcaacgttccacatgggacaggatggctgaccttcgctaaggagcgaacaagttcttggggttgcgaagagtttggctgtcttgccatctccgacgggtgcgtgttcggaagctgccaagatattataaaagacgaaatcactgtgtacagaaaggagaccgaagagacgacagatgtagagctgtgtttgaccttcgcagacaaaacttattgcaccaatctcaacgcgattacacccatcattactgatcagtttgaagtccagttcaagaccgtggaggcctactcgctgcctaggatcatagctgttcgcaaccacgaaatcatggtgggccagattaatgacatcggtgtctattcaaaggggtgtggcaacgtgcaaaaagttaataacacaaattacggaaacggcgtgccaaagtttgattacctatgccatctggcctctcggaaagaggtaattgtcagaaagtgtttcgacaatgattatcaggcatgcaaatttctccagacgcccgctagttacaggctggaggaagaggggtccagcgtgaccgtgatcgactataagaagatacttggaactattaaaatgaaggccatcttgggcgatgtcaaatacaagacattcgcagacaacgttgacctgaccgtggaaggtgtatgtactgggtgcatcaattgttttgagaacattcactgcgaattaacaatccactctaccgtggaggccagctgtccggtcgtgtcctcatgcacggttttccatgatcgcatactcattactcctaatgagcacaaatatgctatcaaggtgatttgcaacgaaaagccaggacccaccctgccttttaaaatctgtagtgcgaagacagacgccgcaatgacccttgctgatgccaaacccatactggagctagccccagtcgaccagactacatacattaaggaaaaagatgagcgatgcaagacctggatgtgtcgggtgcgtgacgaaggcttccaagttatctttgagcctttcaagaatctcttcggtagctatatcggcatcttttacacattcattatttctctgatggctatatttatcgtgatttacatcgtcttgcccatctgcttcaaactgagagatgcattaaggcagcatgaggacgcctataagcgcgaaatgaaaattcggtga

SEQ ID NO: 10981 - RNA, 4323 nt, synthetic construct
  misc_feature 1..4323: note = derived and/or modified CDS sequence (opt3) from TAHV(29)__GQ386823.1__GP
  source 1..4323: mol_type = other RNA
atgatgttcgtgctgtttttcatcgccctcagcgctgcatcccccgtctaccagagatgctttcaagacggcgccattgttaagcagaacccttctaaacaggcggtgaccgaggtatgtcttaaggatgacgtgtcaatgataaaaacagaagctaggtatttccggaatgccactgggacgtacgcaaacaatgtcgccatccgcaagtggctggtgagtgattggcacgactgccgaccgaaaaaggttagcggaggtcatattaacgtgatcgaggtcggcgatgacttgaccttacacacagaggcttatgtgtgtaatgcagattgcactattggggtagacaaggagaccgcccaggttcgtctgcaaacagataccactaaccattttgaaatcgctggaacaaccgtgaaatccggctggttcaagtctacgacttacataaccctagaccagacatgtgagcacctcaaagtctcgtgcggtccaaagtcaatccagtttcatgcctgtttcaatcagcacatgagctgcgtgagatttctgcacaggactattcttcccgggagtatcgcgtcctctatttgtcaaaacgtggagatcataattctgaccgtcttgacactcctgatcttcattctgctcagcatcttatccaaaacctatatctgctacattctgatgcctatatttatcccacttgcatatatttacggagttatctacaataagtcatgtaagaaatgcaagttgtgcggcctggtgtatcatcccttcacggaatgtggcactcactgcgtatgtggggcccggtacgagacaagtgatcgcatgaaactacatagagctagcggactctgccctggttataagtctctgagggccgcacgggtgatgtgtaaatccaagggcccagcttcaatacttagcattatcaccgccgtcctgatcttgacttttgtgacacccattaacgcgatggttgccggggacacccaggaaacgttcaaactcgaggatctgcctgacgacatgttaagtatggcaatgaaggtgaatatgtactatatcatgtgcatgattaactacgctgtcacctggtctttcatactgtgtgccctccttatcgctctgttgtttaagaaatatcagcaccgcttcctaaatttttacgccatgtactgccacgagtgtgatatgtatcatgaccgatccggactgaagtacaacggcgatttcacaaataaatgcagacagtgtacttgcggtcaatatgaagacgcagccgggctcctgacccacaggaagacatacaactgccttgtgcagtataaaagcaagtggctgactaactttttgattgtatacatcatcctcatgctgattaaggattcggttttaatagtgcatgctgacggaaccgatttcgagaaatgttctggcgaagcggacatcacatggaattgcaccggcccatttctgaacctagggaattgtgagaagaaacagaagaaagaatcctatgataacattgcaactcaactcaagggactggacgccatctcagtccttgatattccgatgatcagtaagatacccgaggacatcgctggtgccttgcggttcattgaggaacagcgtagctaccacgtgcagctgacggcagagtacgccatgctcacacgctattgcgactactatacccagtttactgataattccggctactctcaaaccacatggagagtctatctgaggagccatgacttcgaggcttgtatcctttaccctaaccagcacttttgccggtgtgtgaaacacggggataagtgctcaagttccaattgggacttcgccaacgaaatgaaaaattattacagcggaaagcagtctaaatttgataaggacctgaacttggcactcatgtcactgcatcacgcgttccgaggcaccagtagcttctacattgctaagttactgaaagaaaagaaaaatgaggatctagttacttatgccgagaagatcaaaggtaagtacccagggaacgcactcctgaaagccataattgactatatcaagtacatgaaggatcttacagaaatgaataactttaaacatgacgagatgtgggatgacttcatttttgaagtgccccctacgaagtccccatctgtacgcagattggagtcgagctatgatttcaaaaccaatgtcaactccaacccctcacacatctgtaagaatataaaaactgtggtttgcctgagtccgaagtctggcgtgagctacgactccatcattgcttgtggagaaccttcacagcccagcatctataggaagccagactctcaagtctttcagtccaacgccgatcagacacacttctgcctcagtgacacccattgcctggagaattacgagacagtgggcgaagagattatcgatgcaattaaaaagagcaaatgttgggaaactgagtttaccgagtacatacagttcaagcaatctgacggggtacggtcctgccgcatgaaagattcaggagaatgtacggtgaccacaaacagatggcctatcatcttatgcgacaatgataagttttattacagtgagctgcagaaggactatgataaagaccaggatattggtcacttctgtcttagccccaggtgcaacactatccgtcatccaattaatcggaagcacatatcgaactgtacctggcaggtttcccataataacatcgacaaaattgaagtccacgagttggaagatctcgagcaatacaagaaagctatcacacagaagctgcagacttctctaaccctgtttaagtatagcaaaacgaagaatctcccccacattaaacctatgtacaagtatatcacaatagagggcaccgaaactgccgaggggatcgaatcagcgtacattgagagtgaaatcccagccctggctggaacatccattggcttcaaaatcacctctaagagcggtaaacatcttttggacgtgatagggtacgtgaagtccgcatcatatagcgccgtctacactaagctgtataccacaggcccgacgattggagttaacaccaaacacgacgagttatgcactggcccctgtcctgtgaatatgccacatgggacaggatggctcacctttgctaaggagcgaacaagttcttggggttgcgaagagttcggctgtctggccatctccgatgggtgcgtgttcggaagctgccaagacatcattaaagatgaaataactgtatacagaaaggagaccgaagagacgacagacgtcgagctttgtctgacctttgcagataaaacttattgcaccaacttgaatgcgatcacacccattatcactgaccagttcgaagtgcagtttaagaccgttgaggcctactcgctccctaggattatcgctgtgcgcaaccacgaaataatggtcggccagatcaacgatattggtgtgtattcaaaggggtgtggcaatgttcaaaaagtgaacaatacaaactacggaaatggcgtaccaaagttcgactacctgtgccatctagcctctcggaaagaggtcatcgtgagaaagtgttttgataacgactatcaggcatgcaaattcctgcagacgcccgctagttacaggctcgaggaagaagggggatccgtgaccgtcattgattataagaagatcctgggcactataaaaatgaaggccattcttggtgacgttaaatacaagacatttgcagacaatgtggatttgaccgtagaaggggtgtgtactggatgcatcaactgtttcgagaatatccactgcgaactgacaattcacagcaccgtcgaggcctcttgtccggtggttagctcctgcacggtgtttcatgaccgcatcttaataactcctaacgagcacaaatatgctattaaggtcatctgcaatgaaaagccaggccccaccctccctttcaaaatttgttcagcgaagacagatgtggccatgaccctggcagacgctaaacccatccttgagctggccccagttgatcagactacatacataaaggaaaaagacgagcgatgcaagacctggatgtgtcgggtgaaggatgaaggttttcaagtcattttcgagcctttcaaaaacctatttggcagttatatcgggatcttctacacatttattatcagcctcatggccattttcatagtaatctacattgtgctgcccatctgctttaagttgcgtgacactctgagacagcatgaggatgcttataaaagggaaatgaagatccgctga

SEQ ID NO: 10982 - RNA, 4323 nt, synthetic construct
  misc_feature 1..4323: note = derived and/or modified CDS sequence (opt3) from TAHV(4019)__GQ386834.1__GP
  source 1..4323: mol_type = other RNA
atgatgttcgtgctgtttttcatcgccctcagcgctgcatcccccgtctaccagagatgctttcaagacggcgccattgttaagcagaacccttctaaacaggcggtgaccgaggtatgtcttaaggatgacgtgtcaatgataaaaacagaagctaggtatttccggaatgccactgggacgtacgcaaacaatgtcgccatccgcaagtggctggtgagtgattggcacgactgccgaccgaaaaaggttagcggaggtcatattaacgtgatcgaggtcggcgatgacttgaccttacacacagaggcttatgtgtgtaatgcagattgcactattggggtagacaaggaaaccgcccaggttcgtctgcaaacagataccactaaccattttgaaatcgctggaacaaccgtgaaatccggctggttcaagtctacgacttacataaccctagaccagacatgtgagcacctcaaagtctcgtgcggtccgaagtcaatccagtttcatgcctgtttcaatcagcacatgagctgcgtgagatttctgcacaggactattcttcccgggagtatcgcgtcctctatttgtcaaaacgtggagatcataattctgaccgtcttgacactcctgatcttcattctgctcagcatcttatccaaaacctatatctgctacattctgatgcctatatttatcccacttgcatatatttacggagttatctacaataagtcatgtaagaaatgcaagttgtgcggcctggtgtatcatcccttcacggaatgtggcactcactgcgtatgtggggcccggtacgagacaagtgatcgcatgaaactacatagagctagcggactctgccctggttataagtctctgagggccgcacgggtgatgtgtaaatccaagggcccagcttcaatacttagcattatcaccgccgtcctgatcttgacttttgtgacacccattaacgcgatggttgccggggacacccaggaaacgttcaaactcgaggatctgcctgacgacatgttaagtatggcaatgaaggtgaatatgtactatatcatgtgcatgattaactacgctgtcacctggtctttcatactgtgtgccctccttatcgctctgttgtttaagaaatatcagcaccgcttcctaaatttttacgccatgtactgccacgagtgtgatatgtatcatgaccgatccggactgaagtacaacggcgatttcacaaataaatgcagacagtgtacttgcggtcaatatgaagacgcagccgggctcctgacccacaggaagacatacaactgccttgtgcagtataaaagcaagtggctgactaactttttgattgtatacatcatcctcatgctgattaaggattcggttttaatagtgcatgctgacggaaccgatttcgagaaatgttctggcgaagcggacatcacatggaattgcaccggcccatttctgaacctagggaattgtgagaagaaacagaagaaagaatcctataacaatattgcaactcaactcaagggactggatgccatctcagtccttgacattccgatgatcagtaagatacccgaggatatcgctggtgccttgcggttcattgaggaacagcgtagctaccacgtgcagctgacggcagagtacgccatgctcacacgctattgcgactactatacccagtttactgacaactccggctactctcaaaccacatggagagtctatctgaggagccatgatttcgaggcttgtatcctttaccctaatcggcacttttgccgatgtgtgaaacacggggacaagtgctcaagttccaactgggatttcgccaatgaaatgaaaaactattacagcggaaagcagtctaaatttgacaaggatctgaatttggcactcatgtcactgcatcacgcgttccgcggcaccagtagcttctacattgctaagttactgaaagaaaagaaaaacgaggacctagttacttatgccgagaagatcaaaggtaagtacccagggaatgcactcctgaaagccataattgattatatcaagtacatgaaggaccttacagaaatgaacaattttaaacatgatgagatgtgggacgattccattttcgaagtgccccctacgaagtctccatcggtaagaaggttggagagctcctatgactttaaaaccaacgtcaactcaaatcccagtcacatctgtaagaacataaaaactgtggtttgcctgtctccaaagagcggcgtgtcctacgattcaatcattgcttgtggagaacctagccagccctctatctatcggaagccagactcccaggtcttccaaagtaatgccgaccagacacacttttgcctcagcgatacccattgcctggagaactacgaggcagtgggcgaagagattatcgacgctattaaaaagtctaaatgttgggaaacagagttcactgagtacattcagtttaagcagtccgatggggtacgctcatgcagaatgaaagacagtggagaatgtaccgtgacgaccaataggtggcctatcatcttatgcgataacgacaagttctattacagcgagctgcaaaaggattatgacaaagatcaggacattggtcacttttgtctttcgccccgttgcaatacaatccggcatccaattaaccgaaagcacatatccaattgtacttggcaggtttctcataacaatatcgataaaattgaagtccacgagttggaagacctcgagcagtacaagaaagccatcacccaaaagctgcagacaagcctaactctgttcaagtattcaaaaaccaagaacctcccccacattaaacctatgtacaagtatatcacgatagagggcacagaaaccgcggaggggatcgaaagtgcctacattgagtccgaaatcccagctctggcaggaacttctattggctttaaaatcacaagcaagtccggtaaacatcttttggatgtgatatcatacgtcaagagcgccagttattctgctgtgtacaccaagctgtatactaccgggccgacaattggcgttaatacgaaacacgacgagttatgcaccggaccctgtcctgtgaacgtgccacatggcactgggtggatcacattcgccaaggagagaacctccagctggggatgcgaagagtttggttgtctcgcaatctcggacggctgcgtattcgggtcatgccaggatattataaaagacgaaatcacagtctacaggaaggagactgaagagaccacggatgtggagctgtgtcttacattcgcggacaaaacctattgcactaatctgaacgccattacccccatcattacagatcaatttgaagttcagttcaagactgtggaggcttactctttgcctcgcatcatagccgtccggaaccacgaaatcatggtgggacagattaatgacatcggcgtttatagtaagggttgtgggaacgtgcagaaagtaaataacaccaattacggcaacggagtcccaaagtttgattacctctgccatctggcatccagaaaagaggtgattgtgaggaagtgtttcgacaatgattatcaggcttgcaaatttctacaaacacccgccagctaccgcctggaggaagagggcgggtctgtcacggttatcgactataagaagatactcggaaccattaaaatgaaggcaatcctgggcgatgtgaaatacaagactttcgccgacaacgtagaccttacagtggaaggtgtctgtaccgggtgcatcaattgttttgagaacattcactgcgaattgactatccacagcacagtggaggcttcctgtccggttgtgtcaagttgcaccgtcttccatgatcgaatactgattacgcctaatgagcacaaatatgcgatcaaggtgatttgcaacgaaaagccaggacccactttaccttttaaaatctgtagcgccaagaccgacgcagctatgacactcgccgatgccaaacccatactggagcttgctccagttgaccagaccacttacattaaggaaaaagatgagcggtgcaagacatggatgtgtcgtgtgagagacgaaggcttccaggtcatctttgagcctttcaagaatctgttcggttcttatatcggcatattttacaccttcatcatttccctaatggcaatatttatcgtaatttacatcgtgctccccatctgcttcaaactgagggatacattgcgccaacatgaggacgcctataagcgggaaatgaaaattagatga

SEQ ID NO: 10983 - RNA, 4323 nt, synthetic construct
  misc_feature 1..4323: note = derived and/or modified CDS sequence (opt3) from TAHV(4020)__GQ386835.1__GP
  source 1..4323: mol_type = other RNA
atgatgttcgtgctgtttttcatcgccctcagcgctgcatcccccgtctaccagagatgctttcaagacggcgccattgttaagcagaacccttctaaacaggcggtgaccgaggtatgtcttaaggatgacgtgtcaatgataaaaacagaagctaggtatttccggaatgccactgggacgtacgcaaacaatgtcgccatccgcaagtggctggtgagtgattggcacgactgccgaccgaaaaaggttagcggaggtcatattaacgtgatcgaggtcggcgatgacttgaccttacacacagaggcttatgtgtgtaatgcagattgcactattggggtagacaaggaaaccgcccaggttcgtctgcaaacagataccactaaccattttgaaatcgctggaacaaccgtgaaatccggctggttcaagtctacgacttacataaccctagaccagacatgtgagcacctcaaagtctcgtgcggtccgaagtcaatccagtttcatgcctgtttcaatcagcacatgagctgcgtgagatttctgcacaggactattcttcccgggagtatcgcgtcctctatttgtcaaaacgtggagatcataattctgaccgtcttgacactcctgatcttcattctgctcagcatcttatccaaaacctatatctgctacattctgatgcctatatttatcccacttgcatatatttacggagttatctacaataagtcatgtaagaaatgcaagttgtgcggcctggtgtatcatcccttcacggaatgtggcactcactgcgtatgtggggcccggtacgagacaagtgatcgcatgaaactacatagagctagcggactctgccctggttataagtctctgagggccgcacgggtgatgtgtaaatccaagggcccagcttcaatacttagcattatcaccgccgtcctgatcttgacttttgtgacacccattaacgcgatggttgccggggacacccaggaaacgttcaaactcgaggatctgcctgacgacatgttaagtatggcaatgaaggtgaatatgtactatatcatgtgcatgattaactacgctgtcacctggtctttcatactgtgtgccctccttatcgctctgttgtttaagaaatatcagcaccgcttcctaaatttttacgccatgtactgccacgagtgtgatatgtatcatgaccgatccggactgaagtacaacggcgatttcacaaataaatgcagacagtgtacttgcggtcaatatgaagacgcagccgggctcctgacccacaggaagacatacaactgccttgtgcagtataaaagcaagtggctgactaactttttgattgtatacatcatcctcatgctgattaaggattcggttttaatagtgcatgctgacggaaccgatttcgagaaatgttctggcgaagcggacatcacatggaattgcaccggcccatttctgaacctagggaattgtgagaagaaacagaagaaagaatcctataacaatattgcaactcaactcaagggactggatgccatctcagtccttgacattccgatgatcagtaagatacccgaggatatcgctggtgccttgcggttcattgaggaacagcgtagctaccacgtgcagctgacggcagagtacgccatgctcacacgctattgcgactactatacccagtttactgacaactccggctactctcaaaccacatggagagtctatctgaggagccatgatttcgaggcttgtatcctttaccctaatcagcacttttgccggtgtgtgaaacacggggacaagtgctcaagttccaactgggatttcgccaatgaaatgaaaaactattacagcggaaagcagtctaaatttgacaaggatctgaatttggcactcatgtcactgcatcacgcgttccgaggcaccagtagcttctacattgctaagttactgaaagaaaagaaaaacgaggacctagttacttatgccgagaagatcaaaggtaagtactccgggaatgcactcctgaaagccataattgattatatcaagtacatgaagggccttacagaaatgaacaattttaaacatgacgagatgtgggatgacttcatttttgaagtgccaccccctaagtctccatcggtacgcagattggagagctcctatgatttcaaaacgaacgtcaactcaaatcccagtcacatctgtaagaacataaaaaccgtggtttgcctgtctccaaagagcggagtgtcctacgactcaatcattgcttgtggcgaacctagccagccctctatctataggaagccagattcccaagtctttcagagtaatgccgaccagactcacttctgcctcagcgacacacattgcctggagaactacgagaccgtgggggaagagattatcgatgcaattaaaaagtctaaatgttgggaaacagagtttactgagtacatacagttcaagcaatccgacggagtacggtcatgccgcatgaaagatagtggtgaatgtaccgtgacgaccaatagatggcctatcatcttatgcgacaacgataagttttattacagcgagctgcagaaggactatgataaagaccaggatattggccacttctgtctttcgcccaggtgcaatacaatccgtcatccaattaaccggaagcacatatccaattgtacttggcaggtttctcataacaatatcgacaaaattgaagtccacgagttggaagatctcgagcaatacaagaaagctatcacccagaagctgcagacaagcctaactctgtttaagtattcaaaaaccaagaacctcccccacattaaacctatgtacaagtatatcacgatagaggggacagaaaccgccgagggaatcgaaagtgcgtacattgagtccgaaatcccagccctggctggcacttctattggtttcaaaatcacaagcaagtccgggaaacatcttttggacgtgataggctacgtgaagtcagcaagctatagtgccgtctacaccaagctgtatactaccggaccgacaattggcgttaatacgaaacacgatgagttatgcaccgggccctgtcctgtgaacgtgccacatggaactggttggctcacatttgctaaggagcgaacctcttcctggggctgcgaagagttcgggtgtctggccatcagcgacggatgcgtattcggctcgtgccaagacatcattaaagatgaaataacagtctacagaaaggagactgaagagaccacggacgtggagctttgtctgacatttgcagataaaacctattgcactaatttgaacgcgatcacccccattatcacagaccagttcgaagttcagtttaagactgtggaggcctactcactccctaggattatcgctgtccgcaaccacgaaataatggtgggtcagatcaatgatattggggtttattctaagggctgtggaaacgtgcaaaaagtaaataacaccaattacggcaacggggtcccaaagttcgactacctgtgccatctagccagtcggaaagaggtgatcgtgagaaagtgttttgataatgactatcaggcatgcaaattcctgcagacacccgcttcctacaggctcgaggaagagggaggcagcgtcacggttattgattataagaagatcctgggtaccataaaaatgaaggccattcttggggacgtgaaatacaagacttttgcagataacgtagacttgacagtggaaggagtctgtaccggctgcatcaattgtttcgagaacatccactgcgaactgactattcactctacagtggaggccagctgtccggttgtgtcctcatgcaccgtctttcatgaccgcatcttaataacgcctaatgagcacaaatatgctattaaggtgatctgcaacgaaaagccaggtcccactctccctttcaaaatttgtagtgcgaagaccgatgccgcaatgacactggctgacgccaaacccatccttgagctggccccagttgatcagaccacttacataaaggaaaaagacgagcgatgcaagacatggatgtgtcgggtgcgtgatgaaggctttcaagtcattttcgagcctttcaagaatctatttgggagctatatcggaatcttctacacctttattatctctctcatggctattttcatagtaatctacattgtgctgcccatctgctttaaattgagagacacactgaggcagcatgaggatgcatataagcgcgaaatgaaaatccggtga

SEQ ID NO: 10984 - RNA, 4323 nt, synthetic construct
  misc_feature 1..4323: note = derived and/or modified CDS sequence (opt3) from TAHV(4030)__GQ386836.1__GP
  source 1..4323: mol_type = other RNA
atgatgttcgtgctgtttttcatcgccctcagcgctgcatcccccgtctaccagagatgctttcaagacggcgccattgttaagcagaacccttctaaacaggcggtgaccgaggtatgtcttaaggatgacgtgtcaatgataaaaacagaagctaggtatttccggaatgccactgggacgtacgcaaacaatgtcgccatccgcaagtggctggtgagtgattggcacgactgccgaccgaaaaaggttagcggaggtcatattaacgtgatcgaggtcggcgatgacttgaccttacacacagaggcttatgtgtgtaatgcagattgcactattggggtagacaaggagaccgcccaggttcgtctgcaaacagataccactaaccattttgaaatcgctggaacaaccgtgaaatccggctggttcaagtctacgacttacataaccctagaccagacatgtgagcacctcaaagtctcgtgcggtccaaagtcaatccagtttcatgcctgtttcaatcagcacatgagctgcgtgagatttctgcacaggactattcttcccgggagtatcgcgtcctctatttgtcaaaacgtggagatcataattctgaccgtcttgacactcctgatcttcattctgctcagcatcttatccaaaacctatatctgctacattctgatgcctatatttatcccacttgcatatatttacggagttatctacaataagtcatgtaagaaatgcaagttgtgcggcctggtgtatcatcccttcacggaatgtggcactcactgcgtatgtggggcccggtacgagacaagtgatcgcatgaaactacatagagctagcggactctgccctggttataagtctctgagggccgcacgggtgatgtgtaaatccaagggcccagcttcaatacttagcattatcaccgccgtcctgatcttgacttttgtgacacccattaacgcgatggttgccggggacacccaggaaacgttcaaactcgaggatctgcctgacgacatgttaagtatggcaatgaaggtgaatatgtactatatcatgtgcatgattaactacgctgtcacctggtctttcatactgtgtgccctccttatcgctctgttgtttaagaaatatcagcaccgcttcctaaatttttacgccatgtactgcaacgagtgtgatatgtatcacgaccgatccggactgaagtacaatggcgatttcacaaacaaatgcagacagtgtacttgcggtcaatatgaagacgcagccgggctcctgacccataggaagacatacaactgccttgtgcagtataaaagcaagtggctgactaactttttgattgtatacatcatcctcatgctgattaaggattcggttttaatagtgcacgctgacggaaccgatttcgagaaatgttctggcgaagcggacatcacatggaattgcaccggcccatttctgaatctagggaactgtgagaagaaacagaagaaagaatcctataataacattgcaactcaactcaagggactggatgccatctcagtccttgacattccgatgatcagtaagatacccgaggatatcgctggtgccttgcggttcattgaggaacagcgtagctaccatgtgcagctgacggcagagtacgccatgctcacacgctattgcgactactatacccagtttactgacaattccggctactctcaaaccacatggagagtctatctgaggagccacgatttcgaggcttgtatcctttaccctaaccagcatttttgccggtgtgtgaaacacggggacaagtgctcaagttccaattgggatttcgccaacgaaatgaaaaattattacagcggaaagcagtctaaatttgacaaggatctgaacttggcactcatgtcactgcaccatgcgttccgaggcaccagtagcttctacattgctaagttactgaaagaaaagaaaaatgaggacctaatcacttatgccgagaagataaaaggtaagtacccagggaacgcactcctgaaagccattatcgattatattaagtacatgaaggaccttacagaaatgaataactttaaacacgatgagatgtgggacgatttcatctttgaagttccccctacgaagtccccatctgtgcgcagattggagtcgagctatgacttcaaaaccaacgtaaattccaacccctcacatatatgtaagaatatcaaaactgtcgtgtgcctgagtccgaagtctggcgttagctacgattccattatcgcttgtggagaaccttcacagcccagcatttataggaagccagactctcaagtgtttcagtccaacgccgaccagacacacttctgcctcagtgatacccactgcctggagaattacgagacagtcggcgaagagatcatagacgcaattaaaaagagcaaatgttgggaaactgagtttaccgagtacatccagttcaagcaatctgatggggtgcggtcctgccgcatgaaagactcaggagaatgtacggtaaccacaaacagatggcctatcattttatgcgataatgacaagttttattacagtgagctgcagaaggattatgacaaagatcaggacatcggtcatttctgtcttagccccaggtgcaacactattcgtcacccaataaatcggaagcatatctcgaactgtacctggcaagtgtcccacaataacattgataaaatcgaagttcatgagttggaagacctcgagcagtacaagaaagctattacacagaagctgcagacttctctaaccctgtttaagtatagcaaaacgaagaatctcccccacatcaaacctatgtacaagtatataacaatcgagggcaccgaaactgccgaggggattgaatcagcgtacatcgagagtgaaattccagccctggctggaacatccatcggcttcaaaataacctctaagagcggtaaacaccttttggatgtcattgggtacgtgaagtccgcatcatatagcgccgtgtacactaagctgtataccacaggcccgacgatcggagtcaacaccaaacatgacgagttatgcactggcccctgtcctgttaatgtgccacacgggacaggatggctcacctttgctaaggagcgaacaagttcttggggttgcgaagagttcggctgtctggccatctccgacgggtgcgtgttcggaagctgccaagatattataaaagacgaaatcattgtatacagaaaggagactgaagagaccacggatgtcgagctttgtctgacatttgcagacaaaacctattgcactaacttgaacgcgatcacccccattatcacagatcagttcgaagtgcagtttaagactgttgaggcctactcgctccctaggataatcgctgtgcgcaatcatgaaattatggtcggccagatcaacgacattggtgtgtattcaaaggggtgtggcaatgttcaaaaagtgaacaataccaactacggaaatggcgtaccaaagttcgattacctgtgccacctagcctctcggaaagaggtcatcgtgagaaagtgttttgacaacgattatcaggcatgcaaattcctgcagacacccgctagttacaggctcgaggaagaagggggatccgtgacggtcatagactataagaagattctgggcaccatcaaaatgaaggccatccttggtgatgttaaatacaagacttttgcagacaatgtggacttgacagtagaaggggtgtgtaccggatgcgtcaactgtttcgagaatattcattgcgaactgactatccacagcacagtggaggcctcttgtagcgttgtgtcctcatgcaccgtctttcacgatcgcatattaattacgccgaacgagcataaatatgctatcaaggtgatttgcaatgaaaagcctggcccaactctccccttcaaaatctgtagtgcgaagaccgacgccgcaatgacactggctgatgccaaacctatacttgagctggcccccgttgaccagaccacttacattaaggaaaaagatgagcgatgcaagacatggatgtgtcgggtgcgtgacgaaggttttcaagtcatcttcgagccattcaagaacctatttggcagctatatcgggattttctacacctttatcatttctctcatggctatattcatcgtaatttacatcgtgctgcctatctgctttaaattgagagatacactgaggcagcacgaggacgcatataagcgcgaaatgaaaattcggtga

SEQ ID NO: 10985 - RNA, 4323 nt, synthetic construct
  misc_feature 1..4323: note = derived and/or modified CDS sequence (opt3) from TAHV(4033)__GQ386837.1__GP
  source 1..4323: mol_type = other RNA
atgatgttcgtgctgtttttcatcgccctcagcgctgcatcccccgtctaccagagatgctttcaagacggcgccattgttaagcagaacccttctaaacaggcggtgaccgaggtatgtcttaaggatgacgtgtcaatgataaaaacagaagctaggtatttccggaatgccactgggacgtacgcaaacaatgtcgccatccgcaagtggctggtgagtgattggcacgactgccgaccgaaaaaggttagcggaggtcatattaacgtgatcgaggtcggcgatgacttgaccttacacacagaggcttatgtgtgtaatgcagattgcactattggggtagacaaggaaaccgcccaggttcgtctgcaaacagataccactaaccattttgaaatcgctggaacaaccgtgaaatccggctggttcaagtctacgacttacataaccctagaccagacatgtgagcacctcaaagtctcgtgcggtccgaagtcaatccagtttcatgcctgtttcaatcagcacatgagctgcgtgagatttctgcacaggactattcttcccgggagtatcgcgtcctctatttgtcaaaacgtggagatcataattctgaccgtcttgacactcctgatcttcattctgctcagcatcttatccaaaacctatatctgctacattctgatgcctatatttatcccacttgcatatatttacggagttatctacaataagtcatgtaagaaatgcaagttgtgcggcctggtgtatcatcccttcacggaatgtggcactcactgcgtatgtggggcccggtacgagacaagtgatcgcatgaaactacatagagctagcggactctgccctggttataagtctctgagggccgcacgggtgatgtgtaaatccaagggcccagcttcaatacttagcattatcaccgccgtcctgatcttgacttttgtgacacccattaacgcgatggttgccggggacacccaggaaacgttcaaactcgaggatctgcctgacgacatgttaagtatggcaatgaaggtgaatatgtactatatcatgtgcatgattaactacgctgtcacctggtctttcatactgtgtgccctccttatcgctctgttgtttaagaaatatcagcacggattcctaaatttttacgccatgtactgccacgagtgtgatatgtatcatgaccgctccggcctgaagtacaacggtgatttcacaaataaatgccgacagtgtacttgcgggcaatatgaagacgcagccggactcctgacccacagaaagacatacaactgccttgtgcagtataaaagcaagtggctgactaactttttgattgtatacatcatcctcatgctgattaaggattcggttttaatagtgcatgctgacggcaccgatttcgagaaatgttctggcgaagcggacatcacatggaattgcaccgggccatttctgtccctaggaaactgtgagaagaaacagaagaaagaatcatataataacattgcaactcaactcaagggtctggatgccatcagtgtccttgacattccgatgatcagcaagatacccgaggatatcgctggcgccttgaggttcattgaggaacagcggtcctaccacgtgcagctgacggcagagtacgccatgctcacacgttattgcgactactatacccagtttactgacaattctgggtacagccaaaccacatggcgcgtctatctgagatcacatgatttcgaggcttgtatcctttaccctaaccagcacttttgtaggtgcgtgaaacacggagacaagtgcagttccagcaattgggatttcgccaacgaaatgaaaaattattactctggcaagcagtcaaaatttgacaaggatctgaacttggcactcatgagtctgcatcacgcgttccggggtaccagctccttctacattgctaagttactgaaagaaaagaaaaatgaggacctagttacttatgccgagaagatcaaagggaagtacccaggcaacgcactcctgaaagccataattgattatatcaagtacatgaaggaccttacagaaatgaataactttaaacatgatgagatgtgggacgatttcatttttgaagtgccccctacgaagtctccatcggtacgacgcttggagagctcctatgacttcaaaaccaatgtcaactcaaaccccagtcacatctgtaagaatataaaaactgtggtttgcctgtctccaaagagcggagtgtcctacgattcaatcattgcttgtggcgaacctagccagccctctatctatagaaagccagactcccaagtctttcagagtaacgccgaccagacacacttctgcctcagcgatacccattgcctggagaattacgagacagtgggggaagagattatcgacgcaattaaaaagtctaaatgttgggaaactgagtttaccgagtacatacagttcaagcaatccgatggagtaaggtcatgccggatgaaagacagtggtgaatgtacggtgaccacaaaccgctggcctatcatcttatgcgataatgacaagttttattacagcgagctgcagaaggattatgacaaagatcaggacattggccacttctgtctttcgcccagatgcaacactatcaggcatccaattaatcgtaagcacatatccaactgtacctggcaggtttctcataataacatcgataaaattgaagtccacgagttggaagacctcgagcaatacaagaaagctatcacacagaagctgcagactagcctaaccctgtttaagtattcaaaaacgaagaatctcccccacattaaacctatgtacaagtatatcacaatagaggggaccgaaactgccgagggaatcgaaagtgcgtacattgagtccgaaatcccagccctggctggcacatctattggtttcaaaatcaccagcaagtccgggaaacatcttttggatgtgataggctacgtgaagtcagcaagctatagtgccgtctacactaagctgtataccacaggaccgacgattggcgttaacaccaaacacgacgagttatgcactgggccctgtcctgtgaatgtgccacatggaacaggttggctcacctttgctaaggagcggacatcttcctggggctgcgaagagttcgggtgtctggccatcagcgacggatgcgtattcggctcgtgccaagatatcattaaagacgaaataactgtctaccgaaaggagaccgaagagacgacagatgtggagctttgtctgacctttgcagacaaaacttattgcaccaacttgaatgcgatcacacccattatcactgatcagttcgaagttcagtttaagaccgtggaggcctactcactccctagaattatcgctgtcaggaaccacgaaataatggtgggtcagatcaacgacattggggtttattctaagggctgtggaaatgtgcaaaaagtaaacaatacaaactacggcaatggggtcccaaagttcgattacctgtgccatctagccagtcgcaaagaggtgatcgtgcggaagtgttttgacaacgattatcaggcatgcaaattcctgcagacgcccgcttcctacagactcgaggaagagggaggcagcgtcaccgttattgactataagaagatcctgggtactataaaaatgaaggccattcttggggatgtgaaatacaagacatttgcagacaatgtagacttgaccgtggaaggagtctgtactggctgcatcaactgtttcgagaatatccactgcgaactgacaattcactctaccgtggaggccagctgtccggttgtgtcctcatgcacggtctttcatgataggatcttaataactcctaacgagcacaaatatgctattaaggtgatctgcaatgaaaagccaggtcccaccctccctttcaaaatttgtagtgcgaagacagacgccgcaatgaccctggctgatgccaaacccatccttgagctggccccagttgaccagactacatacataaaggaaaaagatgagcgctgcaagacctggatgtgtcgagtgcgggacgaaggctttcaagtcattttcgagcctttcaagaacctatttgggagctatatcggaatcttctacacatttattatctctctcatggctattttcatagtaatctacattgtgctgcccatctgctttaaattgcgtgatactctgagacagcatgaggacgcatataagagggaaatgaaaatccgctga

SEQ ID NO: 10986 - RNA, 4323 nt, synthetic construct
  misc_feature 1..4323: note = derived and/or modified CDS sequence (opt3) from TAHV(4034)__GQ386838.1__GP
  source 1..4323: mol_type = other RNA
atgatgttcgtgctgtttttcatcgccctcagcgctgcatcccccgtctaccagagatgctttcaagacggcgccattgttaagcagaacccttctaaacaggcggtgaccgaggtatgtcttaaggatgacgtgtcaatgataaaaacagaagctaggtatttccggaatgccactgggacgtacgcaaacaatgtcgccatccgcaagtggctggtgagtgattggcacgactgccgaccaaagaaggttagcggaggtcatattaacgtgatcgaggtcggcgatgacttgaccttacacacagaggcttatgtgtgtaatgcagattgcactattggggtagacaaggagaccgcccaggttcgtctgcaaacagataccactaaccattttgaaatcgctggaacaaccgtgaaatccggctggttcaagtctacgacttacataaccctagaccagacatgtgagcacctcaaagtctcgtgcggtccgaagtcaatccagtttcatgcctgtttcaatcagcacatgagctgcgtgagatttctgcacaggactattcttcccgggagtatcgcgtcctctatttgtcaaaacgtggagatcataattctgaccgtcttgacactcctgatcttcattctgctcagcatcttatccaaaacctatatctgctacacgctgatgcctatttttataccacttgcatatatctacggagttatttacaataagtcatgtaagaaatgcaagttgtgcggcctggtgtatcatcccttcactgaatgtggcacacactgcgtatgtggggcccggtacgagaccagtgatcgcatgaaactacatagagctagcggactctgccctggttataagtctctgagggccgcacgggtgatgtgtaaatccaagggcccagcttcaatccttagcataattactgccgtcctgatcttgacatttgtgacccccatcaacgcgatggttgccggggacacgcaggaaaccttcaaactcgaggatctgcctgacgacatgttaagtatggcaatgaaggtgaatatgtactatattatgtgcatgatcaactacgctgtcacatggtctttcattctgtgtgccctccttatagctctgttgtttaagaaatatcagcaccgcttcctaaatttttacgccatgtactgccacgagtgtgatatgtatcatgaccgatccggactgaagtacaacggcgatttcactaataaatgcagacagtgtacctgcggtcaatatgaagacgcagccgggctcctgacacacaggaagacttacaactgccttgtgcagtataaaagcaagtggctgaccaactttttgatcgtatacattatcctcatgctgatcaaggattcgattttaatagttcatgctgacggaacagatttcgagaaatgttctggcgaagcggacatcacctggaattgcactggcccatttctgaacctagggaattgtgagaagaaacagaagaaagaatcctataacaatattgcaacgcaactcaagggactggatgccatctcagtgcttgacattccgatgatcagtaagatacccgaggatatcgctggtgccttgcggttcattgaggaacagcgtagctaccacgtccagctgacagcagagtacgccatgctcacccgctgctgtgactattacactcagtttaccgacaactccggctattctcaaacaacctggagagtgtacctgaggagccatgatttcgaggcttgcatcctttatcctaatcagcacttttgtcggtgcgtcaaacacgggaacaagtgttcaagttccaattgggacttcgccaacgaaatgaaaaattactatagcggaaagcagtctaaatttgataaggacctgaacttggcactcatgtcactgcatcacgcgttccgaggcacaagtagcttctacattgctaagttactgaaagaaaagaaaaatgaggatctagtgacttacgccgagaagatcaaaggtaagtatccagggaacgcactcctgaaagccataattgactacatcaagtatatgaaggatcttacggaaatgaataactttaaacatgacgagatgtgggatgacttcatttttgaagttccccctaccaagtccccatctgtgcgcagattggagtcgagctacgatttcaaaactaacgtaaattccaacccctcacacatctgcaagaatataaaaacagtcgtgtgtctgagtccgaagtctggcgttagctatgactccatcattgcttgcggagaaccttcacagcccagcatctacaggaagccagattctcaagtgtttcagtccaacaccgaccagacacacttctgcctcagtgacactcattgtctggagaattatgaggccgtcggcgaagagattatcgatgcaattaaaaagagcaaatgctgggaaaccgagtttacggagtacatacagttcaagcaatctgacggggtgcggtcctgtcgcatgaaagattcaggagaatgcaccgtaacaactaacagatggcctatcatcttatgtgacaatgataagttttactatagtgagctgcagaaggactacgataaagaccaggatattggtcacttctgccttagccccaggtgtaacaccatccgtcatccaattaatcggaagcacatatcgaactgcacatggcaagtgaatcataacaatatcgacaaaattgaagttcacgagttggaagatctcgagcagtataagaaagctatcactcagaagctgcagacctccctaacgctgtttaagtactctaaaacaaagaacctcccccacattaaacctatgtataagtacatcaccatagagggcactgaaacagccgaggggatcgaaagcgcgtatattgagtcagaaatcccagccctggctggaaccagtattggcttcaaaatcacttccaagtctggtaaacatcttttggacgtcatagggtacgtgaaaagcgcatcctactcagccgtgtataccaagctgtacacaacgggcccgaccattggagtcaatactaaacacgatgagttatgtacaggcccctgccctgttaacgtgccacatgggaccggatggctcacatttgctaaggagcgaactagcagttggggttgtgaagagttcggctgcctggccatctctgacgggtgcgtgttcggatcctgtcaagacatcattaaagatgaaataaccgtatatagaaaggagacggaagagacaaccgacgtcgagctttgcctgacttttgcagataaaacctactgtacaaacttgaatgcgatcactcccattatcaccgaccagttcgaagtgcagtttaagacagttgaggcctatagcctccctaggattatcgctgtgcgcaaccacgaaataatggtcggccagatcaatgatattggtgtgtactcgaaggggtgcggcaacgttcaaaaagtgaataacacgaattatggaaacggcgtaccaaagttcgactacctgtgtcatctagcctcacggaaagaggtcatcgtgagaaagtgctttgataatgactaccaggcatgtaaattcctgcagattcccgcttcttataggctcgaggaagaagggggaagtgtgaccgtcatcgattacaagaagatactgggcactattaaaatgaaggccatccttggtgacgttaaatataagacatttgcagataacgtggacttgaccgtagaaggggtgtgcactggatgtatcaattgcttcgagaacattcactgtgaactgacaatccactccaccgtcgaggccagctgcccggtggtttctagctgcacggtgtttcatgaccgcatattaattactcctaatgagcacaaatacgctatcaaggtcatttgtaacgaaaagccaggccccaccctccctttcaaaatctgctccgcgaagacagatgccgcaatgaccctggctgacgccaaacccatacttgagctggccccagtggatcagactacatatattaaggaaaaagacgagcgatgtaagacctggatgtgccgggttcgtgatgaaggttttcaagtgatcttcgagcctttcaagaatctatttggctcatacatcgggattttctatacatttatcattagtctcatggctatattcatcgtcatttacatcgtactgcccatctgttttaaattgagagacactctgaggcagcatgaggatgcatacaagcgcgaaatgaaaattcggtga

SEQ ID NO: 10987 - RNA, 4323 nt, synthetic construct
  misc_feature 1..4323: note = derived and/or modified CDS sequence (opt3) from TAHV(4057)__GQ386839.1__GP
  source 1..4323: mol_type = other RNA
atgatgttcgtgctgtttttcatcgccctcagcgctgcatcccccgtctaccagagatgctttcaagacggcgccattgttaagcagaacccttctaaacaggcggtgaccgaggtatgtcttaaggatgacgtgtcaatgataaaaacagaagctaggtatttccggaatgccactgggacgtacgcaaacaatgtcgccatccgcaagtggctggtgagtgattggcacgactgccgaccgaaaaaggttagcggaggtcatattaacgtgatcgaggtcggcgatgacttgaccttacacacagaggcttatgtgtgtaatgcagattgcactattggggtagacaaggaaaccgcccaggttcgtctgcaaacagataccactaaccattttgaaatcgctggaacaaccgtgaaatccggctggttcaagtctacgacttacataaccctagaccagacatgtgagcacctcaaaggttcgtgcgggccaaagtcaatccagtttcatgcctgtttcaatcagcacatgagctgcgtcagatttctgcacaggactattcttcccggaagtatcgcgtcctctatttgtcaaaacgtggagatcataattctgaccgtgttgacactcctgatcttcattctgctcagcatcttatccaaaacctatatctgctacattctgatgcctatatttatcccacttgcatatatttacggcgtcatctacaataagtcatgtaagaaatgcaagttgtgcggcctggtttatcatcccttcacggaatgtgggactcactgcgtgtgtggagcccggtacgagacaagtgatcgcatgaaactacatagagctagcggtctctgccctggctataagtctctgagggccgcacgggtaatgtgtaaatccaaggggccagcttcaatacttagcattatcaccgccgtgctgatcttgacttttgtcacacccattaacgcgatggtggccggagacacccaggaaacgttcaaactcgaggatctgcctgacgacatgttaagtatggcaatgaaggttaatatgtactatatcatgtgcattataaactacgctgtgacctggtctttcatcctgtgtgccctccttattgctctgttgtttaagaaatatcagcaccgcttcctaaatttttacgccatgtactgccacgagtgtgatatgtatcatgaccgatccggcctgaagtacaacggtgatttcacaaataaatgcagacagtgtacttgcgggcaatatgaagacgcagccggactcctgacccacaggaagacatacaactgccttgtccagtataaaagcaagtggctgactaactttttgatcgtgtacatcattctcatgctgataaaggattcggtattaatcgttcatgctgacggcaccgatttcgagaaatgttctggcgaagcggacattacatggaattgcaccgggccatttctgaacctaggaaattgtgagaagaaacagaagaaagaatcctataacaatatcgcaactcaactcaagggtctggatgccatttcagtgcttgacatcccgatgataagtaagatccccgaggatattgctggcgccttgcggttcatcgaggaacagcgtagctaccacgtccagctgacggcagagtacgccatgctcacacgctattgcgactactatacccagtttactgacaactccgggtactctcaaaccacatggagagtgtatctgaggagccatgatttcgaggcttgtattctttaccctaatcagcacttttgccggtgtgtcaaacacggagacaagtgctcaagttccaactgggatttcgccaatgaaatgaaaaactattacagcggcaagcagtctaaatttgacaaggatctgaatttggcactcatgtcactgcatcacgcgttccgaggtaccagtagcttctacatcgctaagttactgaaagaaaagaaaaacggggacctagtgacttatgccgagaagataaaaggcaagtacccaggaaatgcactcctgaaagccattatcgattatattaagtacatgaaggaccttacagagatgaacaattttaaacatgatgaaatgtgggacgatttcatctttgaggttccccctacgaagtccccatctgtgcgcagattggaatcgagctatgacttcaaaaccaacgtaaactccaatccctcacacatatgtaagaacatcaaaactgtcgtgtgcctgagtccgaagtctggcgttagctacgattccattatcgcttgtggggagccttcacagcccagcatttataggaagccagactctcaagtgtttcagtccaatgccgaccagacacacttctgcctcagtgatacccattgcctggaaaactacgagacagtcggagaggaaatcatagacgcaattaaaaagagcaaatgttgggagactgaatttaccgagtacatccagttcaagcaatctgatggtgtgcggtcctgccgcatgaaagactcaggcgagtgtacggtaaccacaaataagtggcctatcattttatgcgataacgacaagttttattacagtgaactgcagaaagattatgacaaggatcaggacatcgggcacttctgtcttagccccagatgcaatactattaggcatccaataaaccgtaaacacatctcgaattgtacctggcaagtgtcccataacaatattgataagatcgaggttcacgaattggaggacctcgaacagtacaaaaaggctattacacagaagctgcagacttctctaaccctgtttaaatatagcaagacgaaaaacctcccccacatcaagcctatgtacaaatatataacaatcgagggaaccgagactgccgaaggcattgagtcagcgtacatcgaaagtgagattccagccctggctggtacatccatcgggttcaagataacctctaaaagcggccggcatcttttggatgtcattggatacgtgaagtccgcatcatatagcgccgtgtacactaagctgtataccacaggcccgacgatcggggtcaataccaaacacgacgaattatgcactggaccctgtcctgttaacgtgccacatggtacaggctggctcacctttgctaaggagcgaacaagttcttgggggtgcgaggagttcggatgtctggccatctccgacggctgcgtgttcggtagctgccaagatattataaaagacgaaatcactgtatacagaaaggaaaccgaggaaacgacagatgtcgagctttgtctgacctttgcagacaaaacttattgcaccaatttgaacgcgattacacccatcattactgatcagttcgaggtgcagtttaagaccgttgaagcctactcgctccctaggatcatagctgtgcgcaaccacgagatcatggtcgggcagattaatgacatcggcgtgtattcaaagggatgtggcaacgttcaaaaagtgaataacacaaattacgggaacggagtaccaaagttcgattacctgtgccatctagcctctcggaaagaagtcattgtgagaaagtgttttgacaatgattatcaggcatgcaaattcctgcagacgcccgctagttacaggctcgaggaggaaggcggttccgtgaccgtcatcgactataagaagatactggggactattaaaatgaaggccatccttggagatgttaaatacaagacatttgcagacaacgtggacttgaccgtagagggcgtgtgtactggttgcgtcaattgtttcgaaaacatccactgcgagagcacaattcactctaccgtggaagccagctgtccggttgtgtcctcatgcacggtctttcatgatcgcatcctgataactcctaatgagcacaaatatgctattaaggtgatctgcaacgagaagccaggccccaccttacctttcaaaatttgtagtgcgaagacagacgccgcaatgaccctcgctgatgccaaacccatcctggaacttgccccagttgaccagactacatacataaaggagaaagatgaacgatgcaagacctggatgtgtcgggtgcgtgacgaggggtttcaagtcattttcgaacctttcaagaatctgtttggaagctatatcggcatcttctacacatttattatctctctaatggctattttcatagtaatctacattgtgctccccatctgctttaaactgagagatactttgaggcagcatgaggacgcatataagcgcgagatgaaaatccggtga

SEQ ID NO: 10988 - RNA, 4323 nt, synthetic construct
  misc_feature 1..4323: note = derived and/or modified CDS sequence (opt3) from TAHV(4060)__GQ386840.1__GP
  source 1..4323: mol_type = other RNA
atgatgttcgtgctgtttttcatcgccctcagcgctgcatcccccgtctaccagagatgctttcaagacggcgccattgttaagcagaacccttctaaacaggcggtgaccgaggtatgtcttaaggatgacgtgtcaatgataaaaacagaagctaggtatttccggaatgccactgggacgtacgcaaacaatgtcgccatccgcaagtggctggtgagtgattggcacgactgccgaccgaaaaaggttagcggaggtcatattaacgtgatcgaggtcggcgatgacttgaccttacacacagaggcttatgtgtgtaatgcagattgcactattggggtagacaaggagaccgcccaggttcgtctgcaaacagataccactaaccattttgaaatcgctggaacaaccgtgaaatccggctggttcaagtctacgacttacataaccctagaccagacatgtgagcacctcaaagtctcgtgcggtccaaagtcaatccagtttcatgcctgtttcaatcagcacatgagctgcgtgagatttctgcacaggactattcttcccgggagtatcgcgtcctctatttgtcaaaacgtggagatcataattctgaccgtcttgacactcctgatcttcattctgctcagcatcttatccaaaacctatatctgctacattctgatgcctatatttatcccacttgcatatatttacggagttatctacaataagtcatgtaagaaatgcaagttgtgcggcctggtgtatcatcccttcacggaatgtggcactcactgcgtatgtggggcccggtacgagacaagtgatcgcatgaaactacatagagctagcggactctgccctggttataagtctctgagggccgcacgggtgatgtgtaaatccaagggcccagcttcaatacttagcattatcaccgccatcctgattttgacttttgtcacacccatcaacgcgatggtggccggggacacccaggaaacgttcaaactcgaggatctgcctgacgacatgttaagtatggcaatgaaggttaatatgtactatattatgtgcatgataaactacgctgtgacctggtctttcatcctgtgtgccctccttattgctctgttgtttaagaaatatcagcaccgcttcctaaatttttacgccatgtactgccacgagtgtgatatgtatcatgaccgatccggactgaagtacaacggcgatttcacaaataaatgcagacagtgtacttgcggtcaatatgaagacgcagccgggctccagacccacaggaagacatacaactgcctggtccagtataaaagcaagtggcttactaactttctgatcgtgtacatcattttgatgctcataaaggattcggtactgatcgttcatgctgacggaaccgatttcgagaaatgttctggcgaagcggacattacatggaattgcaccggcccatttttaaacctggggaattgtgagaagaaacaaaagaaagaatcctataacaatatcgcaactcagctaaagggactcgatgccatttcagtgctggacatcccgatgataagtaagatccccgaggatattgctggtgcccttcggttcatcgaggaacagcgtagctaccacgtccagttgacggcagagtacgccatgctgacacgctattgcgactactatacccaatttactgacaactccggctactctcagaccacatggagagtgtatctcaggagccatgatttcgaggcttgtattctgtaccctaatcagcacttttgccggtgtgtcaaacacggggacaagtgctcaagttccaactgggatttcgccaatgaaatgaaaaactattacagcggaaagcagtctaaatttgacaaggatcttaatctggcattgatgtcactccatcacgcgttccgaggcaccagtagcttctacatcgctaagctgttaaaagaaaagaaaaacgaggacctggtgacttatgccgagaagataaaaggtaagtacccagggaatgcactactcaaagccattatcgattatattaagtacatgaaggacctgacagaaatgaacaattttaaacatgatgagatgtgggacgatttcatctttgaagttccccctacgaagtccccatctgtgcgcagacttgagtcgagctatgacttcaaaaccaacgtaaactccaatccctcacacatatgtaagaacatcaaaactgtcgtgtgcttgagtccgaagtctggcgttagctacgattccattatcgcttgtggagaaccttcacaacccagcatttataggaagccagactctcaggtgtttcagtccaatgccgaccagacacacttctgcctgagtgatacccattgcctcgagaactacgagacagtcggcgaagagatcatagacgcaattaaaaagagcaaatgttgggaaactgagtttaccgagtacacgcaattcaagcagtctgatggggtgcggtcctgccgcatgaaagactcaggagaatgtaccgtaacaactaatagatggcctatcatcctgtgcgataacgacaagttttattacagtgagttacagaaggattatgacaaagatcaggacattggtcacttctgtctgagccccaggtgcaataccatccgtcatccaattaaccggaagcacatatcgaattgtacatggcaagtgtcccataacaatatcgataaaattgaagttcacgagcttgaagacttggagcagtacaagaaagctatcactcagaagctccaaacctctctgacgctatttaagtatagcaaaacaaagaacctgccccacattaaacctatgtacaagtatatcaccatagagggcactgaaacagccgaggggatcgaatcagcgtacattgagagtgaaatcccagccctcgctggaacctccattggcttcaaaatcacttctaagagcggtaaacatctgcttgatgtcatagggtacgtgaagtccgcatcatatagcgccgtgtacaccaagttgtatacaacgggcccgaccattggagtcaatactaaacacgacgagctgtgcacaggcccctgtcctgttaacgtgccacatgggaccggatggttaacatttgctaaggagcgaaccagttcttggggttgcgaagagttcggctgtctcgccatctccgacgggtgcgtgttcggaagctgccaggatatcattaaagacgaaataactgtatacagaaaggagacggaagagacaaccgatgtcgagctgtgtcttacttttgcagacaaaacctattgcacaaatctgaacgcgatcactcccattatcaccgatcagttcgaagtgcagtttaagacagttgaggcctactcgttgcctaggattatcgctgtgcgcaaccacgaaataatggtcggccaaatcaatgacattggtgtgtattcaaaggggtgtggcaacgttcagaaagtgaataacacgaattacggaaacggcgtaccaaagttcgattacctctgccatctggcctctcggaaagaggtcatcgtgagaaagtgttttgacaatgattatcaggcatgcaaattcctacagacccccgctagttacaggctggaggaagaagggggatccgtgactgtcattgactataagaagatcctcggcacaataaaaatgaaggccattctgggtgatgttaaatacaagacctttgcagacaacgtggaccttactgtagaaggggtgtgtacaggatgcatcaattgtttcgagaacatccactgcgaattgaccattcacagcacggtcgaggcctcttgtccggtggttagctcctgcactgtgtttcatgatcgcatcctgataacccctaatgagcacaaatatgctattaaggtcatctgcaacgaaaagccaggccccacattacctttcaaaatttgttcagcgaagaccgacgccgcaatgactctcgctgatgccaaacccatcctggagcttgccccagtggaccaaacaacctacataaaggaaaaagatgagcgatgcaagacatggatgtgtcgggttcgtgacgaaggttttcaggtgattttcgagcctttcaagaatctgtttggcagttatatcgggatcttctacacttttattatcagcctaattgctatattcatcgtcatttacatcgtactccccatctgctttaaactgagagataccttgaggcagcatgaggacgcatataagcgcgaaatgaaaattcggtga

SEQ ID NO: 10989 - RNA, 4323 nt, synthetic construct
  misc_feature 1..4323: note = derived and/or modified CDS sequence (opt3) from TAHV(5060)__GQ386841.1__GP
  source 1..4323: mol_type = other RNA
atgatgttcgtgctgtttttcatcgccctcagcgctgcatcccccgtctaccagagatgctttcaagacggcgccattgttaagcagaacccttctaaacaggcggtgaccgaggtatgtcttaaggatgacgtgtcaatgataaaaacagaagctaggtatttccggaatgccactgggacgtacgcaaacaatgtcgccatccgcaagtggctggtgagtgattggcacgactgccgaccaaagaaggttagcggaggtcatattaacgtgatcgaggtcggcgatgacttgaccttacacacagaggcttatgtgtgtaatgcagattgcactattggggtagacaaggaaaccgcccaggttcgtctgcaaacagataccactaaccattttgaaatcgctggaacaaccgtgaaatccggctggttcaagtctacgacttacataaccctagaccagacatgtgagcacctcaaagtctcgtgcggtccgaagtcaatccagtttcatgcctgtttcaatcagcacatgagctgcgtgagatttctgcacaggactattcttcccgggagtatcgcgtcctctatttgtcaaaacgtggagatcataattctgaccgtcttgacactcctgatcttcattctgctcagcatcttatccaaaacctatatctgctacattctgatgcctatatttatcccacttgcatatatttacggagttatctacaataagtcatgtaagaaatgcaagttgtgcggcctggtgtatcatcccttcacggaatgtggcactcactgcgtatgtggggcccggtacgagacaagtgatcgcatgaaactacatagagctagcggactctgccctggttataagtctctgagggccgcacgggtgatgtgtaaatccaagggcccagcttcaatacttagcattatcaccgccgtcctgatcttgacttttgtgacacccattaacgcgatggttgccggggacacccaggaaacgttcaaactcgaggatctgcctgacgacatgttaagtatggcaatgaaggtgaatatgtactatatcatgtgcattataaactacgctgtcacctggtctttcatcctgtgtgccctccttattgctctgttgtttaagaaatatcagcaccgcttcctaaatttttacgccatgtactgccacgagtgtgatatgtatcatgaccgatccggactgaagtacaacggcgatttcacaaataaatgcagacagtgtacttgcggtcaatatgaagacgcagccgggctcctgacccacaggaagacatacaactgccttgtgcagtataaaagcaagtggctgactaactttttgatcgtatacatcattctcatgctgataaaggattcggttttaatcgtgcatgctgacggaaccgatttcgagaaatgttctggcgaagcggacattacatggaattgcaccggcccatttctgaacctagggaattgtgagaagaaacagaagaaagaatcctataacaatatcgcaactcaactcaagggactggatgccatttcagtccttgacatcccgatgataagtaagatccccgaggatattgctggtgccttgcggttcatcgaggaacagcgtagctaccacgtgcagctgacggcagagtacgccatgctcacacgctattgcgactactatacccagtttactgacaactccggctactctcaaaccacatggagagtctatctgaggagccatgatttcgaggcttgtattctttaccctaatcagcacttttgccggtgtgtgaaacacggggacaagtgctcaagttccaactgggatttcgccaatgaaatgaaaaactattacagcggaaagcagtctaaatttgacaaggatctgaatttggcactcatgtcactgcatcacgcgttccgaggcaccagtagcttctacatcgctaagttactgaaagaaaagaaaaacggtgacctagttacttatgccgagaagataaaagggaagtacccaggcaatgcactcctgaaagccattatcgattatattaagtacatgaaggaccttacagagatgaacaattttaaacatgatgaaatgtgggacgatttcatctttgaggtgtcccccacgaagtctccttcggtacgcagattggaaagctcctatgacttcaaaaccaacgtcaactcaaatccaagtcacatatgtaagaacatcaaaactgtggtttgcctgtctcccaagagcggagtgtcctacgattcaattatcgcttgtggcgagccgagccagccttctatttataggaagcccgactcccaagtctttcagagtaatgccgaccagacacacttctgcctcagcgatacccattgcctggaaaactacgagacagtgggggaggaaatcatagacgcaattaaaaagtctaaatgttgggagactgaatttaccgagtacatccagttcaagcaatccgatggagtacggtcatgccgcatgaaagacagtggtgagtgtacggtgaccacaaataagtggccaatcattttatgcgataacgacaagttttattacagcgaactgcagaaagattatgacaaggatcaggacatcggccacttctgtctttcgcctagatgcaatactattaggcatcccataaaccgtaaacacatctccaattgtacctggcaggtttctcatagcaacattgataagatcgaggtccacgaattggaggacctcgaacaatacaaaaaggctattacacagaagctgcagacttcactaaccctgtttaaatatagtaagacgaaaaatctcccacacatcaagcccatatacaaatatatcacaattgaggggaccgagactgccgaaggaatcgagtccgcgtacattgaatctgagatccctgccctggctggcacaagcataggtttcaagattacctccaaatcagggaagcatcttttggatgtgatcggctacgtgaaaagcgcaagttattctgccgtctacactaaactgtataccacaggaccaacgatcggcgttaacaccaagcacgacgaattatgcactgggccgtgtcccgtgaatgtgcctcatggaacaggttggctcacctttgctaaagagcggacatccagctggggctgcgaggagttcgggtgtctggccatttcggacggatgcgtattcggctcatgccaagatataatcaaggacgaaattactgtctaccgaaaagaaaccgaggaaacgacagatgtggagctttgtctgacctttgcagacaagacttattgcaccaacttgaatgcgatcacaccaattatcactgatcagttcgaggttcagtttaagaccgtggaagcctactctctccccagaataatcgctgtcaggaaccacgagattatggtgggtcagatcaacgacattggggtttatagtaaaggctgtggaaatgtgcaaaaggtaaacaatacaaactacggcaatggggtccctaaattcgattacctgtgccatctagcctcccgcaaggaagtgatcgtgcggaaatgttttgacaacgattatcaggcatgcaagttcctgcagacgccagctagctacagactcgaggaggaaggaggctctgtcaccgttatagactataagaaaattctgggtactatcaagatgaaagccatccttggggatgtgaagtacaaaacatttgcagacaatgtagacttgaccgtggagggagtctgtactggctgcattaactgtttcgaaaatatccactgcgagctgacaatacacagcaccgtggaagcctcctgtcccgttgtgtcaagttgcacggtctttcatgataggattttaatcactccgaacgagcacaagtatgctattaaggtgatctgcaatgagaaacctggtccaaccctccccttcaagatatgtagcgcgaaaacagacgccgcaatgaccctggctgatgccaagcctattcttgaactggcccccgttgaccagactacatacatcaaagagaaggatgaacgctgcaagacctggatgtgtcgagtgcgggacgagggctttcaagtcatcttcgaaccattcaaaaacctatttgggtcttatattggaatcttctacacatttattatatccctcatggctatcttcattgtaatctacatcgtgctgcctatttgctttaagttgcgtgatactctgagacagcatgaggacgcatataaaagggagatgaagatacgctga

SEQ ID NO: 10990 - RNA, 4323 nt, synthetic construct
  misc_feature 1..4323: note = derived and/or modified CDS sequence (opt3) from TAHV(76)__GQ386824.1__GP
  source 1..4323: mol_type = other RNA
atgatgttcgtgctgtttttcatcgccctcagcgctgcatcccccgtctaccagagatgctttcaagacggcgccattgttaagcagaacccttctaaacaggcggtgaccgaggtatgtcttaaggatgacgtgtcaatgataaaaacagaagctaggtatttccggaatgccactgggacgtacgcaaacaatgtcgccatccgcaagtggctggtgagtgattggcacgactgccgaccgaaaaaggttagcggaggtcatattaacgtgatcgaggtcggcgatgacttgaccttacacacagaggcttatgtgtgtaatgcagattgcactattggggtagacaaggaaaccgcccaggttcgtctgcaaacagataccactaaccattttgaaatcgctggaacaaccgtgaaatccggctggttcaagtctacgacttacataaccctagaccagacatgtgagcacctcaaagtctcgtgcggtccaaagtcaatccagtttcatgcctgtttcaatcagcacatgagctgcgtgagatttctgcacaggactattcttcccgggagtatcgcgtcctctatttgtcaaaacgtggagatcataattctgaccgtcttgacactcctgatcttcattctgctcagcatcttatccaaaacctatatctgctacattctgatgcctatatttatcccacttgcatatatttacggagttatctacaataagtcatgtaagaaatgcaagttgtgcggcctggtgtatcatcccttcacggaatgtggcactcactgcgtatgtggggcccggtacgagacaagtgatcgcatgaaactacatagagctagcggactctgccctggttataagtctctgagggccgcacgggtgatgtgtaaatccaagggcccagcttcaatacttagcattatcaccgccgtcctgatcttgacttttgtgacacccattaacgcgatggttgccggggacacccaggaaacgttcaaactcgaggatctgcctgacgacatgttaagtatggcaatgaaggtgaatatgtactatatcatgtgcatgattaactacgctgtcacctggtctttcatactgtgtgccctccttatcgctctgttgtttaagaaatatcagcaccgcttcctaaatttttacgccatgtactgccacgagtgtgatatgtatcatgaccgatccggactgaagtacaacggcgatttcacaaataaatgcagacagtgtacttgcggtcaatatggggacgcagccggactcctgacccacaggaagacatacaactgccttgtgcagtataaaagcaagtggctgactaactttttgattgtatacatcatcctcatgctgattaaggattcggttttaatagtgcatgctgacggcaccgatttcgaaaaatgttctggcgaggcggacatcacatggaattgcaccgggccatttctgaacctaggaaattgtgaaaagaaacagaagaaagagtcctataacaatattgcaactcaactcaagggtctggatgccatctcagtccttgacattccgatgatcagtaagatacccgaagatatcgctggcgccttgcggttcattgaggagcagcgtagctaccacgtgcagctgacggcagaatacgccatgctcacacgctattgcgactactatacccagtttactgacaactccgggtactctcaaaccacatggagagtctatctgaggagccatgatttcgaggcttgtatcctttaccctaatcagcacttttgccggtgtgtgaaacacggagacaagtgctcaagttccaactgggatttcgccaatgaaatgaaaaactattacagcggcaagcagtctaaatttgacaaggatctgaatttggcactcatgtcactgcatcacgcgttccgaggtaccagtagcttctacattgctaagttactgaaagagaagaaaaacgaagacctagttacttatgccgagaagatcaaagggaagtacccaggcaatgcactcctgaaagccataattgattatatcaagtacatgaaggaccttacagagatgaacaattttaaacatgatgaaatgtgggacgatttcatttttgaggtgccccctacgaagtccccatctgtacgcagattggaatcgagctatgacttcaaaaccaacgtcaactccaatccctcacacatctgtaagaacataaaaactgtggtttgcctgagtccgaagtctggagtgagctacgattccatcattgcttgtggcgagccttcacagcccagcatctataggaagccagactctcaagtctttcagtccaatgccgaccagacacacttctgcctcagtgatacccattgcctggaaaactacgaggcagtgggggaggaaattatcgacgctattaaaaagagcaaatgttgggagacagaatttactgagtacatacagttcaagcaatctgatggagtacggtcctgccgcatgaaagactcaggtgagtgtaccgtgacgaccaatagatggcctatcatcttatgcgataacgacaagttttattacagtgaactgcagaaggattatgacaaagatcaggacattggccacttctgtcttagccccaggtgcaatacaatccgtcatccaattaaccggaagcacatatcgaattgtacttggcaggtttcccataacaatatcgataaaattgaggtccacgaattggaggacctcgaacaatacaagaaagccatcacccagaagctgcagacatctctaactctgtttaagtatagcaaaaccaagaacctcccccacattaaacctatgtacaagtatatcacgatagaggggacagagaccgcggaaggaatcgagtcagcctacattgaaagtgagatcccagctctggcaggcacttccattggtttcaaaatcacatctaagagcgggaaacatcttttggatgtgatatcctacgtgaagtcagccagctatagtgctgtctacaccaagctgtatactaccggcccgacaattggagttaatacgaaacacgacgaattatgcaccggcccctgtcctgtgaacgtgccacatgggactggatggatcacatttgccaaggagcgaacctcttcctggggttgcgaggagttcggctgtctcgcaatcagcgacgggtgcgtattcggatcgtgccaagatattataaaagacgaaatcacagtctacagaaaggaaactgaggaaaccacggatgtggagctgtgtcttacatttgcggacaaaacctattgcactaatctgaacgccattacccccatcattacagatcagttcgaggttcagtttaagactgtggaggcttactcattgcctaggatcatagccgtccgcaaccacgaaatcatggtgggccagattaatgacatcggtgtttattctaaggggtgtggcaacgtgcaaaaagtaaataacaccaattacggaaacggcgtcccaaagttcgattacctctgccatctggcaagtcggaaagaagtgattgtgagaaagtgttttgacaatgattatcaggcttgcaaattcctacagacacccgcctcctacaggctggaggaggaagggggaagcgtcacggttatcgactataagaagatactcggcaccattaaaatgaaggcaatcctgggtgatgtgaaatacaagacttttgccgacaacgtagaccttacagtggagggggtctgtaccggatgcatcaattgtttcgaaaacattcactgcgagttgactatccactctacagtggaagctagctgtccggttgtgtcctcatgcaccgtctttcatgatcgcatactgattacgcctaatgagcacaaatatgcgatcaaggtgatttgcaacgagaagccaggccccactttacctttcaaaatctgtagtgccaagaccgacgcagctatgacactcgccgatgccaaacccatactggaacttgctccagttgaccagaccacttacattaaggagaaagatgaacgatgcaagacatggatgtgtcgggtgcgtgacgagggttttcaagtcatcttcgaacctttcaagaatctgtttggcagctatatcgggattttctacacctttatcatttctctaatggcaatattcatcgtaatttacatcgtgctccccatctgctttaaactgagagatacattgaggcagcatgaggacgcctataagcgcgagatgaaaattcggtga

SEQ ID NO: 10991 - RNA, 4323 nt, synthetic construct
  misc_feature 1..4323: note = derived and/or modified CDS sequence (opt3) from TAHV(83)__GQ386825.1__GP
  source 1..4323: mol_type = other RNA
atgatgttcgtgctgtttttcatcgccctcagcgctgcatcccccgtctaccagagatgctttcaagacggcgccattgttaagcagaacccttctaaacaggcggtgaccgaggtatgtcttaaggatgacgtgtcaatgataaaaacagaagctaggtatttccggaatgccactgggacgtacgcaaacaatgtcgccatccgcaagtggctggtgagtgattggcacgactgccgacccaaaaaggttagcggaggtcatattaacgtgatcgaggtcggcgatgacttgaccttacacacagaggcttatgtgtgtaatgcagattgcactattggggtagacaaggaaaccgcccaggttcgtctgcaaacagataccactaaccattttgaaatcgctggaacaaccgtgaaatccggctggttcaagtctacgacttacataaccctagaccagacatgtgagcacctcaaagtctcgtgcggtccgaagtcaatccagtttcatgcctgtttcaatcagcacatgagctgcgtgagatttctgcacaggactattcttcccgggagtatcgcgtcctctatttgtcaaaacgtggagatcataattctgaccgtcttgacactcctgatcttcattctgctcagcatcttatccaaaacctatatctgctacattctgatgcctatatttatcccacttgcatatatttacggagttatctacaataagtcatgtaagaaatgcaagttgtgcggcctggtgtatcatcccttcacggaatgtggcactcactgcgtatgtggggcccggtacgagacaagtgatcgcatgaaactacatagagctagcggactctgccctggttataagtctctgagggccgcacgggtgatgtgtaaatccaagggcccagcttcaatacttagcattatcaccgccgtcctgatcttgacttttgtgacacccattaacgcgatggttgccggggacacccaggaaacgttcaaactcgaggatctgcctgacgacatgttaagtatggcaatgaaggtgaatatgtactatatcatgtgcatgattaactacgctgtcacctggtctttcatactgtgtgccctccttatcgctctgttgtttaagaaatatcagcaccgcttcctaaatttttacgccatgtactgccacgagtgtgatatgtatcatgaccgatccggactgaagtacaacggcgatttcacaaataaatgcagacagtgtacttgcggtcaatatgaagacgcagccgggctcctgacccacaggaagacatacaactgccttgtgcagtataaaagcaagtggctgactaactttttgattgtatacatcatcctcatgctgattaaggattcggttttaatagtgcatgctgacggaaccgatttcgagaaatgttctggcgaagcggacatcacatggaattgcaccggcccatttctgaacctagggaattgtgagaagaaacagaagaaagaatcctataacaatattgcaactcaactcaagggactggatgccatctcagtccttgacattccgatgatcagtaagatacccgaggatatcgctggtgccttgcggttcattgaggaacagcgtagctaccacgtgcagctgacggcagagtacgccatgctcacacgctattgcgactactatacccagtttactgacaactccggctactctcaaaccacatggagagtctatctgaggagccatgatttcgaagtgtgtatcctttaccctaatcagcacttttgccggtgtgttaaacacggggacaagtgctcaagttccaactgggatttcgctaatgagatgaaaaactattacagcggaaagcagtctaaatttgacaaggatctgaatttggccctcatgtcactgcatcacgcattccgaggcaccagtagcttctacattgcgaagttactgaaagaaaagaaaaacgaggacctagtgacttatgctgagaagatcaaaggtaagtacccagggaatgccctcctgaaagcaataattgattatatcaagtacatgaagggccttacagaaatgaacaattttaaacatgacgaggtatgggatgacttcatttttgaagtcccacctacgaagtccccatctgtgcgcagattggagtcgagctatgatttcaaaaccaacgttaactccaatccctcacacatctgtaagaacataaaaactgtggtctgcctgagtccgaagtctggagtgagctacgactccatcattgcctgtggcgaaccttcacagcccagcatctataggaagccagattctcaagtatttcagtccaatgctgaccagacacacttctgcctcagtgacacccattgcctggagaactacgagacagtgggggaagagattatcgatgccattaaaaagagcaaatgttgggaaactgagtttaccgagtacatacagttcaagcaatctgacggagttcggtcctgccgcatgaaagattcaggtgaatgtacggtcaccacaaatagatggcctatcatcttatgcgacaacgataagttttattacagtgagctgcagaaggactatgataaagaccaggatattggccacttctgtcttagccccaggtgcaatactatccgtcatccaattaaccggaagcacatatcgaattgtacctggcaagtgtcccataacaatatcgacaaaattgaagtgcacgagttggaagatctcgagcagtacaagaaagcaatcacacagaagctgcagacttctctaaccctgtttaagtatagcaaaacgaagaacctcccccacattaaacctatgtacaagtatatcacaatagaggggaccgaaactgctgagggaatcgaatcagcctacattgagagtgaaatcccagcgctggccggcacatccattggtttcaaaatcacctctaagagcgggaaacatcttttggacgtcataggctacgttaagtccgcttcatatagcgcagtgtacactaagctgtataccacaggaccgacgattggcgtgaataccaaacacgatgagttatgcactgggccctgtcctgtaaacgtcccacatggaacaggttggctcacctttgccaaggagcgaacaagttcttggggctgcgaagagttcgggtgtctggctatctccgacggatgcgtgttcggcagctgccaagacatcattaaagatgaaataactgtttacagaaaggagaccgaagagacgacagacgtggagctttgtctgacctttgccgataaaacttattgcaccaatttgaacgcaatcacacccattatcactgaccagttcgaagtccagtttaagaccgtggaggcgtactcgctccctaggattatcgccgttcgcaaccacgaaataatggtgggtcagatcaatgatattggggtatattcaaagggctgtggaaacgtccaaaaagtgaataacacaaattacggcaacggggtgccaaagttcgactacctgtgccatctagcttctcggaaagaggtcatcgttagaaagtgttttgataatgactatcaggcctgcaaattcctgcagacgcccgcaagttacaggctcgaggaagagggaggctccgtgaccgtaattgattataagaagatcctgggtactataaaaatgaaggctattcttggggacgtgaaatacaagacatttgccgataacgtcgacttgaccgtggaaggagtttgtactggctgcatcaattgtttcgagaacatccactgcgaactgacaattcacagcaccgtggaggcatcttgtccggtcgtgagctcctgcacggtttttcatgaccgcatcttaataactcctaatgagcacaaatatgccattaaggtgatctgcaacgaaaagccaggtcccaccctccctttcaaaatttgttcagctaagacagatgcggccatgaccctggcagacgctaaacccatccttgagctggccccagtcgatcagactacatacataaaggaaaaagacgagcgatgcaagacctggatgtgtcgggtacgtgatgaaggctttcaagtgattttcgagcctttcaagaatctatttgggagttatatcggaatcttctacacatttattatcagcctcatggccattttcatagttatctacattgtgctgcccatctgctttaaattgagagacactctgaggcagcatgaggatgcttataagcgcgaaatgaaaatccggtga

SEQ ID NO: 10992 - RNA, 4323 nt, synthetic construct
  misc_feature 1..4323: note = derived and/or modified CDS sequence (opt3) from TAHV(89)__GQ386826.1__GP
  source 1..4323: mol_type = other RNA
atgatgttcgtgctgtttttcatcgccctcagcgctgcatcccccgtctaccagagatgctttcaagacggcgccattgttaagcagaacccttctaaacaggcggtgaccgaggtatgtcttaaggatgacgtgtcaatgataaaaacagaagctaggtatttccggaatgccactgggacgtacgcaaacaatgtcgccatccgcaagtggctggtgagtgattggcacgactgccgaccaaagaaggttagcggaggtcatattaacgtgatcgaggtcggcgatgacttgaccttacacacagaggcttatgtgtgtaatgcagattgcactattggggtagacaaggaaaccgcccaggttcgtctgcaaacagataccactaaccattttgaaatcgctggaacaaccgtgaaatccggctggttcaagtctacgacttacataaccctagaccagacatgtgagcacctcaaagtctcgtgcggtccgaagtcaatccagtttcatgcctgtttcaatcagcacatgagctgcgtgagatttctgcacaggactattcttcccgggagtatcgcgtcctctatttgtcaaaacgtggagatcataattctgaccgtcttgacactcctgatcttcattctgctcagcatcttatccaaaacctatatctgctacattctgatgcctatatttatcccacttgcatatatttacggagttatctacaataagtcatgtaagaaatgcaagttgtgcggcctggtgtatcatcccttcacggaatgtggcactcactgcgtatgtggggcccggtacgagacaagtgatcgcatgaaactacatagagctagcggactctgccctggttataagtctctgagggccgcacgggtgatgtgtaaatccaagggcccagcttcaatacttagcattatcaccgccgtcctgatcttgacttttgtgacacccattaacgcgatggttgccggggacacccaggaaacgttcaaactcgaggatctgcctgacgacatgttaagtatggcaatgaaggtgaatatgtactatatcatgtgcatgattaactacgctgtcacctggtctttcatactgtgtgccctccttatcgctctgttgtttaagaaatatcagcaccgcttcctaaatttttacgccatgtactgccacgagtgtgatatgtatcatgaccgatccggactgaagtacaacggcgatttcacaaataaatgcagacagtgtacttgcggtcaatatgaagacgcagccgggctcctgacccacaggaagacatacaactgccttgtgcagtataaaagcaagtggctgactaactttttgattggatacatcatcctcatgctgattaaggattcggtattaatagttcatgctgacggcaccgatttcgagaaatgttctggcgaagcggacatcacatggaattgcaccgggccatttctgaacctaggaaattgtgagaagaaacagaagaaagaatcctataacaatattgcaactcaactcaagggtctggatgccatctcagtgcttgacattccgatgatcagtaagatacccgaggatatcgctggcgccttgcggttcattgaggaacagcgtagctaccacgtccagctgacggcagagtacgccatgctcacacgctattgcgactactatacccagtttactgacaactccgggtactctcaaaccacatggagagtgtatctgaggagccatgatttcgaggcttgtatcctttaccctaatcagcacttttgccggtgtgtcaaacacggagacaagtgctcaagttccaactgggatttcgccaatgaaatgaaaaactattacagcggcaagcagtctaaatttgacaaggatctgaatttggcactcatgtcactgcatcacgcgttccgaggtaccagtagcttctacattgctaagttactgaaagaaaagaaaaacgaggacctagtgacttatgccgagaagatcaaagggaagtacccaggcaatgcactcctgaaagccataattgattatatcaagtacatgaagggacttacagaaatgaacaattttaaacatgacgagatgtgggatgacttcatttttggcgttccccctacgaagtccccatctgtgcgcagattggaatcgagctatgatttcaaaaccaacgtaaactccaatccctcacacatctgtaagaacataaaaactgtcgtgtgcctgagtccgaagtctggggttagctacgactccatcattgcttgtggagagccttcacagcccagcatctataggaagccagattctcaagtgtttcagtccaatgccgaccagacacacttctgcctcagtgacacccattgcctggaaaactacgagacagtcggtgaggaaattatcgatgcaattaaaaagagcaaatgttgggagactgaatttaccgagtacatacagttcaagcaatctgacggcgtgcggtcctgccgcatgaaagattcaggggagtgtacggtaaccacaaatagatggcctatcatcttatgcgacaacgataagttttattacagtgaactgcagaaggactatgataaagaccaggatattggacacttctgtcttagccccaggtgcaatactatccgtcatccaattaaccggaagcacatatcgaattgtacctggcaagtgaaccataataacatcgacaaaattgaggttcacgaattggaggatctcgaacagtacaagaaagctatcacacagaagctgcagacttccctaaccctgtttaagtattctaaaacgaagaatctcccccacattaaacctatgtacaagtatatcacaatagagggcaccgagactgccgaaggtatcgagagcgcgtacattgaatcagagatcccagccctggctgggacaagtattggcttcaaaatcacctccaagtctggaaaacatcttttggacgtcataggctacgtgaaaagcgcatcctattcagccgtgtacactaagctgtataccacagggccgacgattggagtcaacaccaaacacgatgaattatgcactggtccctgtcctgttaatgtgccacatagcacaggctggctcacctttgctaaggagcgaacaagttcttgggggtgcgaggagttcggatgtctggccatctccgacggctgcgtgttcggtagctgccaagacatcattaaagatgaaataactgtatacagaaaggaaaccgaggaaacgacagacgtcgagctttgtctgacctttgcagataaaacttattgcaccaacttgaacgcggtgacacccatcattactgaccagttcgaggttcagtttaagaccgtggaagcctactcgctccctaggatcattgctgtccgcaatcacgagatcatggtggggcagataaacgatatcggcgtttattcaaagggatgtggcaatgtgcaaaaagtaaacaatacaaactacgggaatggagtcccaaagttcgactacctgtgccatctagcctctcggaaagaagtgattgtgagaaagtgttttgataacgactatcaggcatgcaaattcctgcagacgcccgctagttacaggctcgaggaggaaggcggttccgtcaccgttatcgattataagaagattctggggactatcaaaatgaaggccatacttggagacgtgaaatacaagacatttgcagataatgccgacttgaccgtagagggcgtgtgtactggttgcattaactgtttcgaaaatatccactgcgagctgacaatccacagcaccgtcgaggcttcttgtccggtggttagctcctgcacggtgtttcatgaccgcattttaatcactcctaacgaacacaaatatgcgataaaggtcatttgcaatgagaagccaggccccaccctccctttcaaaatctgttcagccaagacagatgcagctatgaccctggccgacgccaaacccattcttgaactggctccagtggatcagactacatacatcaaggagaaaggggaacgatgcaagacctggatgtgtcgggttcgtgacgagggatttcaagtgatattcgaacctttcaagaacctatttggcagttatattgggatcttctacacatttatcattagcctcatggcaatcttcattgtcatatacatcgtactgcccatttgctttaaattgagagatactctgaggcagcatgaggacgcctataagcgcgagatgaaaatccggtga

SEQ ID NO: 10993 - RNA, 4323 nt, synthetic construct
  misc_feature 1..4323: note = derived and/or modified CDS sequence (opt3) from TAHV(90)__GQ386827.1__GP
  source 1..4323: mol_type = other RNA
atgatgttcgtgctgtttttcatcgccctcagcgctgcatcccccgtctaccagagatgctttcaagacggcgccattgttaagcagaacccttctaaacaggcggtgaccgaggtatgtcttaaggatgacgtgtcaatgataaaaacagaagctaggtatttccggaatgccactgggacgtacgcaaacaatgtcgccatccgcaagtggctggtgagtgattggcacgactgccgaccaaagaaggttgctggaggtcatattaacgtgatcgaggtcggcgatgacttgaccttacacacagaagcatatgtgtgtaatgccgattgcactattggggtagacaaggagaccgctcaggttcgtctgcaaacagataccactaaccattttgaaatcgccggaacaaccgtgaaaagcggctggttcaagtccacgacttacataaccctagaccagacatgtgagcacctcaaagtctcttgcggtccgaagtcgatccagtttcatgcgtgtttcaatcagcacatgtcatgcgtgagatttctgcacaggactattcttcccgggagcatcgcaagttccatttgtcaaaacgtggagatcataattctgaccgtcttgacactcctgatcttcattctgctctctatcttaagcaaaacctatatctgctacattctgatgcctatatttatcccacttgcctatatttacggagttatctacaataagtcctgtaagaaatgcaagttgtgcggcctggtgtatcatcccttcacggaatgtggcactcactgcgtatgtggggctcggtacgagacatcagatcgcatgaaactacatagagccagtggactctgccctggttataagagcctgagggcagctcgggtgatgtgtaaatctaagggcccagcctccatactttcaattatcaccgcggtcctgatcttgacttttgtgacacccattaacgccatggttgcaggggacacccaggaaacgttcaaactcgaggatctgcctgacgacatgttaagcatggctatgaaggtgaatatgtactatatcatgtgcatgattaactacgccgtcacctggagtttcatactgtgtgctctccttatcgccctgttgtttaagaaatatcagcaccgcttcctaaatttttacgcaatgtactgccacgagtgtgatatgtatcatgaccgatctggactgaagtacaacggcgatttcacaaataaatgcagacagtgtacttgcggtcaatatgaagacgccgctgggctcctgacccacaggaagacatacaactgccttgtgcagtataaatccaagtggctgactaactttttgattggatacatcatcctcatgctgattaaggatagcgtattaatagttcatgcggacggcaccgatttcgagaaatgttcgggcgaagcagacatcacatggaattgcaccgggccatttctgaacctaggaaattgtgagaagaaacagaagaaagaatcttataacaatattgccactcaactcaagggtctggatgctatctccgtgcttgacattccgatgatctcaaagatacccgaggatatcgccggcgcattgcggttcattgaggaacagcgtagttaccacgtccagctgacggccgagtacgctatgctcacacgctattgcgactactatacccagtttactgacaacagcgggtactcccaaaccacatggagagtgtatctgaggtctcatgatttcgaagcctgtatcctttaccctaatcagcacttttgccggtgtgtcaaacacggagacaagtgcagctcaagtaactgggatttcgcaaatgagatgaaaaactattactccggcaagcagagcaaatttgacaaggatctgaatttggcgctcatgtctctgcatcacgctttccgaggtacctcaagtttctacattgccaagttactgaaagaaaagaaaaacgaggacctagtgacttatgcagagaagatcaaagggaagtacccaggcaatgccctcctgaaagctataattgattatatcaagtacatgaagggacttacagaaatgaacaattttaaacatgacgagatgtgggatgacttcatttttgaagttccccctacgaaaagcccatccgtgcgcagattggagtcttcgtatgatttcaaaaccgacgtaaacagcaacccctcccacatctgtaagaatataaaaactgtcgtgtgcctgtcaccgaagagtggcgtttcttacgatagcatcattgcctgtggggaaccttcccagccctcaatctataggaagccagacagccaagtgtttcagtctaacgcagaccagacacacttctgcctctccgatacccattgcctggagaattacgagacagtcggagaagagattatcgacgctattaaaaagagtaaatgttgggaaactgagtttaccgagtacatacagttcaagcaaagcgatggtgtgcggtcttgccgcatgaaagactccggcgaatgtacggtaaccacaaacagatggcctatcatcttatgcgataataacaagttttattactcagagctgcagaaggactatgataaagaccaggatattgggcacttctgtcttagtcccaggtgcaatactatccgtcatccaattaaccggaagcacataagcaattgtacctggcaagtgaaccataataacatcgacaaaattgaagttcacgagttggaagatctcgagcagtacaagaaagccatcacacagaagctgcagacttcgctaaccctgtttaagtattccaaaacgaagaatctcccccacattaaacctatgtacaagtatatcacaatagagggaaccgaaactgcggagggcatcgaatctgcctacattgagagcgaaatcccagctctggcaggtacatcaattgggttcaaaatcaccagtaagtccggcaaacatcttttggacgtcataggatacgtgaagtctgccagctattccgctgtgtacactaagctgtataccacaggcccgacgattggggtcaacaccaaacacgatgagttatgcactggaccctgtcctgttaatgtgccacatggtacaggctggctcacctttgccaaggagcgaacatcaagctgggggtgcgaagagttcggatgtctggcaatcagtgacggctgcgtgttcggttcttgccaagacatcattaaagatgaaataactgtatacagaaaggagaccgaagagacgacagacgtcgagctttgtctgacctttgcggataaaacttattgcaccaacttgaacgccgtgacacccatcattactgaccagttcgaagttcagtttaagaccgtggaggcttactccctccctaggatcattgccgtccgcaatcacgaaatcatggtggggcagataaacgatatcggcgtttatagcaagggatgtggcaatgtgcaaaaagtaaacaatacaaactacgggaatggagtcccaaagttcgactacctgtgccatctagcatcgcggaaagaggtgattgtgagaaagtgttttgataacgactatcaggcttgcaaattcctgcagacgcccgcctcatacaggctcgaggaagagggcggttctgtcaccgttatcgattataagaagattctggggactatcaaaatgaaggcaatacttggagacgtgaaatacaagacatttgccgataatgtagacttgaccgtggaaggcgtctgtactggttgcattaactgtttcgagaatatccactgcgaactgacaatccacagtaccgtggaggcttcctgtccggttgtgagctcttgcacggcgtttcatgaccgcattttaatcactcctaacgagcacaaatatgccataaaggtcatttgcaatgaaaagccaggccccaccctccctttcaaaatctgtagcgcaaagacagatgctgccatgaccctggccgacgctaaacccattcttgagctggcaccagtggatcagactacatacatcaaggaaaaagacgagcgatgcaagacctggatgtgtcgggttcgtgatgaagggtttcaagtgatattcgagcctttcaagaacctatttggatcctatattggcatcttctacacatttatcatttcactcatggccatcttcattgtcatatacatcgtactgcccatttgctttaaattgagagacactctgaggcagcatgaggatgcgtataagcgcgaaatgaaaatccggtga

SEQ ID NO: 10994 - RNA, 4323 nt, synthetic construct
  misc_feature 1..4323: note = derived and/or modified CDS sequence (opt3) from TAHV(94)__GQ386828.1__GP
  source 1..4323: mol_type = other RNA
atgatgttcgtgctgtttttcatcgccctcagcgctgcatcccccgtctaccagagatgctttcaagacggcgccattgttaagcagaacccttctaaacaggcggtgaccgaggtatgtcttaaggatgacgtgtcaatgataaaaacagaagctaggtatttccggaatgccactgggacgtacgcaaacaatgtcgccatccgcaagtggctggtgagtgattggcacgactgccgacccaaaaaggttagcggaggtcatattaacgtgatcgaggtcggcgatgacttgaccttacacacagaggcttatgtgtgtaatgcagattgcactattggggtagacaaggaaaccgcccaggttcgtctgcaaacagataccactaaccattttgaaatcgctggaacaaccgtgaaatccggctggttcaagtctacgacttacataaccctagaccagacatgtgagcacctcaaagtctcgtgcggtccgaagtcaatccagtttcatgcctgtttcaatcagcacatgagctgcgtgagatttctgcacaggactattcttcccgggagtatcgcgtcctctatttgtcaaaacgtggagatcataattctgaccgtcttgacactcctgatcttcattctgctcagcatcttatccaaaacctatatctgctacattctgatgcctatatttatcccacttgcatatatttacggagttatctacaataagtcatgtaagaaatgcaagttgtgcggcctggtgtatcatcccttcacggaatgtggcactcactgcgtatgtggggcccggtacgagacaagtgatcgcatgaaactacatagagctagcggactctgccctggttataagtctctgagggccgcacgggtgatgtgtaaatccaagggcccagcttcaatacttagcattatcaccgccgtcctgatcttgacttttgtgacacccattaacgcgatggttgccggggacacccaggaaacgttcaaactcgaggatctgcctgacgacatgttaagtatggcaatgaaggtgaatatgtactatatcatgtgcatgattaactacgctgtcacctggtctttcatactgtgtgccctccttatcgctctgttgtttaagaaatatcagcaccgcttcctaaatttttacgccatgtactgccacgagtgtgatatgtatcatgaccgatccggactgaagtacaacggcgatttcacaaataaatgcagacagtgtacttgcggtcaatatgaagacgcagccgctctcctgacccacaggaagacatacaactgccttgtgcagtataaaagcaagtggctgactaactttttgattgtatacatcatcctcatgctgattaaggattcggttttaatagtgcatgcggacgggaccgatttcgagaaatgttctggagaagcagacatcacatggaattgcaccggcccatttctgaacctaggcaattgtgagaagaaacagaagaaagaatcctataacaatattgccactcaactcaaggggctggatgctatctcagtccttgacattccgatgatcagtaagatacccgaggatatcgccggagcattgcggttcattgaggaacagcgtagctaccacgtgcagctgacggccgagtacgctatgctcacacgctattgcgactactatacccagtttactgacaactccggttactctcaaaccacatggagagtctatctgaggagccatgatttcgaagtgtgtatcctttaccctaatcagcacttttgccggtgtgttaaacacggcgacaagtgctcaagttccaactgggatttcgccaatgagatgaaaaactattacagcgggaagcagtctaaatttgacaaggatctgaatttggcactcatgtcactgcatcacgcgttccgaggaaccagtagcttctacattgctaagttactgaaagaaaagaaaaacgaggacctagtgacttatgccgagaagatcaaaggcaagtacccaggtaatgcactcctgaaagccataattgattatgtaaagtacatgaaggaccttacagaaatgaacaattttaaacatgatgagatgtgggacgatttcatctttgaagtcccacctacgaagtccccatctgtgcgcagattggagtcgagctatgacttcaaaaccaacgttaactccaatccctcacacatttgtaagaacatcaaaactgtggtctgcctgagtccgaagtctggggtgagctacgattccataatcgcttgtggcgaaccttcacagcccagcatttataggaagccagactctcaagtatttcagtccaatgccgaccagacacacttctgcctcagtgatacccattgcctggagaactacgagacagtgggagaagagatcattgacgcaatcaaaaagagcaaatgttgggaaactgagtttaccgagtacatacagttcaagcaatctgatggcgttcggtcctgccgcatgaaagactcaggggaatgtacggtcaccacaaatagatggcctattatcttatgcgataacgacaagttttattacagtgagctgcagaaggattatgacaaagatcaggacatcggacacttctgtcttagccccaggtgcaatactattcgtcatccaatcaaccggaagcacatttcgaattgtacctggcaagtgtcccataacaatatagataaaatcgaagtgcacgagttggaagacctcgagcagtacaagaaagctattacacagaagctgcagacttctctaaccctgtttaagtatagcaaaacgaagaacctcccccacatcaaacctatgtacaagtatattacaatcgagggtaccgaaactgccgagggcatagaatcagcgtacatcgagagtgaaattccagccctggctgggacatccatcggattcaaaattacctctaagagcggcaaacatcttttggatgtcatcggttacgttaagtccgcatcatatagcgccgtgtacactaagctgtataccacagggccgacgataggcgtgaataccaaacacgacgagttatgcactggaccctgtcctgtaaacgtcccacatggcacagggtggctcacctttgctaaggagcgaacaagttcttggggatgcgaagagttcggttgtctggccatttccgacggctgcgtgttcgggagctgccaagatatcatcaaagacgaaattactgtttacagaaaggagaccgaagagacgacagatgtggagctttgtctgacctttgcagacaaaacttattgcaccaatttgaacgcgataacacccatcattactgatcagttcgaagtccagtttaagaccgtggaggcctactcgctccctaggatcattgctgttcgcaaccacgaaatcatggtgggacagataaatgacatcggcgtatattcaaagggttgtgggaacgtccaaaaagtgaataacacaaattacggcaacggagtgccaaagttcgattacctgtgccatctagcctctcggaaagaggtcattgttagaaagtgttttgacaatgattatcaggcatgcaaattcctgcagacgcccgctagttacaggctcgaggaagagggcgggtccgtgaccgtaatcgactataagaagattctgggaactatcaaaatgaaggccatacttggcgatgtgaaatacaagacatttgcagacaacgtcgacttgaccgtggaaggtgtttgtactgggtgcgtgaattgtttcgagaacattcactgcgaaagcacaatccactctaccgtcgaggccagctgtccggtgatctcctcatgcacggtttttcatgatcgcattctgatcactcctaatgagcacaaatatgctataaaggtgatttgcaacgaaaagccaggacccaccttacctttcaaaatctgtagtgcgaagacagacgccgcaatgaccctcgctgatgccaaacccattctggagcttgccccagtcgaccagactacatacatcaaggaaaaagatgagcgatgcaagacctggatgtgtcgggtacgtgacgaaggctttcaagtgatattcgagcctttcaagaatctgtttggtagctatattggcatcttctacacatttatcatttctctaatggctatcttcattgttatatacatcgtgctccccatttgctttaaactgagagatactttgaggcagcatgaggacgcatataagcgcgaaatgaaaatccggtga

SEQ ID NO: 10995 - RNA, 4323 nt, synthetic construct
  misc_feature 1..4323: note = derived and/or modified CDS sequence (opt3) from TAHV(XJ0625)__EU622819.2__GP
  source 1..4323: mol_type = other RNA
atgatgttcgtgctgtttttcatcgccctcagcaccgcttcccccgtctaccagagatgctttcaagacggcgcaattgttaagcagaacccttctaaacaggccgtgacagaggtatgtcttaaggatgacgtgtcaatgataaaaactgaagcgaggtatttcaagaatgctacggggacctacgccaacaatgtcgcaatccggaaatggctggtgagtgattggcacgactgccgcccaaagaaggttgccggaggtcatattaacgtgatcgaggtcggcgatgacttgacattacacactgaagcatatgtgtgtaatgcagattgcaccattggggtagacaaagagacagcccaggttcgactgcaaaccgatactacaaaccattttgaaatcgctggaaccacggtgaaaagcggctggttcaaatccactacctacataacactagaccagacttgtgagcacctcaaggtctcttgcggtccgaaatcggtgcagtttcatgcctgtttcaatcagcacatgtcatgcgtgcgttttctgcacagaaccatccttcccgggagcattgcgagttccatctgtcaaaacgtcgagattatcatactgacagttttgaccctcctgattttcatcctgctctctattttaagcaagacgtatatctgctacctgcttatgcctatctttattccattggcatatgtgtacggagtaatatacaataagtcctgtaaaaagtgcaaactgtgcggcctagtgtatcatcccttcactgaatgtggcacacactgcgtctgtggggccaggtacgagacctcagatcggatgaagctccatcgcgctagtggactgtgccctggttataaaagccttagagccgcaagggtgatgtgtaagtctaaaggcccagcttccatcctgtcagttattactgccgtgttgatcctcacatttgtcacccccataaacgcgatggtggccggggacacgcaggaaaccttcaagctggaggatttacctgacgacatgctgagcatggcaatgaagattcagatgtactatatcatgtgcatcgtaaattacattgttacatggagtttcatcgtgtgtgctctcattatagcccttatctttaaaaagtatcagcaccggttcctgaacttttacgctatgtactgccacgagtgtgatatgtatcatgaccgctctggattgaaatacaatggcgatttcactaacaagtgccgacaatgtacctgcggtcagtatgaagacgccgcagggctactgacacacagaaaaacttacaattgcctcgtccagtataagtccaagtggctggtgaactttcttattatctacatcctgttgatgctcgtcaaagatagcgtgctgattgttcaagccgagggaaccgacttcgaaaagtgttcgggcgagataaacatcacatggaattgcaccggcccatttttaaacctggggaattgtgaaaagaagcagaaaaaggagccgtattctaacattgctactcagctaaagggactcgatgcgatctccattctggacatccccatgatatcaaggatccctgaggatattgctggtgcccttcggttcatcgaagaacagaatagttaccatgtgcaattgacggctgaatacgccatgctgacacgttattgcgactactatacccagtttagcgataactccggctactctcagaaaacttggcgcgtatatctcagaagccacgacttcgaggcatgtattctgtacccaaatcagcatttttgtaggtgcgtcaagcacggggacaaatgctcaagttccaactgggatttcgccagcgaaatgaagaattattacaccggaaaacaacttaagtttaacaaggacctgaatttggctctcatgtctttccaccatgccttccggggcacatcaagtttttacgtggcaaaactgttacgagagaagaacaatgaggaactggttaactataccgagaaaatcaaggataaataccccggtaatgcgctactcaaggctataattgactatatcaaatacatgaagaacctgagcgaaatgactaacttcaagcacgatgagatgtgggacgattttgtgttcaattcccctccaacaaaatctccctcggtccgcagaagcgactccgcctatgattttaagaacaatattaactcaaatccgagtcatatctgtcagaacataaaaacggtgatctgcctttctcctaagagcggggtatcctacgactcaattatcgcatgtggcgaacccagccagccaaccatttataaaaagcctgagtctagggtgttccagtccaatgccgatcaaactcacttttgcttggctgacacacactgcctggagaactacgaaaccgttggagaggaaatcctcgatgccataaagaaaagtaagtgttgggagacagacttcactgagtacattcagtttaaacagagcgacggcgtccggtcttgccgcatgaaggattccggggaatgtaccgtgacgacccatagatggcccatcatcctgtgcgacaataacaaattctattactcagagttacagaaggattatgacaaggatcaagacattggacacttttgtctgagtccaaggtgcaatacaatccgtcatcccattaaccagaaacacataagcaattgtacttggcaagtgtcgcataacaatatcgaaaagattgaggtccacgaacttgagaacttggagcagtacaaaaaggcaatcacccagaaactccagacatccctgactctattcaagtattctaagaccaaaaacctgcctcacattaagccaatgtacaaatatatcacgatagaaggtacagagaccgctgaaggcatcgagagcgcctacattgaatcagagatcccggcgctcgccgggacaagtattggatttaagatcacttccaaatctggcaagcatctgcttgatgttataggttacgtgaaaagcgcttcctattcagcagtgtacaccaagttgtatactaccgggcccacaattggcgtaaatacgaagcacgacgagctgtgcaccggaccttgtccagtcaacgtgccccatggcactgggtggttaacattcgccaaagaacggaccagcagttggggatgcgaggagttcggttgtctcgctatctctgatggctgcgtttttgggtcctgccaggacatcattaaggaggaactggccgtgtaccgaaaagagacagaggaaactaccgatgtcgagctttgtctgacgttcgcagacaagacatattgcaccaatttgaacgcgataactcctatcattaccgatcaatttgaagtgcagttcaaaacagttgagagctactcgctcccaagaatcattgccgtgaggaatcacgagatcatggtaggacagataaacgacatcggcgtctattcaaagggttgtgggaatgtgcagaaggtgaacaatactaactacggcaatggagtccccaaatttgactacctgtgccatctagcttctcgcaaggaagttattgtgcggaaatgtttcgataacgactatcaagcctgcaagtttctgcagaccccggcaagttacagactcgaggaagagggcgggtccgtaacagtgatcgattataaaaagattctgggaacgatcaagatgaaagctatacttggcgacgtcaagtacaaaaccttcgccgataatgtggacttgactgttgaaggtgtgtgtacagggtgcattaactgttttgagaatatccactgcgagctgaccatccacagcactgtcgaagcatcttgtcctgtgacaagctcctgcaccgttttccatgataggattttaatcacgccaaacgagcacaagtatgccataaaagtgatttgcgctgaaaagcccggaccttcactccagtttaagatctgtaacgcgaaaactgacgccgcaatgaccctggctgatgccaagcccattcttgagctggccccagtcgaccagacaacctacatcaaagaaaaggatgtacgctgcaaaacttggatgtgtcgagtgcgggacgagggcctacaagttatattcgagcctttcaagaatctctttggtagttatattggcatcttctacacatttctgatcaccttgattgctgtgttcgtcgtgatctacattgtactgcccatatgctttaagttacgtgacacactcagacagcatgaagatgcatataaaagggagatgaagatccgctga

SEQ ID NO: 10996 - RNA, 4323 nt, synthetic construct
  misc_feature 1..4323: note = derived and/or modified CDS sequence (opt3) from TAHV(XJ0708)__HM243138.1__GP
  source 1..4323: mol_type = other RNA
atgatcctggtgctcgtcttcgttgcccttagcgctgcatcccccgtgtaccagagatgctttcaagacggcgccattgtaaagcagtctccttcaaaacaggcggtgaccgaggtctgtctgaaggatgacgtgagtatgataaaaacagaagctaggtatttcaagaacgccactgggacgtacgcaaataacgttgccatccggaaatggttggtgagcgattggcacgactgccgcccaaagaagatttccggaggtcatatcaatgtcattgaggtgggcgatgacttaaccctgcacacagaagcatatgtatgtaacgcagattgcatcataggggttgacaaagagactgcccaggtgcgactacaaaccgatacaaccaatcattttgaaatcgctggaactacagtcaagtctggctggttcaaatcgaccacgtacattactctcgaccagacctgtgagcacctgaaggtgtcatgcggtccgaaaagcatccagtttcatgcctgtttcaaccagcacatgagttgcgtgcgttttcttcacagaacaattctgcccgggtccatcgcgtctagcatatgtcaaaatgtcgagattatcattttgactgttctcaccctgctgatcttcatcctcttatccattctgtcaaagacatatatatgctacatccttatgcctatttttatcccattggcatatgtgtacggagtaatatacaacaagagttgtaaaaagtgcaaactgtgcggcctagtgtatcatcccttcaccgaatgtggcacgcactgcgtctgtggggccaggtacgagactagcgatcggatgaagctccatcgcgcttctggactgtgccctggttataaatcccttagagccgcaagggtgatgtgtaagtcaaaaggcccagctagcattctgagtatcatcacagccgttttgattctcacctttgtgactcccatcaatgcgatgattgccggggaaacacaggagaccttcaagctggaggacttacctgatgacatgctgtctatggcaatgaagctcaacatgtactatcttatgtgcatagtcaattacatcgtgacgtggtcctttattatctgtgctctgatcattgccttgatattcaaaaagtatcagcaccggttcctaaacttttacgctatgtactgccacgaatgtgacatgtatcatgatcgcagcggactgaaatacaatggcgacttcaccaacaagtgccgacagtgtacatgcggtcaatatgaggatgccgcagggctcctgactcacagaaaaacctacaattgccttgtacagtataagtcgaagtggctggttaactttttgatcgtgtacattctcctgatgttagtcaaagactctatcctgattgtgcaggccgaaggaacagatttcgacaagtgttccggcgaggctggcatcatatggaactgcactgggccatttctaaatctcggaaactgtgaaaagaaacagaaaaaggagtcatataataacatcgcgacccaactgaagggtcttaatgcaattagtgtcttggatatcccgatgattagcaggatccccgaggacatagccggcgctctgcggttcattgaagatcagaactcctaccatgtgcagctcacagccgagtacgcaatgctgacccgttattgcgactactatactcaattttctgataatagcgggtactcacagacgacatggcgcgtttatcttagaagtcacaacttcgaagcctgtatcctgtactccaatcagcatttttgtaggtgcgtgaaacacggagacaagtgctctagctcaaactgggacttcgctaatgagatgaaaaactattacagtggcaagcagagcaaatttaataaggatttgaacctcgccctgatgtccttacaccatgcattccggggtacctcttcgttttacattgcgaagctgctacgagagaaaaagaatgaggagctcatcaactatgtagaagagatcaaaaagaaataccctgggaacgctctgcttaaggccgtcatagactatattaaatacatgaagaatttgactgaaatggctagcttcaagcacgatgagatgtgggacgagttcgtgtatgaatccccacccacccgctcacctagtgccagaaggtctgagagcgaatacgattttaaaacaaacgttaattccaagccaacccatgtgtgtaaaaacatcaagactgtcgtgtgcctgtcacccaaaagcggcgtatcttatgactccattatcgcttgtggagagccgggccaacctagtgtgtaccggaagcccgaacagcaggttttccagagcaatgccgatcaaacacacttttgcctcctggacacgcactgcttagagaactacaccactgtcaatgatgagatactggacgcaattaagaaatctcgctgttgggaaacagagttcaccgaatatatccagtttaagcagggggatggagtgagatcctgcaggatgaaagactcaggtgagtgtgctgtggccgcgaaccgttggccaatcattctttgcgataataacaagttctactatagtgaattgcagaaagactacgacaaggatcaagacatcggccatttttgtctcagccctcggtgcaatacaattcgacaccccataaaccagaagcatatctcgaattgtacttggcaggtctcccacaacaatattgagaaaatcgaggttcatgaactggagaacctagaacaatataagaaagccattacccagaagctgcagacgtctctcaccctgttcaaatacagcaagacaaagaaccttccacacatcaaacccatgtataagtacataactatcgaggggaccgaaacagctgagggaattgagtcagcatacatcgaaagtgagattcctgccttggctggcacttccatcggttttaaaataacctctaagagcgggaaacacctgttagatgtgattggctatgtgaagtccgcctcatacagcagtgtatatacgagactctacacaaccggaccaactatcggcatcaatacaaggcatgacgaactgtgcaccgggccgtgtcccgtcaacgtgcctcacaatactggatggcttaccttcgcaaaagagcgcacatcttcctggggttgcgaagagtttggctgtctggcgattagcgatgggtgcgttttcggatcgtgccaggacataatcaaggaggaattgacggtgtatcggaaggagaccgaagagactacagatgtcgagctctgtctgacctttgccgacaaaacatactgcactaacctaaatgctattaccccaatcattacggatcaattcgaagtgcagttcaagacagttgaggcctattcactgcccagaatcatagcagtgaggaaccatgaaatcctcgtaggccagattaatgacctgggtgtctactctaaagggtgtggcaacgtgcagaaggtgaataaaaccaactacggaaatggcgtccctaagtttgattatctttgccacttggctagtcgcaaggaggttatcgtgcgaaaatgtttcgacaacgattaccaagcctgcaagtttctgcagactccagcatcctatcggttagaagaggaagggggaaccgtaacagtgattgactacaaaaagatcctcggcactataaaaatgaaggccattctgggtgacgtcaagtataaaaccttcgctgataatgtggaccttacaatcgaaggggtttgtacgggatgcatcaactgttttgagaatattcattgcgaactgaccatccacagcactgtggaggcgtcttgtcccataattagctcctgcacagtcttccacgatcgtatcctaattaccccgaacgaacataagtacgccatcaaagtgatatgcaacgagaagcctggctcaagtctcagctttagagtttgtaatactaaaacagacgcagctatgaccctgacggatgccaagccaattttggagctggcccccgtggaccagactgcttatatcaaggaaaaagatgagaggtgcaagacctggatgtgtcgcgtccgggacgaaggtttacaggtaatcttcgagccttttaaaaacctcttcggctcttacattgggatcttttacacattcattctgtcccttatagcaatcttcattatcatctatattgtgctgcccatatgctttaagttgagagataccctcaggcaacacgaagacgcctacaaacgagagatgaagatccgctga

SEQ ID NO: 10997 - RNA, 4323 nt, synthetic construct
  misc_feature 1..4323: note = derived and/or modified CDS sequence (opt3) from TAHV(XJ0710)__HM243141.1__GP
  source 1..4323: mol_type = other RNA
atgatgttcgtgctgtttttcatcgccctcagcgctgcatcccccgtctaccagagatgctttcaagacggcgccattgttaagcagaacccttctaaacaggcggtgaccgaggtatgtcttaaggatgacgtgtcaatgataaaaacagaagctaggtatttcaagaatgccactgggacgtacgcaaacaatgtcgccatccggaaatggctggtgagtgattggcacgactgccgcccaaagaaggttgctggaggtcatattaacgtgatcgaggtcggcgatgacttgaccttacacacagaagcatatgtgtgtaatgccgattgcactattggggtagacaaagagaccgctcaggttcgactgcaaacagataccactaaccattttgaaatcgccggaacaaccgtgaaaagcggctggttcaaatccacgacttacataaccctagaccagacatgtgagcacctcaaggtctcttgcggtccgaaatcggtgcagtttcatgcgtgtttcaatcagcacatgtcatgcgtgcgttttctgcacagaactatccttcccgggagcattgcaagttccatctgtcaaaacgtcgagattatcatactgaccgttttgacactcctgattttcatcctgctctctattttaagcaagacctatatctgctacctgcttatgcctatctttattccattggcctatgtgtacggagtaatatacaataagtcctgtaaaaagtgcaaactgtgcggcctagtgtatcatcccttcacggaatgtggcactcactgcgtctgtggggctaggtacgagacatcagatcggatgaagctccatcgcgccagtggactgtgccctggttataaaagccttagagcagctagggtgatgtgtaagtctaaaggcccagcctccatcctgtcaattatcaccgcggttttgatactcacttttgtgacacccattaacgccatggtcgcaggggacacccaggaaacgttcaagctggaggatttacctgacgacatgctgagcatggctatgaagatccagatgtactatatcatgtgcattgtgaattacatcgtaacctggagtttcattgtttgtgccctcataatcgctcttatttttaaaaagtatcagcaccggttcctgaacttttacgccatgtactgccacgagtgtgatatgtatcatgaccgctctggattgaaatacaatggcgatttcacaaacaagtgccgacaatgtacttgcggtcagtatgaagacgcagccgggctactgacccacagaaaaacatacaattgcctcgtgcagtataagtccaagtggctggtcaactttcttatcatctacattctgttgatgctcgtgaaagatagcgtcctgatagtgcaagctgagggaatcgacttcgaaaagtgttcgggcgagattaacatcacttggaattgcaccggcccatttttaaacctggggaattgtgaaaagaagcagaaaaaggagccgtattctaacattgcgacacagctaaagggactcgatgcaatctccatactggacatccccatgatttcaaggatccctgaggatattgccggtgcccttcggttcatcgaagaacagaatagttaccatgttcaattgaccgctgaatacgcaatgctgactcgttattgcgactactatacgcagtttagcgataactccggctactctcagacaacctggcgcgtgtatctcagaagccacgacttcgaggcctgtatactgtacccaaatcagcatttttgtaggtgcgtaaaacacggggacaagtgctcaagttccaactgggatttcgctagcaaaatgaagaattattacactggaaaacaacttaagtttaacaaggacctgaatttggccctcatgtctttccaccatgcattccggggcacctcaagtttttacgtcgcgaaactgttacgagaaaagaacaatgatgagctggtgaactatacagagaaaattaagaataaataccccggtaacgctctactcaaggccatcattgactatatcaaatacatgaaaagcctgtccgaaatgaccaacttcaagcacgatgagatgtgggacgattttgttttcaattctcctccaactaaatcgcccagcgtgcgcagatccgactcagcatatgattttaagaacaatataaacagtaatccgtctcatatctgtaaaaacattaagacagtcgtgtgccttagccctaaatccggggtatcatacgacagcatcattgcctgtggcgaaccctctcagccaacgatctataagaagcctgagtccagggtgttccagagtaatgctgatcagacccacttttgcttggccgacactcactgcctggaaaactacgagacagttggagaggaaatactcgatgcaattaaaaagagcaaatgttgggagaccgacttcacagaatacatccaatttaagcagtctgacggcgtccggtcctgccgcatgaaagattcaggggagtgtactgtgaccacgaatagatggcccatcattctgtgcgacaacaataagttctattacagtgagttacagaaggattatgacaaagatcaggacatcggacatttttgtctgagcccaaggtgcaacaccattcgtcaccccataaatcaaaagcatatctcgaactgtacatggcaagtgtcccacaataacattgaaaagatcgaggtccatgaacttgagaacttggaacagtacaagaaagctattactcagaagctccagacctctctgacactattcaagtatagcaaaactaagaatctgcctcacatcaaaccaatgtacaagtatataaccatcgagggtacggagacagccgaaggcattgagtcagcgtacatcgaaagtgagattccggccctcgctgggacctccatcggatttaaaataacttctaagagcggcaaacatctgcttgatgttattggttacgtgaagtccgcatcatatagcgccgtgtacacaaagttgtataccactgggcccaccatcggcgtaaacacaaaacacgacgaactgtgcacgggaccttgtccagtcaatgtgccccacggcaccgggtggttaactttcgctaaggagcggacaagttcttggggatgcgaggagttcggttgtctcgccatctccgatggctgcgtttttgggagctgccaggacattataaaagaggaactggcagtgtaccgaaaggagaccgaagaggcgacagatgtcgagctttgtctgactttcgccgacaaaacctattgcacgaacttgaatgctatcacacctattatcaccgatcagtttgaagtgcaattcaagactgttgagtcgtactcactcccaagaattatcgccgtgaggaaccatgaaataatggtaggacagatcaatgacattggcgtctattctaagggttgtgggaacgtgcagaaagtgaataacaccaattacggcaacggagtccccaagtttgactacctgtgccacctagcaagtcgcaaagaggttatcgtgcggaagtgtttcgataatgactatcaggcttgcaaatttctgcaaacaccggcctcctacagactcgaggaagagggcgggagcgtaactgtgattgattataagaagatcctgggaaccataaaaatgaaggcaattcttggcgacgtcaaatacaagacattcgccgataacgtggacttgacggttgaaggtgtgtgtaccgggtgcatcaattgttttgagaacatccattgcgaactgactattcactctacagtcgaggctagctgtcctgtgacctcctcatgcactgttttccacgataggatcttaataacaccaaacgagcataaatatgcgattaaggtgatctgcgccgaaaagcccggacctagtctccagtttaaaatttgtaatgcaaagaccgacgctgccatgacgctggccgatgctaaacccatccttgagctggcaccagtcgaccagactacctacataaaggaaaaagatgagcgctgcaagacatggatgtgtcgagtacgggacgaaggcctacaggtgattttcgagcctttcaagaacctctttggtagctatatcggcatcttctacacctttctgattactttgatcgccgttttcattgtgatatacatcgtcctgcccatttgctttaaattacgtgacacactcagacaacacgaggatgcgtataagagggaaatgaaaatccgctga

SEQ ID NO: 10998 - RNA, 4326 nt, synthetic construct
  misc_feature 1..4326: note = derived and/or modified CDS sequence (opt3) from TVTV__AF123491.1__GP
  source 1..4326: mol_type = other RNA
atgatcgtgttcgccctgctcaccattgtcgctgcaagccccgtttacaagagatgctttcaggacggcgccatagtgaggcaagagtattccaaaaacgcggtaacagaagtgtgtcttaaggatgacgtctctatgatcaaaactgaggctgaatacttcaaaaattcaacgggggtgtttagtaaaaacattgcctatcggaagtggctggttagcgattggaatgagtgccgccctcagaagtccgcaaacggacacatcaatgtgattgaagtccagccagacttgtctttacagaccaactcgtacgtgtgtgccgctacatgcgtaatctcaatagataaagagactgcacaagttcgactgcagaccgacacaaccaatcatttcgagatcagcggtactacagtgaagagtggctggtttaaatccaccacgtatctaactctcgatcagacctgtgaacacctgaagatttcttgcgggagcaaatccgtccagcttcatgcctgtttcaaccaacacatgtcatgcgtgcgttttctgcatagaacaatcttgccgggaaagcacaggaagagtatttgtcagaatatcgagataattatcctcactagcctgtctctgttcatttttctcttcttaaccatcatctccaaaacatacatttgctatgtgctgatacccatctttattcctatcgcttacgtctacggcttcatatataacaagtcatgtaaaaagtgcaaactttgcggtttggtttaccacccatttaccgaatgtgggagccattgcgtgtgtggagccaagtatgacacgagtgatcggatgaaaatgcacagatcttccggcctgtgccccggctacaagagcctacgcgcggcaaggtcgatgtgtaagtctaaagggcctgccccaattctctccctgctttcagctgtactgatcttgactttcgtgacacccatcaccgccattagtctcaaggacgaggagaaagaaacttataagctgcctgagttaccagatgacaaagtcaatctggaaacaaagatcgatctctacttccagatgtgccttattaactatgcaaccacgtgggctctgatattttgtgtgttgatcaccgcctgcctattcaagaaactgcagcataagtttctcgactactacgcggtttattgtcacgagtgcgacatgtaccacgagaaaacaagcctgaagtataatggagatttctccaacaaatgtcggcaatgcacttgcgaacagtacgaggacgccaccggtcttctgacacatcgcaagtcttataatcgattggtgcagtacaaggcaaaatggactctcaactttctgattacctatgctatcttagtcatcattaaggatagcgtgatgatagtaggcgcctcaaacacagacgttaaagattgtctggaccaagaagagatcacctggaattgcactgggccgttcctaaacatgggaagatgtacgaggccccagaagaaagaaaattacggcaacattgctacacagctcaagggtctggatgtgcttagtgccttggacatgcctgcagtcgggaagatcccagaggatattgccggagctctgtcctacatcgaaagcaaaaagacctatcacgagcagctcactctggagtttgcgatgcttacccggtactgcgacttctataaacaatacgcagataattctggctattcacagacaacctggcgtgcctacatacgcagtcatgactttggcgtgtgtatcatgtatcccaaccagcacttctgcagatgtgtcaagatgggggaaaaatgcactagctccaattgggactttgctaaccagatggccaattactacaacggaaagcaaaataggttcaacaaagatctgaatttggcactctatacaatgcatcacgcctttcggggttctacgtcgtacctgattagcaaggtgttacacgagaagaaatatgaccagctgaccaacctactcactcagctgaagacaaaataccctggcaatgctcttttgaaggccctgatcgggtatcagatttacctcaaatccctgtcagaaatgagttctttcaccccagatgagttatgggacgatctgcaatatgttcccgcaccgacattcaagcctaaccttggacgaagcggcgacaacgaatacaagtttgataaatcccgcatcgtggacccccagactacctgtacgtcattgaagggtgtaaattgcctcagcccaagatctagggcgtccgtcagtgatataattgcttgtgggcaggccacccagcctgcactgttctacgtgcccaacgacaaaatccatcaaagcaatacagatcagaaccagtattgcattggcgactctcactgcctaactaagtttaccccaatcacagaggagctgctcgccgctgttaaaaagtccaagtgtcaagccttcgatctggacaatatagtgaaaacttcaaccagtacgggagtccggagctgccttgtgaagaaatttggcaactgtaatacaaccaaccaggtatggcccatcactatttgctcggacgatcagtactattacacagacaccaagcagtcctatgattcttaccaagacatcgggcatttctgtttgagccctcgctgctcaactattagatatccagtgaatccgaaacacctgagtgcatgtacctggacagaagagtacacgcccgttgataagatctccgtcaccaacatagaagagattgagcagtacaagaaggctttactccagaagctgcagactggacttaatatctttaaatataggaagacatctaacctgcctcacatcaaaagcatgtacaagtatattaccgtgcaaggtacaggcactgccgaaggggtggagaatgcgtacatcgaatccgagatgccagccttggctggatcaagcagtggcttcaaagtcctctctaaggaaggtaaccatctgtttgacgttgtggcatatattaagtccgccagctactcgtcagtgtataataaactatactctaccgggcccacgctgggcataaacgtaaagcacgatgagaaatgcacaggaccttgtccagctaacatcccccataagaccggctggctcactttcgcccgtgagcggaccagtacatgggggcgagaagagtacggatgcctggcaatttccgacggttgtgtctttggcagctgccaggatatcattaaaccggaaatgactgtgtatagaaagcagaccgacgagatcgttacagtggaactttgcttgacgttcgtcgataagacctactgtactgagctgaatgcggtgacacctataatctctgacttatttgaggttcagttcaaaaccgtggaaagctattccctcccaaagattgtagccatcaaaaaccaccaaattttcgtcgggcagatcaatgtgataggaactaactcaaagggctgcggtaatgtgcaggtctttaacgggacaaattacggcagtggaacccccaggttcgattatctgtgtcatcttgctagccgccgggaggttattatgagaaaatgctttgacaacgactaccaagcctgtaagttcctgcagcagccttcttcctttaggctagaagaggaaggcgagacggtgactatcatcgattataagaaaattctcgggaccataaagatgaaagcaatcttcggagacgtaaagtaccgcacattttcagagaaagtggatattaatgctgaaggcgtctgcgccggttgtatcaactgcttcgagcgaattaattgtgaatttaccatccacagtactgtggagacaagctgccccctggttgcagactgtcagttgttccacgatcggctgttaataaccccaaacgagcataagtacgccatcaaggctatttgcaaagacaagccttccaatacactccgtttttctatctgcaacactaaagtggaagcgaccgtcacgattatcgatgccaagcccatactggagcttgcaccagtggaccaaacagcttatattaaagaaaaggatgagagatgtaagacctggctgtgcagggttaaagacgaaggggtggccgtcttgctcgagccgttcaagaatctgttcggatcgtacatcggcatcttttatggtattatcctagtagtgctggccatacttgtttgtatttacatcgtgctccctgtctgcttcaaaattaaggatactctgaaaaagcacgaggacgcttataaacgcgaaatgaagatccggtga

SEQ ID NO: 10999 - RNA, 4335 nt, synthetic construct
  misc_feature 1..4335: note = derived and/or modified CDS sequence (opt3) from TVTV(AR42)__KX891322.1__GP
  source 1..4335: mol_type = other RNA
atgagaaacatgatcgtgttcgccctgctcaccattgtcgctgcaagccccgtttacaagaggtgctttcaggacggcgccatagtgcggcaagagtattccaaaaatgcggtaacagaagtgtgtcttaaggatgacgtctctatgatcaaaactgaggctgaatacttcaagaactcaacgggggtgtttagtaaaaatattgcctatcgcaagtggctggttagcgattggaacgagtgccgacctcagaagtccgcaaatggacacatcaacgtgattgaagtccagccagacttgtctttacagaccaattcgtacgtgtgtgccgctacatgcgtaatctcaatagataaagagactgcacaagttcgtctgcagaccgacacaaccaaccatttcgagatcagcggtactacagtgaagagtggctggtttaaatccaccacgtatctaactctcgatcagacctgtgaacacctgaagatttcttgcgggagcaaatccgtccagcttcatgcctgtttcaatcaacacatgtcatgcgtgagatttctgcataggacaatcttgccgggaaacattgctaatagtatctgtcagaacatagagattatcattctcactagcctgtctctgttcatctttctcttcttaaccatcatttccaagacatacatatgctatgtgctgatccccatttttatccctatagcctacgtctacggcttcatttataataagtcatgtaaaaagtgcaaactttgcggtttggtttaccacccatttaccgaatgtgggagccactgcgtgtgtggagcgaagtatgacacgagtgatcggatgaaaatgcatagatcttccggcctgtgccccggctacaagagcctacgcgcagccaggtcgatgtgtaaatctaaggggcctgcttccatcctctcactgcttagtgccgtactgatcttgactttcgtgacaccaattaccgcaatcagcctcaaggacgaggagaaagaaacttataagctgtccgagttacccgatgacatggtcaacctggaaaataaaattgatctctacttccagatgtgccttataaactatgctacaacctgggccctgatcttttgtgcgttgattacggcctgcctattcaagaaactgcagcacaagtttctcgactactacgcagtgtattgtcatgagtgcgacatgtaccacgaacggcgcggactgaagtataacggtgatttctctaataaatgtcgacaatgtacctgcggccagtacgaggacgctacagggcttctgactcacagaaagagctataactgcttggttcagtacaaagccaagtggatgctcaattttctgatcacctatgctatcttagtgattataaaagattcagtcatgatcgtgggagccagtgacacagatgtaaaggactgcctggatcaagaggaaattacttggaactgtaccggccctttcctaaatatgggttcctgcacaaggccacagaagaaagagaactacgggaatatcgcaacccagctcaagggactggacgttcttagcgccttggatatgccggctgtgggcaaaattcccgaagacatcgcgggcgcactgtcttacatagagtcaaagaaaacttatcatgaacagctcacgctggagtttgccatgcttacacggtactgtgatttctataagcaatacgctgacaacagtgggtatagccagaccacttggcgtgcctacatccgctcccacgactttggagtctgcattatgtatcctaatcagcatttctgtagatgcgtgaagatgggtgagaaatgtacctcttcgaactgggattttgcaaatcagatggccaactactacaatggcaagcaaaacaggttcaataaagacctgaacttggctctctatacaatgcaccatgcctttcgggggagcacctcctacctgatctcaaaggtcttacacgagaaaaagtatgatcagctgactaacctactcacacagctgaaaacgaagtacccaggaaatgcacttttgaaggcgctgattgactatcagatctacctcaaaagtctgtctgaaatgagctccttcacccccgatgaattatgggacgatctgcaatatgtgcctgctccaactttcaagcccaaccttggccgatcagaggacaatgaatacaaatttgataagagccgcatagttgacccgcagacaacctgcacatctttgaaaggtgtgaactgtctctcccctagaagtagggccagcgtatctgatattatcgcatgcgggcaggccactcagcccgctctgttctacgtcccaaatgacaagattcaccaatccaacaccgatcagaatcagtattgcatcggcgactcacattgtctaacgaagtttacccctataacagaggagctgctcgccgcagtgaaaaagagtaaatgccaggctttcgacctggatgacatcgttaagactagcccctcgaccggagtgcggtcctgtcttgtcaaaaagtttggcaactgcaatacaactaaccaagtgtggccaattaccatctgttctgatgaccagtactattacacggatacaaagcagagctatgactcaaatcaagatattgggcacttctgcttgagtccccgctgttccaccatcagataccctgtaaacccaaaacatctgtctgcctgcacttggacagaagagtataccccggtggacaagataagcgttactaatattgaagagatcgagcagtacaaaaaggcgttactccagaaactgcagaccggacttaacatctttaagtacaagaaaacatccaatctgccccacattaagcctatgtataaatacatcacggtccaaggtaccgaaactgccgagggcgtggaaaacgcttatattgagtcagaaatgccagcattggccgggagcagttctggattcaaggtgctctccaaagagggcaaccacctgtttgatgtcgttgcttacataaagagcgcctcgtattcatctgtgtacaataaactatatagtacaggtcccaccctggggatcaacgtgaagcatgacgagaagtgtacaggcccttgcccagcaaatattccccacaaaactggatggctcaccttcgcgagggaacgtacgtccacatggggctgtgaggaatacgggtgcctggccatcagcgatggatgcgtatttggttcttgtcaggacattatcaagccggagatgaccgtctaccggaaacagactgatgaaatagtgaccgttgagctttgcttgacattcgtggacaagacttattgtaccgagctgaacgctgtcacacctatcattagcgacttatttgaagtgcagttcaaaacggttgagtcctactcactcccaaagatcgtggccattaagaatcatcaaatcttcgtaggccagataaacgatattgggacctatagtaaaggatgcggcaatgtccaggtgtttaacggtactaattacgggagcggcacaccccgattcgactatctgtgtcaccttgcatctagaaaggaagtgatcatgaggaaatgctttgataacgactaccaggcttgtaagttcctgcaacagccttcctcatttcgcctagaggaagagggagagaccgtcactatcattgattataaaaagatactcggcacaatcaagatgaaagccattttcggggacgttaagtacaaaacctttagtgaaaaggtggatatcaatgcagagggagtatgcgccggctgtattaactgcttcgaaagcatcaattgtgagtttacgatacattccactgtggagacctcttgccccctggtcgctgactgccagttgttccacgatcggctgttaatcacaccaaacgaacacaaatacgcgattaaggccatctgtaaggacaaaccttcgaataccctcagatttagcatttgcaacactaaggtggaggcaacagttaccatcatagatgctaaacccattctggaacttgccccagtggaccaaacagcctatatcaaggagaaagacgaaaggtgtaagacttggctgtgccgcgtcaaggatgagggtgtggctgttttgctcgagccgttcaaaaacctgttcgggtcatacatcggaatattttatggcatcattctagtggtcctggcaattcttgtatgtatctacattgtgctccctgtttgcttcaagatccgagacaccctgaaaaagcatgaagatgcctataaacgggagatgaagatacgttga

SEQ ID NO: 11000 - RNA, 4335 nt, synthetic construct
  misc_feature 1..4335: note = derived and/or modified CDS sequence (opt3) from TVTV(Eklund)__KR149248.1__GP
  source 1..4335: mol_type = other RNA
atgagaaacatgatcgtgttcgccctgctcaccattgtcgctgcaagccccgtttacaagaggtgctttcaggacggcgccatagtgcggcaagagtattccaaaaatgcggtaacagaagtgtgtcttaaggatgacgtctctatgatcaaaactgaggctgaatacttcaagaactcaacgggggtgtttagtaaaaatattgcctatcgcaagtggctggttagcgattggaacgagtgccgacctcagaagtccgcaaatggacacatcaacgtgattgaagtccagccagacttgtctttacagaccaattcgtacgtgtgtgccgctacatgcgtaatctcaatagataaagagactgcacaagttcgtctgcagaccgacacaaccaaccatttcgagatcagcggtactacagtgaagagtggctggtttaaatccaccacgtatctaactctcgatcagacctgtgaacacctgaagatttcttgcgggagcaaatccgtccagcttcatgcctgtttcaatcaacacatgtcatgcgtgagatttctgcataggacaatcttgccgggaaacattgctaatagtatctgtcagaacatagagattatcattctcactagcctgtctctgttcatctttctcttcttaaccatcatttccaagacatacatatgctatgtgctgatccccatttttatccctatagcctacgtctacggcttcatttataataagtcatgtaaaaagtgcaaactttgcggtttggtttaccacccatttaccgaatgtgggagccactgcgtgtgtggagcgaagtatgacacgagtgatcggatgaaaatgcatagatcttccggcctgtgccccggctacaagagcctacgcgcagccaggtcgatgtgtaaatctaaggggcctgcttccatcctctcactgcttagtgccgtactgatcttgactttcgtgacaccaattaccgcaatcagcctcaaggacgaggagaaagaaacttataagctgtccgagttacccgatgacatggtcaacctggaaacaaaaattgatctctacttccagatgtgccttataaattatgctaccacgtgggccctgatcttttgtgcgttgattaccgcctgcctattcaagaaactgcagcacaagtttctcgactactacgcagtgtattgtcatgagtgcgacatgtaccacgaacggcgcggactgaagtataacggtgatttctctaacaaatgtcgacaatgcacatgcggccagtacgaggacgctactgggcttctgacccacagaaagagctataattgtttggttcagtacaaagccaagtggatgctcaactttctgatcacatatgctatcttagtgattataaaagattcagtcatgatcgtgggagccagtaatactgacgtaaaggattgcctggaccaagaggaaattacctggaactgtacaggccctttcctaaatatgggtaggtgcacccggccacagaagaaagagaactacgggaatatcgcaactcagctcaagggactggatgttctttccgccttggacatgccggctgtgggcaaaattcccgaagatatcgcgggcgcactgagctacatagagtctaagaaaacgtatcatgaacagctcacactggagtttgccatgcttacccgttactgtgacttctataagcaatacgctgataactcagggtatagtcagactacctggcgcgcctacatcagaagccacgactttggagtctgcattatgtatcctaatcagcatttctgtaggtgcgtgaagatgggtgagaaatgtacatcctctaactgggactttgcaaatcagatggccaactactacaatggcaagcaaaaccggttcaataaagatctgaacttggctctctataccatgcaccatgcctttcgagggtcgactagctacctgatctccaaggtcttacacgagaaaaagtatgaccagctgacaaacctactcacgcagctgaaaaccaagtacccaggaaatgcacttttgaaggcgctgattgattatcagatctacctcaaatcactgagtgaaatgtctagcttcactcccgacgaattatgggatgacctgcaatatgtgcctgctccaacattcaagcccaaccttggccgctccgaggataatgaatacaaatttgacaagtcaagaatagttgatccgcagaccacatgcactagcttgaaaggtgtgaactgtctctctcctaggtcccgggccagtgtaagcgacattatcgcatgcgggcaggccacccagcccgctctgttctacgtcccaaatgataagattcaccaatctaacacggaccagaatcagtattgcatcggcgattcccattgtctaaccaagtttacacctataactgaggagctgctcgccgcagtgaaaaagtcaaaatgccaggctttcgacctggacaacatcgttaagaccagtcccagcacaggagtgcgctcgtgtcttgtcaaaaagtttggcaattgcaacactaccaatcaagtgtggccaattacgatctgttccgatgaccagtactattacacagataccaagcagtcttatgacagctaccaagatattgggcacttctgcttgtcacccagatgtagtactatcaggtatcctgtaaacccaaaacatctgtccgcctgcacatggaccgaagagtacactccggtggacaagatatctgttaccaatattgaagagatcgagcagtacaaaaaggcgttactccagaaactgcagacaggacttaacatctttaagtatcgtaagacgagcaatctgccccacattaaacctatgtacaagtatatcaccgtccaaggtactgaaacagccgagggcgtggaaaacgcttacattgagtccgaaatgccagcattggccgggtcaagcagtggattcaaagtgctctctaaggagggcaaccacctgtttgatgtcgttgcttatataaaatccgccagctactcgtcagtgtataataagctatactctaccggtcccacactggggatcaacgtgaaacatgacgagaagtgtactggcccttgcccagcaaatattccccacaagaccggatggctcacgttcgcgcgggaacgaacaagtacctggggctgtgaggaatacgggtgcctggccatctccgatggatgcgtatttggtagctgtcaggacattatcaaaccggagatgactgtctatagaaagcagaccgatgaaatagtgacagttgagctttgcttgactttcgtggacaaaacctactgtacagagctgaacgctgtcacgcctatcatttctgatttatttgaagtgcagttcaagaccgttgagagctattccctcccaaaaatcgtggccattaagaatcatcaaatcttcgtaggccagataaacgacattgggacttactcaaagggatgcggcaatgtccaggtgtttaacggtacaaattatgggagtggcacccccaggttcgactacctgtgtcaccttgcaagccgcaaagaagtgatcatgcggaagtgctttgataacgactatcaggcttgtaaattcctgcaacagccttcttcctttagactagaggaagagggagagactgtcacaatcattgattacaagaaaatactcggcaccatcaagatgaaggccattttcggggacgttaaatacaagacgttttcagaaaaagtggatatcaatgcagagggagtatgcgccggctgtattaactgcttcgaaagtatcaattgtgagtttactatacatagcaccgtggagacatcctgccccctggtcgctgactgccagttgttccacgataggctgttaatcaccccaaacgaacacaagtatgcgattaaagccatctgtaaggacaagccttctaatactctccgcttttcgatttgcaacacaaaagtggaggcaaccgttacaatcatagatgctaagcccattctggaacttgccccagtggaccaaactgcctacatcaaagagaaggatgaacgatgtaaaacctggctgtgccgggtcaaggacgagggtgtggctgttttgctcgagccgttcaagaacctgttcgggagctatatcggaatattttacggcatcattctagtggtcctggcaattcttgtatgtatctatattgtgctccctgtttgcttcaaaatcaaggacacgctgaaaaagcatgaagatgcctacaaacgtgagatgaagataagatga

SEQ ID NO: 11001 - RNA, 4335 nt, synthetic construct
  misc_feature 1..4335: note = derived and/or modified CDS sequence (opt3) from JCV(3324-04)__HM007357.1__GP
  source 1..4335: mol_type = other RNA
atggaggtgctgaacctcatctggcttctgaccttgtgcttagccagccccgtcttccagagatgttttcaagacggcgctattgttaagcagaatccttccaaagaagcagtgacagaggtatgcctgaaggatgacgtgtctatgataaaaactgaagccaagtacgtcaaaaacacgaccgggacattcgcgaataacatcgctatgaggaagtggctagtggccgattggcacgactgtcggccacagaagtcaagtggaggtcatattaatgttatcgaggtgggcgatgacctcagcctgcacactgaatcctatatttgctctgcagattgtgtcatcaccgtggacaaagagacagcccagatacgccttcaaaccgataacactaatcattttgaggtagctgggacaaccgttaagtcgggatggttcaaatcaacgacttacatcaccctggaccagacatgcgaacacttgaaggtgagctgtggcccgaaaagtattcagtttcatgcatgcttcaaccagcacatgtcctgtgtccgatttctccaccgtactatcctgcccggttctattgccaatagcatctgccaaaacatagagattatcattctggtgaccctctccttagtgatcttcatctttctgacaattgtctcaaagacctatatatgttaccttttgatgcctatcttcattccaatcgcttttatatatgggtggatttacaataagagttgcaaaaagtgcaaactgtgtggcctagtttatcatcccttcacggaatgcggaactcactgtgtgtgcggcgccagatacgagacaagcgataggatgaagctccatcgggcgtctgggctgtgtcctggatacaaatcccttcgcgcagccagagtaatgtgcaagtcaaaaggtccagctagcgtgctgagtatcatgaccgccgtcttgatcctcacttttgtgacacccatttctgcaatggttatcggcgagtccagcgaaatttataccctggaggacttacctgatgacatggtgcagatggctgaaaggataaacatctactatcagattatcatcattaattacgggataacgtgggccttcctgctccttggactgttgctagcgtatttctttcggaagtaccagcaccgcttcctggacttttatgccatgtactgtgaggaatgcgatatgtaccacgagaaggcaggcctcacccattggggtgacttcacaaacaaatgtcgacaatgcacttgtgggcagtatgaggatatcaccggactgatggtccacaagaaatcgtacaattgccttgtgaagtataaagctaagtggattagagacatcctgattacatacttggtaatcatactcgttaaggattctctgttatttgtgggcgccactggcaccgacttcgctacatgcatcgatgagaaaaccgtcacttggaactgtacggggccatttctgaacctaggaaggtgcgacaagtcccagaaaaagacaaattatgccgatattgcaaaccaactcaaaggtctgggcgtgatctcagtccttgacattccgatgatcaagaagatgcccgatgagataagtgggagcttgaaatacattgacaatctggaaacctatcatgagcagctcactgccgaatacgctttcctgacccggtactgtgactattacacacagtataccgataactccggatactctcagactgtgtggcgtacatatcttcgcagccacgactttggcgcgtgcgttgtgtaccctaatcaacatttctgtagatgcgtaaagtatggtgataaatgtaactcagcaaagtgggactttgccaatgagatgaaaacgttctacaccgggcagaaggctaagtttaacaaagatctgaatttggccctcctggtcttacacaaggcattcaggggcactggaacagcctacatcgctgaggccatggcacggaaagacaacggcagtatggcgcacttcgctctggaagtgcgaaagaaatttccaaccaatgccctactcgcagccctgattgattatatcgtttaccttcagtccttggctgagataagcacattcgaactggacgaggattgggaagactttaagtataaacccgagcctactgagtctaccatccaggcccgctcacatagagatgaccaatacaacttcaagaatgcagctagtgggagcaacgtgaaggtctgcaaaaatattcagaaggtgctctgtatctccccaaggtctcgggccaaatttgaaaacattatcgcgtgcggagagcacgccaacccctcggtatatatgatgccgaatgtgagcatataccagtcctcaagtgaacgctctcattattgtattgctgatagccactgcctggaggagtacgaagttgtcgagacggaattactgaacgcacttaagaaatccaagtgctgggtgaaggagatggacgacgtgatcttgcacaaacagtcagatggtctcagaagctgtaggatgaaggacaccggcaattgcaacgtccaagaaaatgattggaacatcgttctgtgtgagaatgggaactactattactctgagattcataaagactatgataaggaccaggatgtgggacacttctgcctatcccctcgttgtaatacaatccggtaccccattagtaaacgacatataagaagctgcaactggcagatctctcactccactattgacaagatcgccgtgcaggaactggctgatattgagcaatataagaaagccatctcacagaagctccagaccagtctgagcatatttaaatacatcaagactaaaaatcttccacatattaagcctgcatataagtacatcacagtagaaggcgtcgagaccgtggaaggtattgagaacgcgttcatcgagtcggaaatacccgccttggctgggacggccattggctttaaaatcaattccagggagggaaactacctgatggacgttatcggctatgtgaagtctgcaagctactcagctacatataccaaattatacactacagggccaaccattggaataaatactcgccacgatgaaaagtgtaccggtccctgccctgccgtcatcgaccacaaagatggctggctcacattcagtaaggagcggacgtccacctgggggtgtgaagagtttggatgcctggcagtgtctgacggctgtgttttcggtagctgccaagacattatcaaagatgagcttgccgtgtatagaaagactacagaagaactgaccacagtagaattgtgcctcactttttccgacaagacctactgtacgaacctgaacgctattacaccaatcataaccgataaattcgaggtccagttcaagactgtggaggcgtataccctaccgaggatcattgccgtgaaaaatcatgaaatcaaggtcgggcagattaacgacctgggcgtttactcaaaaggatgcggcaatgtgcagaaggtaaacgggacaaattacggaaacggcgcaccccgctttgattatctctgtcacctggctagccgaaaggaggtgatccttcggaaatgcttcgacaatgattaccaagcctgtaagtttttgcagagtccttcttcctatcgtctggaagaacatcagggtactgtcaccgtgatagactacaaaaagattttagggacaatcaaaatgaaggccatcctcggagatgttaagtataaaaacttccagagcaatattgaaatcaacgctgagggcacgtgcgcaggttgtataaattgctttgagaacattcactgtgagttcaccatccatactacagtggagacctcgtgcccaattgtcactgactgtgtgtcatttcacgatagaatcctgataacacccgacgaacacaagtacgcccttaaagttgtgtgccaagacaagcctaaagtctctctgaagttcaagatttgcaataccaacatcgatgcgagtatgacgatcgtagactccaaaccaattctagagctcgctcccgtggatcagactgcctatatcagggaaaaggacgagcgctgtaaaacctggatgtgccgggttagagatgagggctttcaggtgattctggaaccgttcaagaatttgtttgggagctacataggaatcttctacacaggcattctgtctatcatctgtttactcattgtcatatatatcattctgcctatctgcttcaaacttagggacaccctgcgacagcatgaggatgcatacaagaaggaaatgaaaattcgctga

SEQ ID NO: 11002 - RNA, 4335 nt, synthetic construct
  misc_feature 1..4335: note = derived and/or modified CDS sequence (opt3) from JCV(61V2235)__U88058.1__GP
  source 1..4335: mol_type = other RNA
atggaggtgctgaacctcatctggcttctggccttgtgcagcgcttcccccgtcttccagagatgttttcaagacggagcaattgttaagcagaatccttctaaagaagccgtgaccgaggtatgcttaaaggatgacgtgtcaatgataaaaacagaagcgaagtacgtcaaaaacactacggggaccttcgctaataacatcgccatgaggaagtggctggtggcagattggcacgactgtcggccacagaagagtagcggaggtcatattaatgttatcgaggtgggcgatgacctatccctccacacagaatcttatatttgctcggccgattgtgtcatcactgtggacaaagagaccgctcagatacgcctgcaaacagataacaccaatcattttgaggtagcagggactacagttaagtcaggatggttcaaaagcaccacgtacatcactcttgaccagacctgcgaacacctgaaggtgagttgtggcccgaaatccattcagtttcatgcctgcttcaaccagcacatgtcttgtgtccgatttttgcaccgtacaatcctccccggtagcattgctaattccatctgccaaaacatagagattatcattctggtgactctgtcactcgtgatcttcatctttttaagtattgtcagcaagacctatgtttgttacctgcttatgcctatattcacaccaatcgcctttatttatgggtgggtgtacaataagtcttgcaaaaagtgcaaattgtgtggactggtatatcatcccttcaccgaatgcggcacgcactgtgtgtgcggcgcgagatacgagaactccgataggatgaagctacatcgggcatcagggctctgtcctggatacaaaagcctgcgcgccgctagagtcatgtgcaagagtaaaggtccagcctctatcctttccataatgactgcaattctgatcttgacatttgtgacccccatcagcgctatggttattggcgagtcgtctgaactctatactctggacgatttacctaatgacatggtgcagatggccgagagggtcaacatctactatcagattacaataatcaattacggggtgacctgggcgttcttctgtctgggactcattcttgcctactttttcaagaagtatcagcacaaatttctggacttctatgcaatgtactgcgaagagtgtgatatgtaccacgaaaagtccggcttgacgcattggggtgactttaccaacaaatgccggcaatgtacatgcgggcagttcgaggatgtagctggactaatgatccacaagaaatcatataactgcctggttaagtacaaggccaaatggatccgcgacattctcataatctatctggctatgattcttatcaaggatagtctgttgtttgtgggcgccagcggcactgacttcgcagcctgtattgatgagaaagtcgtgacctggaattgcacagggccatttctcaacctgggacgatgtgacaagtcccagaaaaaggcttcttacgcgggtatcgcagatcaattaaagggcctgggggtcataagcgtgctagacatcccgatgattaaaaatatgcccgatgaaatctcaggaagtctcaagtatattgactccctggagacttaccatgaacagcttaccgccgagtatgctttcttgacaagatactgcgactactatacccagtacactgataaaagcggctattctcagacggtttggaggacatacctgcggtcacacgactttggtgcctgtgtggtatatcctaaccaacatttctgccgttgtgtcaagtacggggataaatgcaatagtgcaaagtgggactttgccaacgaaatgaagaccttctatactggccagaaagtgaagttcaataaagatctcaacctggcccttctggttttgcacaaggcttttcgcggaaccggcacagcatacgtggcggaggctatggccagagaggacaatgggagcatggcacacttcgccctcgaaatcaggaaaaagtttccaaccaacgctctgttagccgcactgatagattacattgtctatctacagtccctcggagagatcgctactttcgaactggacgaggattgggaagactttaaatacaagcccgagcctacagagtctacgccacaggtgcggtcgcatcgaaatgatcaatataacttcaagaatgccgaaagcaactccgacaccaaagtatgtaagaatgtgcagaaagttctttgcatttcaccccgcagtaaggcgaaatttgagaacatcatagcctgtggtgaacacgctaacccgtctgtctacatgatgcctaatgtgagcatctatcagtccaactcagagagaagccattactgcattgcaggctctcactgcttggagaagtatgaagtggtcgagactgaactgctcaatgccctgaagaaatccaagtgttgggctaaagagatggatgacatcattttacacaagcagagtgacgggctgaggagctgccggatcaaagatacaggaaactgtaatgttcaagaaaacgactggaccatagtgctttgcgagaatggcaactactactattctgaggtgcataaggattacgacaaggatcaggacgtaggtcacttctgtttgtcaccccgctgcacaactattagatatccaatctccaaaaggcatatcaagaaatgtgaatggcagattagtcacagcaccatcgataagatttcggtccaggagctcgccgacatagaacaatacaaaaaggcaatctcccagaagctgcagacgtctctaagcatttttaaatatgtgcgtaccaagaatctgcctcatatcaaacccgcgtacaagtatattacagttgagggggtggaaactatcgagggcatagagaacgccttcatcgaatcagagattccagctctcgccggaaccgcaatcggctttaaaattaatagtcgggaagggaactacctgatggatgtcatcggatacgtgaagtccgcttcttatagcgccgtttacacaaaactttatactaccggtcccacgataggcattaatacaaagcacgacgagaagtgcaccgggccttgtccagcaatcatcgatcacaaagacggatggttgactttctccaaggaacgaacatcaacctggggctgcgaggagtttggttgtctggccgtgagcgatgggtgcgtattcggcagttgccaagacattataaaagacgaattagctgtctacagaaagactaccgaggaactcacaacggtggagctgtgtcttaccttctctgataaaacttattgcacaaacctgaatgcgatcaccccgattatcacagacaagtttgaggtgcagttcaagactgtcgaatcctacaccttgcccagggttattgccatcaaaaaccatgagataaaggtgggacagatcaacgatctcggcgtatatagcaaagggtgtggaaatgtgcagaaggtcaacggcacgaattacggtaacgggtcgcctcgctttgactacctgtgccacctagcatcacggaaagaagtgattctgagaaagtgtttcgataatgactatcaggcttgcaagtttctccaatctccaagttcctacaggctggaggaacatcagggaacagttaccgtgatcgattataaaaagattcttggcactatcaaaatgaaggccatattgggtgacgtcaaatacaagaactatcagaataacattgagatcagcgccgagggcacctgtgctgggtgcatcgattgtttcgaaaatattcactgcgagtttacaatccatactaccgtggaagcatcttgtcccataacaacggagtgcgttagcttccacgaccgcattctgatcacccctgatgaacacaagtacgccttaaaaattgtgtgccatgacaagccaaaagtctccctcaagtttaaaatctgtaacactcacgtagacgcggctatgacaatagtggattcaaagcccattctggagcttgccccggttgaccaaaccacttatatccgagagaaggatgaacggtgcaaaacatggatgtgtcgtgtgagagacgagggattccaggtcatcctggaaccttttaagaatctattcggcagttacattgggatcttctacaccggcattctcagcataatctgcctgttgattgtggtatatatcatcctgccaatttgttttaaattaagggatacgctccgccagcatgaggacgcatacaagaaagaaatgaagatacggtga

SEQ ID NO: 11003 - RNA, 4335 nt, synthetic construct
  misc_feature 1..4335: note = derived and/or modified CDS sequence (opt3) from JCV(61V2235)__HM007351.1__GP
  source 1..4335: mol_type = other RNA
atggaggtgctgaacctcatctggcttctggccttgtgcagcgcttcccccgtcttccagagatgttttcaagacggcgcaattgttaagcagaatccttctaaagaagccgtgaccgaggtatgcttaaaggatgacgtgtcaatgataaaaacagaagcgaagtacgtcaaaaacactacggggaccttcgctaataacatcgccatgaggaagtggctggtggcagattggcacgactgtcggccacagaagagtagcggaggtcatattaatgttatcgaggtgggcgatgacctatccctccacacagaatcttatatttgctcggccgattgtgtcatcactgtggacaaagagaccgctcagatacgcctgcaaacagataacaccaatcattttgaggtagcagggactacagttaagtcaggatggttcaaaagcaccacgtacatcactcttgaccagacctgcgaacacctgaaggtgagttgtggcccgaaatccattcagtttcatgcctgcttcaaccagcacatgtcttgtgtccgatttttgcaccgtacaatcctccccggtagcattgctaattccatctgccaaaacatagagattatcattctggtgactctgtcactcgtgatcttcatctttttaagtattgtcagcaagacctatgtttgttacctgcttatgcctatattcatcccaattgcctttatctatgggtgggtgtacaataagtcttgcaaaaagtgcaaattgtgtggactggtatatcatcccttcacagaatgcggcacccactgtgtgtgcggcgcgagatacgagacgtccgataggatgaagctacatcgggcatcagggctctgtcctggatacaaaagcctgcgcgccgctagagtcatgtgcaagagtaaaggtccagcctctatactttccattatgactgcaatcctgatcttgacatttgtgacccccattagcgctatggttatcggcgagtcgtctgaagtgtatactctcgacgatctgcctaacgacatggtccagatggccgagagggtgaatatttactatcagataatcattatcaactacggggtaacatgggcgttcttactgctcggacttatcctggcctatttctttaagaagtaccagcacaaattcttggacttttatgcaatgtactgtgaagagtgcgatatgtaccacgaaaagtccggcctaacccattggggtgacttcacgaataaatgtcggcaatgcacctgtgggcagtttgaggatgttgctggactgatgattcacaagaaatcatataactgcctcgtgaagtacaaggccaaatggatacgcgacatcctgattatctatcttgctatgattctgatcaaggatagtctcttgttcgtcggcgccagcggcacagactttgcagcctgcatagatgagaaagtggtcacttggaactgtaccgggccattcctgaatttaggacgatgcgacaagtcccagaaaaaggcttcttacgcgggtatcgcagatcaactgaagggcctaggggtgattagcgttctcgacatcccgatgattaaaaacatgcccgatgaaatctcaggaagtctgaagtatatagactcccttgagacataccatgaacagttgactgccgagtatgcttttctgaccagatactgtgactactatacacagtacaccgataatagcggctattctcagactgtgtggaggacgtacctccggtcacacgacttcggtgcctgcgtagtctatcctaaccaacatttttgtcgttgcgtgaaatacggggataagtgtaatagtgcaaaatgggacttcgccaacgaaatgaagacattttataccggccagaaggttaaattcaataaggatctgaaccttgctctgttggtgctccacaaagccttccgcggaactggcaccgcatacgtcgcggaggctatggccagaaaggacaatgggagcatggcacactttgccctggagattaggaaaaagttcccaacaaacgctttactggccgcactaatcgattacattgtgtatctccagtccctgggagaaatcgctacctttgagcttgacgaagattgggaggacttcaaatacaagcccgaacctactgagtctacaccacaggtacggtcgcatcgaaatgatcaatataactttaagaatgccgagagcaactccgacacgaaagtgtgcaagaatgttcagaaagtcttgtgtatatcaccccgcagtaaggcgaaattcgaaaacatcattgcctgcggtgagcacgctaacccgtctgtgtacatgatgcctaatgtgagcatctatcagtccaactcagaaagaagccattactgtattgcagattctcactgcctggagaagtatgaggtcgttgaaaccgagctcctgaatgccttaaagaaatccaagtgctgggctaaagaaatggacgacatcatactgcacaagcagagtgatggccttaggagctgtcggattaaagacactgggaactgcaatgtgcaagagaacgattggacaatcgtgttgtgtgaaaatggaaactactactattctgaggtacataaggactacgataaggaccaggatgtcggccacttttgcctctcaccccgctgtaccacaatcagatatccaatttccaaaaggcatatcaagaaatgcgagtggcagattagtcacagcactatagacaagatctcggtgcaggaactggccgatattgagcaatacaaaaaggcaatctcccagaagctacagacctctctgagcattttcaaatatgttcgtacgaagaatctccctcatatcaaacccgcgtacaagtatataaccgtggaaggtgtcgagacaatcgaagggattgagaacgcctttatcgagtcagaaattccagctctggccggcactgcaatcggattcaaaataaatagtcgggagggcaactaccttatggacgtgattgggtacgttaagtccgcttcttatagcgccgtgtacaccaaattgtatacaactggacccaccatcggtatcaatacgaagcacgatgaaaagtgtacaggcccttgcccagcaattatagaccacaaagatgggtggctgaccttttccaaggagcgaacttcaacatggggatgtgaagagttcggctgcttagccgtaagcgacggttgtgtctttgggagttgccaagacatcattaaagatgagctcgctgtgtacagaaagaccactgaagaactgaccacagtggaactttgcctgacgttctctgacaaaacctattgtactaacttgaatgcgatcacaccgattatcaccgataagttcgaggtccagtttaagacagttgagtcctacactctccccagggtgatagccatcaaaaaccatgaaattaaggtaggccagatcaacgacctgggagtgtatagcaaaggctgcgggaatgtccagaaggtgaacggaaccaattacggcaacggttcgcctcgcttcgattacctatgtcacctggcatcacggaaagaggttattctcagaaagtgctttgacaatgattatcaggcttgtaagttcctgcaatctccaagttcctacaggcttgaggagcatcaggggacggtgacagtcatcgactataaaaagatattgggaaccattaaaatgaaggccatcctgggcgatgtgaaatacaagaactatcagaataacatcgaaattaatgccgagggtacttgcgctggctgtatcgactgctttgagaacatacactgtgagttcaccattcatacaactgttgaagcaagctgccccatcaccacagaatgtgtgtcttttcacgatcgcattttaatcacgcctgacgagcacaagtacgccctcaaaatagtctgccatgacaagccaaaagtaagcctgaagttcaaaatttgcaataccaacgtggatgcggctatgactatcgttgactccaagcccatccttgaactggccccggtggatcaaacaacctatattcgagagaaggacgagcggtgtaaaacttggatgtgccgtgtcagagatgaagggtttcaggtgatcctagagcctttcaagaatctctttggatcatacattggcatattctacacagggatcctgagtattatctgtttgctgatcgtagtgtatattatattaccaatctgcttcaaactcagggacaccctgcgccagcacgaagatgcatacaagaaagagatgaagattcggtga

SEQ ID NO: 11004 - RNA, 4335 nt, synthetic construct
  misc_feature 1..4335: note = derived and/or modified CDS sequence (opt3) from JCV(61V2235)__KX817316.1__GP
  source 1..4335: mol_type = other RNA
atggaggtgctgaacctcatctggcttctggccttgtgcagcgcttcccccgtcttccagagatgttttcaagacggcgcaattgttaagcagaatccttctaaagaagccgtgaccgaggtatgcttaaaggatgacgtgtcaatgataaaaacagaagcgaagtacgtcaaaaacactacggggaccttcgctaataacatcgccatgaggaagtggctggtggcagattggcacgactgtcggccacagaagagtagcggaggtcatattaatgttatcgaggtgggcgatgacctatccctccacacagaatcttatatttgctcggccgattgtgtcatcactgtggacaaagagaccgctcagatacgcctgcaaacagataacaccaatcattttgaggtagcagggactacagttaagtcaggatggttcaaaagcaccacgtacatcactcttgaccagacctgcgaacacctgaaggtgagttgtggcccgaaatccattcagtttcatgcctgcttcaaccagcacatgtcttgtgtccgatttttgcaccgtacaatcctccccggtagcattgctaattccatctgccaaaacatagagattatcattctggtgactctgtcactcgtgatcttcatctttttaagtattgtcagcaagacctatgtttgttacctgcttatgcctatattcatcccaattgcctttatctatgggtgggtgtacaataagtcttgcaaaaagtgcaaattgtgtggactggtatatcatcccttcacagaatgcggcacccactgtgtgtgcggcgcgagatacgagacgtccgataggatgaagctacatcgggcatcagggctctgtcctggatacaaaagcctgcgcgccgctagagtcatgtgcaagagtaaaggtccagcctctatactttccattatgactgcaatcctgatcttgacatttgtgacccccattagcgctatggttatcggcgagtcgtctgaagtgtatactctcgacgatctgcctaacgacatggtccagatggccgagagggtgaatatttactatcagataatcattatcaactacggggtaacatgggcgttcttactgctcggacttatcctggcctatttctttaagaagtaccagcacaaattcttggacttttatgcaatgtactgtgaagagtgcgatatgtaccacgaaaagtccggcctaacccattggggtgacttcacgaataaatgtcggcaatgcacctgtgggcagtttgaggatgttgctggactgatgattcacaagaaatcatataactgcctcgtgaagtacaaggccaaatggatacgcgacatcctgattatctatcttgctatgattctgatcaaggatagtttactcttcgtcggcgccagcggcacagactttgcagcctgcatagatgagaaagtggtcacttggaactgtaccgggccattcctgaatttaggacgatgcgacaagtcccataaaaaggcttcttacgcgggtatcgcagatcagctgaagggcctaggggtgattagcgttctcgacatcccgatgattaaaaacatgcccgatgaaatctcaggaagtctgaagtatatagactcccttgagacataccacgaacaattgactgccgagtatgcttttctgaccagatactgtgactactatacacagtacaccgataatagcggctattctcagactgtgtggaggacgtacctccggtcacatgacttcggtgcctgcgtagtctatcctaaccagcacttttgtcgttgcgtgaaatacggggataagtgtaatagtgcaaaatgggacttcgccaacgaaatgaagacattttataccggccaaaaggttaaattcaataaggatctgaaccttgctctgttggtgctccacaaagccttccgcggaactggcaccgcatacgtcgcggaggctatggccagaaaggacaatgggagcatggcacattttgccctggagattaggaaaaagttcccaacaaacgctttactggccgcactaatcgattacattgtgtatctccagtccctgggagaaatcgctacctttgagcttgacgaagattgggagggtttcaaatacaagcccgaacctactgagtctacaccacaggtacggtcgcaccgaaatgaccagtataactttaagaatgccgagagcaactccgatacgaaagtgtgcaagaatgttcaaaaagtcttgtgtatatcaccccgcagtaaggcgaaattcaagaacatcattgcctgcggcgaacatgctaacccgtctgtgtacatgatgcctaatgtgagcatctatcagtccaactcagagagaagccactactgtattgcagactctcactgcctggaaaagtatgaggtcgttgagaccgaactcctgaatgccttgaaaaagtccaaatgctgggctaaggagatggatgacatcatactgcataaacagagtgacgggcttaggagctgtcggattaaggatactggaaactgcaatgtgcaggaaaacgactggacaatcgtgttgtgtgagaatggcaactactactattctgaagtacacaaggattacgacaaagatcaagacgtcggtcatttttgcctctcaccccgctgtaccacaatcagatatccaatttccaagaggcacatcaaaaagtgcgagtggcagattagtcatagcactatagataaaatctcggtgcaggagctggccgacattgaacagtacaagaaggcaatctcccaaaaactacagacctctctgagcattttcaagtatgttcgtacgaaaaatctccctcacatcaagcccgcgtacaaatatataaccgtggagggggtcgaaacaatcgagggcattgaaaacgcctttatcgagtcagagattccagctctggccggaactgcaatcggcttcaagataaatagtcgggaagggaactaccttatggatgtgattggatacgttaaatccgcttcttatagcgccgtgtacaccaagttgtatacaactggtcccaccatcggcatcaatacgaagcacgacgagaaatgtacagggccttgcccagcaattatagatcataaggacggatggctgaccttttccaaagaacgaacttcaacatggggctgtgaggagttcggttgcttagccgtaagcgatgggtgtgtctttggcagttgccaggacatcattaaggacgaactcgctgtgtacagaaaaaccactgaggaactgaccacagtggagctttgcctgacgttctctgataagacctattgtactaacttgaatgcgatcacaccgattatcaccgacaagttcgaagtccaatttaaaacagttgagtcctacactctccccagggtgatagccatcaagaaccacgagattaaagtaggacagatcaacgatctgggcgtgtatagcaaggggtgcggaaatgtccagaaagtgaacggcaccaattacggtaacgggtcgcctcgcttcgactacctatgtcatctggcatcacggaaggaagttattctcagaaagtgctttgataatgactatcaggcttgtaaattcctgcaatctccaagttcctacaggcttgaggaacaccagggaacggtgacagtcatcgattataagaaaatattgggcaccattaagatgaaagccatcctgggtgacgtgaagtacaagaactatcagaataacatcgagattaatgccgaaggcacttgcgctgggtgtatcgattgctttgagaacatacattgtgagttcaccattcacacaactgttgaagcaagctgccccatcaccacagagtgtgtgtcttttcacgaccgcattttaatcacgcctgatgaacataaatacgccctcaagatagtctgccacgacaaaccaaaggtaagcctgaaattcaagatttgcaataccaacgtggacgcggctatgactatcgttgattccaagcccatccttgagctggccccggtggaccagacaacctatattcgagaaaaagatgagcggtgtaagacttggatgtgccgtgtcagagacgagggatttcaagtgatcctagaacctttcaaaaatctctttggctcatacattgggatattctacacaggaatcctgagtattatctgtttgctgatcgtagtgtatattatattaccaatctgcttcaagctcagggataccctgcgccagcatgaggacgcatacaaaaaggaaatgaaaattcggtga

SEQ ID NO: 11005 - RNA, 4335 nt, synthetic construct
  misc_feature 1..4335: note = derived and/or modified CDS sequence (opt3) from JCV(3573-03)__HM007354.1__GP
  source 1..4335: mol_type = other RNA
atggaggtgctgagcctcatctggcttctgaccttgtgctccgcctctcccgtcttccagagatgttttcaagacggcgctattgttaagcagaacccttcaaaagaagcagtgacagaggtatgcttaaaggatgacgtgagtatgataaaaactgaagccaagtacgtcaaaaatacgaccgggacattcgcgaacaatatcgctatgaggaagtggctggtggccgattggcacgactgtcggccacaaaagagctccggaggtcatattaacgttatcgaggtgggcgatgacctatctctccacactgaatcgtatatttgctcagcagattgtgtcatcaccgtggacaaagagacagcccagatacgcctgcagaccgataatactaaccattttgaggtagctgggacaaccgttaagagcggatggttcaaaagtacgacttacatcacccttgaccagacatgcgaacacctgaaggtgtcctgtggcccgaaatctattcagtttcatgcatgcttcaatcagcacatgagctgtgtccgatttttgcaccgtactatcctcccctcctcaattgccaacagtatctgccaaaatatagagattatcattctggtgaccctgagcctcacaatcttcatctttttaaccattgtgtctaagacgtatatatgttacctgcttatgcctgtcttcatcccaattgcttttgtttatggttggatctacaacaagtcctgcaaaaagtgcaaattgtgtgggctggtgtatcatcccttcactgaatgcggaacacactgtgtatgcggcgccagatacgagacctcagataggatgaagctacatcgggcgagcggcctctgtcctgggtacaaaagtctgcgcgcagccagagtgatgtgcaagtctaaaggaccagcttccatacttagcattatgactgccgtcctgatcttgacatttgtgacccccatctcggcaatgatgattggtgagtcttccgaagtttatacgctcgacgatctgcctgacgacatggtgcagatggctgagagggtcaatatctactatcagattataatcattaactacggcgtgacctgggccttcttactgctcgggcttgtactggcgtatttctttaagaagtaccagcacaaattcttggatttttatgccatgtactgtaatgaatgcgacatgtaccacgagaaggcaggactaacacattggggcgatttcactaaccggtgtcgccaatgcacctgtggtcagtatgaagacgttacagggctgatcgtgcacaaaaagtcatacaattgcctcgtcaaatataaggctaagtggatccgagatattctgataacttaccttatcattatcctggtgaaagacagtttgctctttgtcggagccaccggcacagatttcgctgcctgcattgacgagaagaccgtgacttggaactgtacgggcccatttctgaacttagggagatgcgataaaagccagaagaaaacatcctataatgacatcgcaaaccaactgaagggactaggtgttatatctgtgctcgatatcccgatgattaagaggatgcccgacgagatcagcggctcactgaaatacattgacaatcttgaaacctatcatgagcagttgactgccgaatacgctttcctgacccggtactgtgattattacacacagtataccgacaacagtgggtactcccagactgtatggcgtacatatctccgcagccacgattttggagcgtgcgtcgtgtaccctaatcaacatttctgtagatgcgttaagtatggcgacaaatgtaactctgcaaagtgggattttgccaatgagatgaaaacgttctacaccggtcagaagatcaagtttaacaaagacctgaatcttgctctgttggtgctccacaaggccttcagggggactggcacagcatacatagccgaagctatggcccggaaagataacggatcaatggcacacttcgcgctggaggtccgaaagaaatttccaaccaatgctttactggccgcactaattgactatatcgtgtacctccagagtctggccgagattagcacattcgaacttgatgaggactgggaagattttaagtataaacccgagcctactgaatccccatctcaggctcgctcgcatagaagcgaccaatacaacttcaagaatgccgagtccaactcaaatgtaaaggtgtgcaaaaacatccagaaggttttgtgtataagtcccaggtctcgggcaaaatttgagaacatcattgcttgcggcgaacacgccaatccgagcgtctatatgatgcctaacgtgtccatctaccagtcaaatagcgagcgctctcattattgtattgcggattcccactgcctggaagactacgagatcgtggagaccgaactcctgagtgccttaaagaaaagcaagtgctgggctaaggagatggacgatatagtcctgcacaaacagtctgacgggcttagatcctgtaggatgaaggatacgggaaactgcgacgttcaagaaaatgattggaccattgtgttgtgtgagaacggtaattactattactcagaaatccataaagactatgataaggaccaggatgtgggccacttctgcctcagtccccgttgtagcacaatccggtacccaattaacaaacgacatatcaagagatgcaattggcagatttcgcactccactatagacaagatctctgtacaggagctggcagatattgagcaatataaaaaggccatcagccagaaactacagacctcactgagtatttttaagtacgtcaaaacaaagaacctccctcatatcaagcccgcttataaatacataactgtggaagggatcgagaccgttgaaggaattgagaatgccttcatcgaatccgagattccagcactggcgggcacggccatcggttttaagataaactctagggaggggaattaccttatggacgtgattggctatgtcaaaagcgcttcctactcagccacatataccaagttgtacactacaggacccaccatcggcatcaacactcgccacgatgaaaaatgtaccgggccttgcccagcagtgattgaccacaaggacggatggctgacattcagcaaagagcggacgagtacctggggttgtgaagagtttggctgcttagctgtttctgatgggtgtgtgttcggatcctgccaagacataatcaaggatgaactcgccgtatatagaaagactacagaggagctgaccacagtcgaactttgcctgacttttagcgacaaaacctactgtacgaatttgaacgcaattacaccgatcattaccgataagttcgaggtgcagttcaaaactgtggaatcgtataccctccccagggtcatcgccgttaagaaccatgagataaaagtgggccagatcaatgacctgggtgtatactcaaaggggtgcggcaacgtgcagaaggtcaatggaacaaactacggcaatgggatgcctaaatttgattatctatgtcacctggcttctcgcaaggaggtgattctccgaaaatgcttcgacaacgattaccaagcgtgtaagtttctgcagagtccatccagctatcggcttgaggaacatcagggaactgttaccatcattgactacaaaaagatcttgggcacaataaagatgaaagccattctgggtgatgtgaagtataaaaattaccagtctaacatcgaaatcaatgcagaggggacgtgcgctggatgtattaactgcttcgaaaatatccactgtgagtttaccatacatactacagtcgaggccagctgccccattgtgaccgactgtgtttccttccacgaccgtatcttaattactcctgatgaacacaagtatgccctcaaagtggtctgccaagacaagccaaaggtatcactgaaatttaagatctgcaacacaaatatagatgctagtatgaccattgtggacagcaaacccatccttgagctggcaccggttgatcagacggcctacatcaaggaaaaagacgagagatgtaagacttggatgtgcagggtgcgcgatgaaggcttccaggtcattctagagccttttaagaacctcttcggttcttacatcggcatattttataccgggattctgtccgtgatctgtttgctgattgtaatctacatcattttaccaatatgcttcaaactccgggacacactgagacagcatgaggatgcgtataagaaagaaatgaagatcaggtga

SEQ ID NO: 11006 - RNA, 4335 nt, synthetic construct
  misc_feature 1..4335: note = derived and/or modified CDS sequence (opt3) from KEYV(KEYV/Ochlerotatus atlanticus/USA/KEYVLK01/2005)__KT630289.1__GP
  source 1..4335: mol_type = other RNA
atgatgatctggattctgctcaccgtggtcacagttactatagccaaccccgtgtaccagagatgcttccaagacggcgctatcgtaaagcagaatcctagcaaagaggcagtgacggaagtctgtcttaaggatgacgtgtccatgattaaaaccgaggccaagtatgttaaaaacctgacagggactttttctaataacgtggcgatgaggaagtggttggtcgctgattggcacgactgccggccacagaagcgcgccggaggtcatatcaatgtgattgaagtaggcgatgacttatcactgcacaccgagagttacatctgtagcgcagattgcgttatatccgtggacaaagaaacagcccagatccgactacaaaccgatactacaaaccatttcgaggtcgctgggaccacggtgaagtctggatggtttaaatcgactacctatattacactcgaccagacttgtgagcacctgaaggtgtcatgcggcccgaaaagcatccagttccatgcatgttttaatcagcacatgagttgcgtccgtttccttcacagaaccattctgcccggttccatcgccaactctatatgtcaaaatattgaaatcattatcttggttacactcaccctgctgatctttattctcttaagcatactgtccaagacgtacatctgctatattcttatgcctatcttcataccaattgcttacatctatgggtgggtgtacaacaagtcatgtaaaaagtgcaaattgtgcggactggtataccatccctttactgagtgtggcacacactgcgtgtgtggcgccaggtatgaaaccagtgatcggatgaagctacatcgcgcgagcgggctctgccctggatacaaatctctgagagcagccagggtcatgtgtaagtccaaaggtccagcttcaatccttagcattctgactgccgtgttgatcctcacattcattacccccatgaatgcaatggttctgggcagttctgaggaggtgtataagttagaagacctgcctgatgacatgctcaacatggctgagaagatagacatctactatctttccattgtcctgaattacagcacgacctgggggttgctaatcctgctcctgatcgtgtcgtgcctttttaaaaagtatcagcacgtattcctgaactactacgccatgtattgtcacgaatgcgatatgtaccatgagaaaaagaatttggtttataacggagacttttctaacaaatgtcggcagtgcacatgtggccagtacgaagatgcgactggtctcattgtgcaccaaaagtcctataattgcctgataaagtacaaagccaagtggttcatcaacattttaatcatttataccatcctggtcctactcaaagactcagtgctgatggcagctgccgaggggccagatttcaatacatgcatagagcagcgcagtatcagccttaactgtactggaccgtttattaatttgggcggctgcgaaaagccccagaaacgagcttcctaccaatctatcgccgagcagctgaaggcaattaacgccatcagcatactcgacatgcctatgatttcaaagatcccagatgacattagtggggctctgagacatatcgaaaatcttaaaacctaccacgagcagctgacagcggagttcgcaatgttgaccaggtattgtgattactatactcagttttccgacaacagcggatactctcaaacgtcatggcggacatatctccgtagtcatgatttcgaggtctgcatagcctaccccaatcagcacttttgtcgctgcgtgaagaacggtgagaaatgtaccagcgctaattgggacttcgccaacgaaatgaagaattattacactggcaaacagatcagatttgacaaggatctgaacttagcactgaccacactacacaccgccttcagggggacttccacatactatatgtctgacattctcgctgagacgaaggccaattcgctgcgggattacgcacttgcgttgaaaagcaagtatcctggaaacgctctgctcaaagccatcctggactttattatgtacttacagtccctgaacgaagcaaccaagttcaaactttcaagtgattgggaggactttaagtataattctgaattggaggcccgagctctcatgccacgcgccagaagctccggcgattacaacttctcaaatgcagagagcactaacaaagttaagatctgcaagaatatacaaagggtgatgtgtctgtctccccggtccaaagctacagtagaagacattatcgcctgcggtgagcatgaacacccgagtgtctatatggtgcctaacaccacaatctaccagagcaatattgagcgctctcattactgtatcgcggattcccactgcctagaggaatatgagctggttcagaacgaactcctgactgcccttaagaaatcaacctgctggacgggggagttggaaaatgtgattccccacaagcagagtgacggcataagaagctgtaggaccaaaaacacaggacgttgcaatgtcaagggcgaggattggactgtgatcctgtgtgagaacgacaagtactattactcggaattaaataaagattatgacaaggaccaagatattgggcatgtatgcctctccccacggtgtaactctatccgataccctattagccccagacacatcaccaattgcaaatgggagaacccagctggaacaatatcaaggatcgaaactcatagtctggcagacattgagcagtataagaaagccatctcccagaaacttcagaactctctgaccatttttaagtacgaaaagacgaagaatttgccccacatcaaacctatatacaagtatattacaatcgagggtaccgagactgtggaaggcgttgagaacgctttcatcgaagccgagattccagcactcgcggggacaagcataggattcaaagtcaattcccgcgatggcgaccatctgatggatatcattgcctacatcaaggtggcttcatatagcagtacctacactaagctatataccacaggtccgacgattgggatcaacaccaaacacgacgaaaagtgtactggcaattgccccgcccggctggagcacaaagtgggatggctcacatttgcaaaggagagaacctctacatggggctgtgaagagttcgggtgcctggctgtctccgatggatgtgtttttggtagctgccaagacataatcaaagaagaactttcggtgtacaggaaggatactgaggaagtgtcaaacgtagagttgtgcctgaccttcgccgacaaaacgtattgtacatctttaaatgcaattacccctatcattactgaaaagtttgaggtccagttcaagaccgtggaaagttactccctcccacgcatcgttggcatacgaaaccatgagattcggatcgggcagatcaatgatctgggaagctactctaaaggctgcggtaacgtgcaacgtgtcaatgggacaaactatggcagcggacagcccaagtttgactacctttgtcacctggcctccagaaaagaggtgattgttaggaagtgcttcgataatgactatcaggcttgtaaatttctacagactccttcaagttaccgcctcgaggaacatgaaggcaccgtgacaatcatagactataagaagattctggggacgatcaaaatgaaggcgattttgggagatgtacggtacaaaaactatgccagcgcaatcgacataaatgctgagggcgtctgcgccggttgtattaactgcttcgaaaacatccactgtgagtttaccatccatactacaattgaggcctcttgcccaatcgaatccgattgtgtgtcattccacgacaggattctggtgacccccaatgagcacaagtacgctttaaaactcatatgcgaagataagccggggagtactctgaagtttaaaatctgcaacacaaagattgacgcagccatgacccttgtcgatgcgaaacctatcctggagttggctccagttgaccaaacggcctacatcagagaaaaggatgagcgatgtaaaacttggatgtgccgcgtgcgggacgagggaattaaggtactcctggaacccttcaagaatctattcggcagctatataggtatcgtgtactccattatcctgattatcatagcagccatcattatcatttatatcatacttcctatttgttttaaactcagagataccctgaagaaacatgaggacgcttacaggaaggaaatgaaaatccgttga

SEQ ID NO: 11007 - RNA, 4332 nt, synthetic construct
  misc_feature 1..4332: note = derived and/or modified CDS sequence (opt3) from KEYV(KEYV/Ochlerotatus atlanticus/USA/KEYVLK01/2005)__KT630289.1__GP
  source 1..4332: mol_type = other RNA
atgatctggattctgctcaccgtggtcacagttactatagccaaccccgtgtaccagagatgcttccaagacggcgctatcgtaaagcagaatcctagcaaagaggcagtgacggaagtctgtcttaaggatgacgtgtccatgattaaaaccgaggccaagtatgttaaaaacctgacagggactttttctaataacgtggcgatgaggaagtggttggtcgctgattggcacgactgccggccacagaagcgcgccggaggtcatatcaatgtgattgaagtaggcgatgacttatcactgcacaccgagagttacatctgtagcgcagattgcgttatatccgtggacaaagaaacagcccagatccgactacaaaccgatactacaaaccatttcgaggtcgctgggaccacggtgaagtctggatggtttaaatcgactacctatattacactcgaccagacttgtgagcacctgaaggtgtcatgcggcccgaaaagcatccagttccatgcatgttttaatcagcacatgagttgcgtccgtttccttcacagaaccattctgcccggttccatcgccaactctatatgtcaaaatattgaaatcattatcttggttacactcaccctgctgatctttattctcttaagcatactgtccaagacgtacatctgctatattcttatgcctatcttcataccaattgcttacatctatgggtgggtgtacaacaagtcatgtaaaaagtgcaaattgtgcggactggtataccatccctttactgagtgtggcacacactgcgtgtgtggcgccaggtatgaaaccagtgatcggatgaagctacatcgcgcgagcgggctctgccctggatacaaatctctgagagcagccagggtcatgtgtaagtccaaaggtccagcttcaatccttagcattctgactgccgtgttgatcctcacattcattacccccatgaatgcaatggttctgggcagttctgaggaggtgtataagttagaagacctgcctgatgacatgctcaacatggctgagaagatagacatctactatctttccattgtcctgaattacagcacgacctgggggttgctaatcctgctcctgatcgtgtcgtgcctttttaaaaagtatcagcacgtattcctgaactactacgccatgtattgtcacgaatgcgatatgtaccatgagaaaaagaatttggtttataacggagacttttctaacaaatgtcggcagtgcacatgtggccagtacgaagatgcgactggtctcattgtgcaccaaaagtcctataattgcctgataaagtacaaagccaagtggttcatcaacattttaatcatttataccatcctggtcctactcaaagactcagtgctgatggcagctgccgaggggccagatttcaatacatgcatagagcagcgcagtatcagccttaactgtactggaccgtttattaatttgggcggctgcgaaaagccccagaaacgagcttcctaccaatctatcgccgagcagctgaaggcaattaacgccatcagcatactcgacatgcctatgatttcaaagatcccagatgacattagtggggctctgagacatatcgaaaatcttaaaacctaccacgagcagctgacagcggagttcgcaatgttgaccaggtattgtgattactatactcagttttccgacaacagcggatactctcaaacgtcatggcggacatatctccgtagtcatgatttcgaggtctgcatagcctaccccaatcagcacttttgtcgctgcgtgaagaacggtgagaaatgtaccagcgctaattgggacttcgccaacgaaatgaagaattattacactggcaaacagatcagatttgacaaggatctgaacttagcactgaccacactacacaccgccttcagggggacttccacatactatatgtctgacattctcgctgagacgaaggccaattcgctgcgggattacgcacttgcgttgaaaagcaagtatcctggaaacgctctgctcaaagccatcctggactttattatgtacttacagtccctgaacgaagcaaccaagttcaaactttcaagtgattgggaggactttaagtataattctgaattggaggcccgagctctcatgccacgcgccagaagctccggcgattacaacttctcaaatgcagagagcactaacaaagttaagatctgcaagaatatacaaagggtgatgtgtctgtctccccggtccaaagctacagtagaagacattatcgcctgcggtgagcatgaacacccgagtgtctatatggtgcctaacaccacaatctaccagagcaatattgagcgctctcattactgtatcgcggattcccactgcctagaggaatatgagctggttcagaacgaactcctgactgcccttaagaaatcaacctgctggacgggggagttggaaaatgtgattccccacaagcagagtgacggcataagaagctgtaggaccaaaaacacaggacgttgcaatgtcaagggcgaggattggactgtgatcctgtgtgagaacgacaagtactattactcggaattaaataaagattatgacaaggaccaagatattgggcatgtatgcctctccccacggtgtaactctatccgataccctattagccccagacacatcaccaattgcaaatgggagaacccagctggaacaatatcaaggatcgaaactcatagtctggcagacattgagcagtataagaaagccatctcccagaaacttcagaactctctgaccatttttaagtacgaaaagacgaagaatttgccccacatcaaacctatatacaagtatattacaatcgagggtaccgagactgtggaaggcgttgagaacgctttcatcgaagccgagattccagcactcgcggggacaagcataggattcaaagtcaattcccgcgatggcgaccatctgatggatatcattgcctacatcaaggtggcttcatatagcagtacctacactaagctatataccacaggtccgacgattgggatcaacaccaaacacgacgaaaagtgtactggcaattgccccgcccggctggagcacaaagtgggatggctcacatttgcaaaggagagaacctctacatggggctgtgaagagttcgggtgcctggctgtctccgatggatgtgtttttggtagctgccaagacataatcaaagaagaactttcggtgtacaggaaggatactgaggaagtgtcaaacgtagagttgtgcctgaccttcgccgacaaaacgtattgtacatctttaaatgcaattacccctatcattactgaaaagtttgaggtccagttcaagaccgtggaaagttactccctcccacgcatcgttggcatacgaaaccatgagattcggatcgggcagatcaatgatctgggaagctactctaaaggctgcggtaacgtgcaacgtgtcaatgggacaaactatggcagcggacagcccaagtttgactacctttgtcacctggcctccagaaaagaggtgattgttaggaagtgcttcgataatgactatcaggcttgtaaatttctacagactccttcaagttaccgcctcgaggaacatgaaggcaccgtgacaatcatagactataagaagattctggggacgatcaaaatgaaggcgattttgggagatgtacggtacaaaaactatgccagcgcaatcgacataaatgctgagggcgtctgcgccggttgtattaactgcttcgaaaacatccactgtgagtttaccatccatactacaattgaggcctcttgcccaatcgaatccgattgtgtgtcattccacgacaggattctggtgacccccaatgagcacaagtacgctttaaaactcatatgcgaagataagccggggagtactctgaagtttaaaatctgcaacacaaagattgacgcagccatgacccttgtcgatgcgaaacctatcctggagttggctccagttgaccaaacggcctacatcagagaaaaggatgagcgatgtaaaacttggatgtgccgcgtgcgggacgagggaattaaggtactcctggaacccttcaagaatctattcggcagctatataggtatcgtgtactccattatcctgattatcatagcagccatcattatcatttatatcatacttcctatttgttttaaactcagagataccctgaagaaacatgaggacgcttacaggaaggaaatgaaaatccgttga

SEQ ID NO: 11008 - RNA, 4332 nt, synthetic construct
  misc_feature 1..4332: note = derived and/or modified CDS sequence (opt3) from KEYV(KEYV/Ochlerotatus atlanticus/USA/KEYVLK02/2005)__KT630292.1__GP
  source 1..4332: mol_type = other RNA
atgatctggattctgctcaccgtggtcacagccactatagctaaccccgtttaccagagatgcttccaagacggcgcaatcgtgaagcagaatcctagcaaagaggccgtaacggaagtgtgtcttaaggatgacgtctccatgattaaaaccgaggcgaagtatgtgaaaaacctgacagggactttttctaataacgttgctatgaggaagtggttggtggccgattggcacgactgccggccacagaagcgcgcaggaggtcatatcaatgtcattgaagtgggcgatgacttatcactgcacaccgagagttacatctgtagcgccgattgcgtaatatccgttgacaaagaaacagctcagatccgactacaaaccgatactacaaaccatttcgaggtggcagggaccacggtcaagtctggatggtttaaatcgactacctatattacactcgaccagacttgtgagcacctgaaggtgtcatgcggcccgaaaagcatccagttccatgcctgttttaatcagcacatgagttgcgtgcgtttccttcacagaaccattctgcccggttccatcgctaactctatatgtcaaaatattgaaatcattatcttggtcacactcaccctgctgatctttattctcttaagcatactgtccaagacgtacatctgctatattcttatgcctatcttcataccaattgcctacatctatgggtgggtttacaacaagtcatgtaaaaagtgcaaattgtgcggactggtgtaccatccctttactgagtgtggcacacactgcgtatgtggcgcgaggtatgaaaccagtgatcggatgaagctacatcgcgcaagcgggctctgccctggatacaaatctctgagagccgctagggtgatgtgtaagtccaaaggtccagcctcaatccttagcattctgactgcagtcttgatcctcacattcattacccccatgaatgctatggtgctgggcagttctgaggaggtttataagttagaagacctgcctgatgacatgctcaacatggccgagaagatagacatctactatctttccattgtgctgaattacagcacgacctgggggttgctaatcctgctcctgatcgtctcgtgcctttttaaaaagtatcagcacgtgttcctgaactactacgcgatgtattgtcacgaatgcgatatgtaccatgagaaaaagaatttggtatataacggagacttttctaacaaatgtcggcagtgcacatgtggccagtacgaagatgccactggtctcattgttcaccaaaagtcctataattgcctgataaagtacaaagcaaagtggttcatcaacattttaatcatttataccatcctggtgctactcaaagactcagtcctgatggctgccgctgaggggccagatttcaatacatgcatagagcagcgcagtatcagccttaactgtactggaccgtttattaatttgggcggctgcgaaaagccccagaaacgagcctcctaccaatctatcgcagagcagctgaaggccattaacgctatcagcatactcgacatgcctatgatttcaaagatcccagatgacattagtggggcgctgagacatatcgaaaatcttaaaacctaccacgagcagctgacagcagagttcgccatgttgaccaggtattgtgattactatactcagttttccgacaacagcggatactctcaaacgtcatggcggacatatctccgtagtcatgatttcgaggtgtgcatagcttaccccaatcagcacttttgtcgctgcgtcaagaacggtgagaaatgtaccagcgccaattgggacttcgcaaacgaaatgaagaattattacactggcaaacagatcagatttgacaaggatctgaacttagccctgaccacactacacaccgctttcagggggacttccacatactatatgtctgacattctcgccgagacgaaggcaaattcgctgcgggattacgcgcttgctttgaaaagcaagtatcctggaaacgccctgctcaaagcaatcctggactttattatgtacttacagtccctgaacgaagccaccaagttcaaactttcaagtgattgggaggactttaagtataattctgaaccagaggctcgagccttgatgccccgcgcaagaagctccggcgattacaacttctcaaatgctgagagcactaacaaagccaaggtgtgcaagaatatccaaagggttatgtgtctctctccgcggtccaaagcgacagtggaagacataattgcctgcggtgagcatgaacaccctagtgtatatatggtccccaacaccacagtgtaccagagcaatatcgagcgctctcattactgtatcgctgattcccactgcctggaggaatatgagctagttcagaacgaactgctcactgcactgaagaaatcaacctgctggacgggggagcttgaaaatgtgattccacacaagcagagtgacggcaccagaagctgtaggactaaaaacacaggacgttgcaatgtcaagggcgaggattggaccgtgatcttgtgtgagaacgacaagtactattactcggaactgaataaagattatgacaaggaccaagatattgggcatgtatgcttatcccctcggtgtaactctatacgataccccatcagcccaagacacattacaaattgcaaatgggagaaccccgccggaactatctcaaggattgaaacccatagtctcgctgacatcgagcagtataagaaagccatatcccagaagctgcagaactctcttacgatctttaagtacgagaaaacaaagaatctgcctcacattaaaccaatctacaagtatattaccatcgagggtactgagacagtggaaggcgttgagaacgcattcatagaagcggagattccggccttggctgggaccagcatcggattcaaagtcaattcccgcgatggcgaccatctcatggatatcattgcctacataaaggtggcatcatatagcagtacttacaccaagctgtatacaacgggtcccaccatcgggattaacactaaacacgacgaaaagtgtacaggcaattgccctgctcggctagagcacaaagtgggatggctgacctttgccaaggagagaacatctacttggggctgtgaagagttcgggtgcctcgcagtctccgatggatgtgtttttggtagctgccaagacatcattaaagaagaactgtcggtgtacaggaaggataccgaggaagtgacgaacgtagagctttgcttgacattcgccgacaaaacctattgtacttcactgaatgctatcaccccaataatcacagaaaagtttgaggtccagttcaagactgtggaatcttacagtttaccccgcattgttggcatccgaaaccatgagattcggatcgggcagataaatgatctcggatcctacagcaaaggctgcggtaacgtgcaacgtgtcaatgacaccaactatgggtctggccagcctaagtttgattacctgtgtcaccttgcgagcagaaaagaggtgattgttaggaagtgcttcgacaatgactatcaggcctgtaaatttctgcagacaccatcctcataccgcctagaagaacatgaaggaacggtgaccatcatcgattataagaagattctcggcactatcaaaatgaaggcaatactgggggacgtacggtacaaaaactatgctagtgccattgatatcaatgccgagggagtctgcgctggctgtattaactgcttcgaaaacatccactgtgagtttacaatacataccactattgaggcaagctgccccatcgaatctgactgtgtgtccttccacgatagaatgttggtgacaccgaatgagcacaagtacgccctgaaattaatctgcgaagacaagcctggttcaaccctcaagtttaaaatttgcaacacgaagatcgatgcggctatgactctggtcgacgccaaaccaattcttgagctggcacccgttgatcaaaccgcctacataagggaaaaggacgagcgatgtaaaacatggatgtgccgcgtgcgggatgaggggatcaaggtattgctcgaacctttcaagaatctgttcggaagttatattggcatcgtgtacagcatcattctaataatcattgctgcaatcattatcatatatgtcatcctgcccatttgttttaaacttagagacaccctcaagaaacatgaggacgcctacaggaaggaaatgaaaatccgttga

SEQ ID NO: 11009 - RNA, 4332 nt, synthetic construct
  misc_feature 1..4332: note = derived and/or modified CDS sequence (opt3) from KEYV(C14031-33)__AF123489.1__GP
  source 1..4332: mol_type = other RNA
atgatctggattctgctcaccgtggtcacagttactatagccaaccccgtgtaccagagatgcttccaagacggcgctatcgtaaagcagaatcctagcaaagaggcagtgacggaagtctgtcttaaggatgacgtgtccatgattaaaaccgaggccaagtatgttaaaaacctgacagggactttttctaataacgtggcgatgaggaagtggttggtcgctgattggcacgactgccggccacagaagcgcgccggaggtcatatcaatgtgattgaagtaggcgatgacttatcactgcacaccgagagttacatctgtagcgcagattgcgttatatccgtggacaaagaaacagcccagatccgactacaaaccgatactacaaaccatttcgaggtcgctgggaccacggtgaagtctggatggtttaaatcgactacctatattacactcgaccagacttgtgagcgtctgaaggtgtcatgcggcccgaaaagcatccagttccacgcatgttttaatcagcatatgagttgcgtcagattccttcacaggaccattctgttgggttccatcgccaactctatatgtcaaaatattgaaatcattatcctcgttacactgaccctgctcatctttattttactgagcatactttccaagacgtacatctgctatattttgatgcccatctcaatacctattgcttacatctatgggtgggtgtacaacaagagttgtaaaaagtgcaaactgtgcggcctagtataccacccattcactgagtgtggcacacattgcgtgtgtggcgcccggtatgaaaccagcgatcgcatgaagctccacagagcgtctgggctgtgccccggatacaaatcccttagggcagcccgggtcatgtgtaagtcaaaaggtcctgctagcatcctgagtattttgactgccgtgctcatcctgacatttattaccccaatgaatgcaatggttttaggatcttccgaggaggtgtataagctggaagacctccccgatgacatgcttaacatggctgagaagatagacatctactatctgagcattgtcttgaattactcgacgacctgggggctactgatcctcctgcttatcgtgtcttgcctgttcaaaaagtatcatttggtatttctcaactactacgccctgtattgtcacgaatgcgatatgtaccacgagaaaaagaatttagtttataacggagacttctccaacaaatgtctgcagtgcacatgtggccagtacgaagatgcgactggtctaattgtgcatcagaagtcatataattgcctcataaactacaaggccaaatggtttatcaatattctgatcatttataccatccttgtcttgctgaaggacagtgtgctcatggcagctgccgagcgccctgatttcaacacatgcatagagcaacgaagcatctccctgaattgtactgggccattcattaaccttggaggctgcaaaaagccgcagaaaagagcttcttaccagagcatcgccgaacaactgaaggcaattaatgccatctcaatattggacatgcccatgattagtaagatccctgatgacatttccggcgctctcaggcacatcgagaacctgaaaacctaccatgaacagttaacagcggagtttgcaatgctgacccggtattgtgattactatactcagttcagcgacaattctgggtactcacagacgagttggcgtacatatctacgcagccacgattttgaagtctgcatagcctacccaaaccaacatttctgtagatgcgtgaagaatggagagaaatgtacctccgctaactgggactttgccaatgagatgaagaactattacactggtaaacagatcaggttcgacaaggatctcaatctggcacttaccacattgcacaccgcctttcggggcacttctacatactatatgtcggacattctggctgaaacgaaggccaacagcctccgagattacgcactggcgttaaaatccaagtatcccgggaacgctctgcttaaagccatcttggacttcattatgtacctccagcctctgaatgaggcaaccaagtttaaactatcaagtgattgggaagacttcaagtataactctgagccagaagcccgcgctctgatgcccagagccaggagctccggagattacaatttttcaaacgcagagagcactaataaagttaaggtgtgcaagaacatccagcgggtaatgtgtctctctccgcgctccaaagctacagtcgaggacataattgcctgcggcgaacacgagcatcctagtgtgtatatggttcccaataccacaatctaccaaagcaacatcgaaagatctcactactgtattgcggattcccattgcctggaggagtatgaacttgtgcagaatgagttgctgactgccttaaagaaatcaacctgctggacgggtgaactcgagaacgtcatcccacacaagcagagtgacgggattaggagctgtcgtaccaaaaatacaggccggtgcaacgtgaagggagaagattggactgtaatactgtgtgagaatgacaagtactattactcggagcttaacaaagattatgacaaggaccaggatatcggccacgtgtgcctgtcccctcgatgtaattctattagataccccatcagcccaaggcatattaccaactgcaaatgggaaaaccccgctgggacaatctcacgcatagagactcacagtttggcagacatcgaacaatataagaaagccatttcccagaagctccaaaattctctgaccatcttcaagtacgagaaaacgaagaacctacctcatattaaaccaatctacaagtatataacaattgaaggaaccgagactgttgagggtgtcgaaaatgcttttatcgaggccgaaatcccggcactggcgggcacaagcattgggttcaaagtgaactcccgggatggagaccacctcatggatataatcgcctacattaaggtggcttcatatagcagtacctacactaagctgtataccacaggccccacgatcggtattaataccaaacatgacgagaagtgtactgggaactgccctgccagacttgaacacaaagtcggctggttgacattcgcaaaggagaggacctctacatggggatgtgaggaatttggctgcctggctgtttccgatgggtgtgtgttcggaagctgccaggacatcataaaagaggaattatcggtgtaccgcaaggatactgaggaggtaaccaatgtcgaactctgcctgacgtttgccgacaaaacatattgtacctcacttaacgcaatcactccaattatcaccgagaagttcgaagtgcagtttaagacagttgagtcttacagtctgccccgaattgtgggtatccggaatcacgaaatacgtattggccagatcaacgatctagggtcctacagcaaaggatgcggcaatgtccagagagtgaacggtactaattatgggtctggccaacctaagttcgactacctctgtcatctggccagcaggaaagaggttatcgtgcgcaagtgctttgataacgactatcaggcttgtaaattcttgcagaccccatcctcataccggctggaggaacacgagggaacagtaacgattatcgactataagaagatattaggcaccattaaaatgaaggcgatcctcggggatgtcagatacaaaaattatgccagtgcaattgacatcaacgctgaaggagtgtgcgccggctgtataaactgctttgagaatattcattgtgagttcactatccacacaaccatcgaagccagctgccccattgagtctgattgtgtgtcctttcatgacaggatgctggtcactccgaacgaacacaagtacgctcttaaactgatctgcgaggataagcctggttcagcattgaagttcaaaatttgcaatacaaagatagacgccgcgatgaccctcgttgatgctaaaccaatcctggaactagcccccgtggaccagacggcatacattcgagagaaggatgaacgctgtaaaacttggatgtgccgggtaagagacgaggggatcaaggtgctgcttgagccttttaagaacctcttcggaagttatatcggcattgtctacagcataatcctgattatcattgccgctatcataatcatttatatcattttgcccatctgtttcaaactgagggataccttaaagaaacacgaagacgcataccgtaaggagatgaaaatacgctga

SEQ ID NO: 11010 - RNA, 4326 nt, synthetic construct
  misc_feature 1..4326: note = derived and/or modified CDS sequence (opt3) from LACV(Human/78)__NC_004109.1__GP
  source 1..4326: mol_type = other RNA
atgatctgcattctggtgctcataaccgtcgccgctgcaagccccgtttaccagagatgtttccaagacggcgccatcgtgaagcagaacccttccaaagaggcggtaacagaagtgtgccttaaggatgacgtctctatgattaaaactgaggctaggtatgtgcggaatgccacgggggttttctcaaacaatgtggcaatccgcaagtggctggtcagtgattggcacgactgtcgaccgaaaaagattgtgggaggtcatatcaacgtaatagaagttggcgatgacttgagcttacacaccgagtcctacgtgtgctctgccgattgtacaatcggggtcgacaaggaaactgctcaggtgcgtctgcagaccgatacaaccaatcatttcgagattgcaggaactacagtgaaatcgggctggtttaagtcaaccacgtatatcactctagaccaaacctgcgagcacctcaaagtcagctgtggtccaaagagtgttcagttccatgcctgctttaaccagcacatgtcctgtgtgagattcctgcacaggacaattcttcccgggtctatcgctaatagcatatgccagaacattgaaatcattatcctggtaactttgaccctcctgatctttattctgctctccatattatcaaaaacatacatctgttatctgcttatgcctattttcatcccaatagcctacatttatggaatcatctacaataagagttgcaagaaatgcaagttgtgtggcctggtgtaccatccctttaccgagtgcggcacgcactgtgtctgcggggcgcggtatgatactagcgaccgcatgaaactacatagagcatctggactctgtcctggttacaagtccctgagggccgctcgggtgatgtgcaaatcaaagggcccagccagcattcttagtatcattacagcagttctggtgttgaccttcgtcactcccataaactctatggtgctcggggaatccaaagagacatttgagctggaagatttacctgacgacatgctggagatggctagccgcatcaattcgtattacctcacctgtattcttaactatgccgtatcttggggactggttatcatcggcttgctaattggtctgctctttaagaagtaccaacaccgatttctgaatgtgtatgcgatgtactgcgaagagtgtgatatgtaccacgacaaatccgggcttaagagacatggagatttcacgaacaaatgcaggcagtgtacctgcggccagtatgaagacgccgcaggcctgatggctcaccggaagacatacaattgcttggtccagtataaagccaagtggatgatgaacttcctcataatctacatttttctgatcttaattaaggattcagctatcgtggtccaagccgcagggactgacttcaccacatgtctggagactgagagtataaactggaattgcaccggaccatttctaaacctcggtaattgtcagaaacagcaaaagaaagaaccgtatacaaacatcgccacccagctgaagggccttaaagctattagcgtgttggatgttcccatcattactgggatccctgacgatatagcgggagcactgcgttacattgaggaaaaggaggacttccatgtgcagctcacgatcgaatatgccatgctgtccaagtactgcgattactatacacagttttctgacaatagcggctactcacaaaccacttggcgcgtatatcttagaagtcacgacttcgaggcttgtattctgtacccaaaccagcatttttgtaggtgcgtcaaaaatggtgagaagtgctccagctctaactgggatttcgccaatgaaatgaaagactattactcagggaagcagaccaaatttgataaggacttgaacctcgcactgacagccttacaccacgctttccggggcaccagtagcgcctatatcgcaactatgctgtccaagaaatctaatgatgacctaatagcgtacacaaacaagatcaaaacgaagtttcccggaaatgctctcctgaaagccattatcgattacattgcatatatgaagtcgcttcctggcatggccaacttcaaatacgacgagttttgggatgaattgctgtataagccaaatcccgctaaggccagcaacctcgcacgagggaaagagtcctcatacaacttcaagctggctatcagttctaaaagcataaagacctgtaaaaatgtgaaggacgttgcctgcttatccccgcgctcaggagcgatttatgccagcatcatcgcttgtggtgaacctaacggcccctctgtgtacagaaagccatccgggggagtcttccagagtagcactgataggtctatttattgcctgcttgactcccattgcttggaggagtttgaagcaatcggccaagaggaactcgatgccgtgaaaaagtcaaaatgttgggagattgagtaccctgacgtaaagctgatacaggaaggtgacgggacaaaaagttgccggatgaaggatagcggcaattgtaacgtggctaccaatcgctggcccgttatccagtgcgagaacgacaagttctactattcggaactacagaaagattacgacaaggcccaagatattggacactattgtctgtccccaggctgcacaactgtcagataccccatcaatcctaaacatatttctaactgtaattggcaagtgagcaggtcaagtatcgcaaagatagacgtgcacaacatcgaggatattgaacagtataaaaaggcgatcacccagaagctccaaacgtccctgtctctttttaaatacgccaagaccaaaaatttgccacacattaagccgatctataaatacataacaattgaggggactgagaccgctgaaggaatcgagagcgcctacatcgaatccgaggtccccgcactggctggtacatcaattggcttcaagataaacagcaaagaagggaagcatttactcgacgttatcgcctatgtgaagagtgcatcttactccagcgtgtatactaaactgtactcgaccggacctacgtcaggcattaatacaaagcacgatgagctttgcaccggtccatgtcccgccaacatcaatcatcaggtagggtggctgacttttgctcgtgagcggacatctagttggggctgcgaagagttcggatgtttggcggtctccgacggctgcgtgtttgggagctgccaggatattatcaaagaggaactctctgtttatcgaaaggaaaccgaggaggtgactgacgtcgaactgtgtctaaccttcagcgataaaacatactgcacgaacctgaaccctgtgaccccaataatcactgacctctttgaggttcaattcaagacagtggaaacctattccctgcccagaattgtagccgtccagaatcacgagatcaagattggacagatcaacgaccttggcgtgtactcaaaaggttgtgggaatgtgcagaaggtcaacggaacaatatacggcaatggtgttccgaggtttgattatttgtgccatctggcaagtcgcaaagaggtgattgtacggaagtgtttcgacaacgattaccaggcttgcaaatttttacagagccctgcctcttatagactcgaagaggactccggcactgtgaccatcatcgattacaagaagattctggggacgatcaaaatgaaggccatacttggagacgtcaaatataagacattcgctgattcagtggacattaccgcagaaggcagttgtactgggtgcatcaattgtttcgagaacattcactgcgaactgaccctacacacaactatcgaggccagctgtccaataaaatcctcttgcaccgtttttcatgataggattctcgtgacacccaatgagcacaagtacgcgctgaagatggtctgcacggaaaaacctggaaacaccttgactatcaaggtgtgtaatacaaaagttgaggcttcgatggccctggtggacgcaaagcccatcattgaattagccccagtcgatcagaccgcttatatccgcgagaaagacgaacgatgcaagacttggatgtgtcgggtacgtgacgagggcctccaggtgattctggagcctttcaagaacctttttggtagctacatagggatcttctacacatttattatctcaatcgttgtgctgttggtcattatatatgtgctcctgcccatctgcttcaaactaagagataccctgaggaagcatgaagacgcatacaaacgcgagatgaagattcggtga

SEQ ID NO: 11011 - RNA, 4326 nt, synthetic construct
  misc_feature 1..4326: note = derived and/or modified CDS sequence (opt3) from LACV__KP271111.1__GP
  source 1..4326: mol_type = other RNA
atgatcagaatactggtgctcatagccgtcaccgctgcaagccccgtttaccagaggtgcttccaagacggcgccatcgtgaagcagaacccttccaaagaggcggtaacagaagtgtgtcttaaggatgacgtctctatgattaaaactgaggctcggtatgtgcgcaatgccacgggggtttttagcaacaatgtggcaatccgaaagtggctggtcagtgattggcacgactgccgtccgaaaaagattatcggaggtcatataaacgtgatcgaagtaggcgatgacttgagcttacacaccgagtcctacgtttgttctgccgattgctcgattggggtggacaaggaaacagctcaggtcagactgcagactgataccacaaatcatttcgagatcgcaggaaccactgtgaaatcaggctggtttaagagcacaacctatattacgctagaccaaacttgtgagcacctcaaagtgagttgcggtccaaagtccgtccagttccatgcctgttttaaccagcacatgtcttgcgttaggttcctgcaccggaccatccttcccgggagcatagctaattccatttgtcagaacatcgaaattatcatcctggtgacattgactctcctgatttttatactgctctcaatcttaagtaaaacctacatttgctatctgcttatgcctatcttcataccaattgcctacatgtatggaatcatctacaataagagctgtaagaaatgcaagttgtgcggcctggtataccatccctttacagagtgtggcacccactgcgtgtgtggggcgcgctatgatacgtctgacagaatgaaactacatagggcatccggactctgccctggttacaagtcactgcgggccgctcgcgtcatgtgtaaaagcaagggcccagccagtattctttctatcattactgcagtgctggttttgacattcgtgacccccataaactccatggtcctcggggaaagcaaagagacttttgagctggaagagttacctgatgacatgctggaaatggcttcgcgaatcaattcttattacttcacatgcattctcaactatgccgtgtcctggggacttgtaatcatcggcctgttgaccggtctactgtttaagaagtaccaacacagattcctcaatgtttatgcgatgtactgtgaggaatgcgacatgtaccacgataaatcagggctgaagaggcatggagacttcacgaacaaatgtcggcagtgcacctgtggccagtatgaggatgccgcaggccttatggctcaccgtaagacatacaattgcctggtgcagtataaagccaagtggatgatgaactttttgattatatacatcttcctcattctgatcaaggacagtgctattgtcgtgcaagccgcagggactgattttaccacatgcttagagactgaaagcatcaactggaattgtaccggaccattcctgaacctaggtaattgccagaaacagcaaaagaaagagccgtatacaaacatagccacccagctcaagggcctgaaagctatctccgtccttgacattcccatcattactgggatccctgatgacatagcgggagcattgcgctacattgaagagagagaagattttcatgtgcagctgacgatcgagtatgccatgctctctaagtactgtgactactatacacagttcagcgataattcaggctacagtcaaaccacttggagggtttatctgcggtcccacgactttgaggcttgcattctttacccaaaccagcatttctgtcgatgcgtgaagaatggtgaaaaatgttcatcttcaaactgggactttgccaatgagatgaaggattattacagtgggaaacagaccaagttcgacaaagatctgaacttggcactcacagccctgcaccacgcttttcgcggcaccagctccgcctatatcgcaactatgttatctaagaagtcgaatgacgatctgatagcgtacacaaacaaaatcaaggctaaattccccggaaatgccctactcaaggcaattatcgactacattgcctatatgaaaagcctgcctggcatggctaactttaagtacgatgagttctgggacgaacttttgtataaaccaaatcccgccaaggcatccaacctggctagagggaaggaatcaagttacaacttcaaactcgccatctctagcaagtccataaaaacgtgcaagaatgtaaaagatgtcgcgtgtctgtcaccgaggagcggagccatttatgcttctatcatcgcatgcggtgagcctaacggcccctccgtgtaccggaagccaagtgggggagtttttcagagctctaccgaccgctccatttattgtttactggattcacattgccttgaggagttcgaagccatcaatcaagaagagttggacgctgtgaagaaaagtaagtgctgggagattgaatacagcgatgtcaaacctctccaggagggcgacggtactaagtcgtgtagaatgaaagactccgggaactgcaatgtggccacaaacaggtggcccgtaatacagtgtgaaaatgataagttttactattctgagctgcagaaggactacgataaaacccaagacatcggccactattgcctaagcccaggatgtacaactgtgcgttaccccattaaccctaagcatatctcaaattgcaactggcaggttagtcggtcctctattgcaaaaatcgatgtccacaatatagaagacatcgagcagtataagaaagcgattacccagaagctgcaaacgagcctctccctgttcaagtacgccaaaaccaagaaccttccacacatcaaaccgatttataagtacatcacaatagagggcactgaaaccgctgaggggattgaatcagcctacatcgagagcgaagtgcccgcattggctggaacaagtatcggttttaaaattaattctaaggagggcaaacatctgttagatgtgatagcctatgtcaagtccgcaagctactcgtcagtttatgccaagctctactctactgggcctaccagtggaatcaacacgaaacacgacgagctgtgtacaggcccatgccccgctaatattaaccatcaggtgggttggcttaccttcgcgaaggaacgaacttccagctgggggtgtgaggaatttggctgcctggccgtgtctgatggatgtgtattcggcagctgccaggacatcattaaagaggaattgtccgtctatagaaaggagacagaggaagtgaccgatgttgagctctgcctgactttttcagacaaaacctactgtacaaacctaaatcctgtgacgccaatcataaccgatctgttcgaagtccaatttaagactgtggagacatatagtctccccaggatcgttgcagtgcagaaccacgagattaagatcgggcagattaatgacctgggagtatacagcaaaggctgcggtaacgtccagaagatcaatgggaccgtgtacggaaacggcgtgccgcgcttcgactatctttgtcatttggcttctcggaaagaagtcatagttagaaagtgctttgataatgactaccaagcctgtaaattcctgcagtcccctgcctcatataggttagaggaagatagtggtacagtgactattatcgactacaagaagatcctcggcaccattaaaatgaaggctatcctgggggatgtaaaatataagacgttcgcagacagcgtggatataacagccgagggatcctgcaccggctgtattaactgctttgaaaatatccactgtgagcttactctgcacaccacaattgaggcgtcttgcccaatcaaatcgagctgtactgtcttccatgaccgcattctagtgacccccaacgaacacaagtacgctctcaagatggtttgcacagagaaacctgggaatacgctgaccattaaggtgtgcaacactaaaatcgaagcctcaatggcattggtcgatgccaagcccatcattgagctggctccagtggaccagacagcatatatccgagaaaaagatgagcggtgtaagacctggatgtgccgtgttagagacgagggattacaggtgattctcgaaccttttaagaatctgttcggctcctacataggtatcttttacactttcattatcagtatcgtcgcccttctggtaattgtgtatgttttgctccccatatgttttaaactgagggacacactacgcaagcatgaggatgcgtacaaacgggaaatgaagatcagatga

SEQ ID NO: 11012 - RNA, 4326 nt, synthetic construct
  misc_feature 1..4326: note = derived and/or modified CDS sequence (opt3) from LACV__M87664.1__GP
  source 1..4326: mol_type = other RNA
atgatctgcattctggtgctcataaccgtcgccacagctagccccgttcttcagagatgtttccaagacggcgcaatcgtgaagcagaacccttccaaagaggcctttactgaagtatgcctgaaggatgacgtgtctatgattaaaacggaggcgaggtacgtccggaatgctaccggggtgttctcaaacaatgttgccatccgcaagtggttggtgagtgcatggcacgattgtcgaccgaaaaagattgtcggaggtcatatcaacgtgatagaagtaggcgacgatttaagcctgcacacagagtcctatgtttgctctgccgactgtactatcggggtggataaggaaaccgctcaggtccgtctacagacagacaccactaatcattttgagattgcaggaacaaccgtgaaatcgggctggttcagatcaacgacttacatcaccctcgatcaaacatgcgagcacctgaaggtgagctgtggtccaaaaagtgtccagtttcatgcctgcttcaaccagcacatgtcctgtgttaggtttcttcaccggactattctgccccgctctatcgctaatagcatatgccagaacattgaaatcattatcttggtgaccctcacactgctgatcttcattctcttatccatactgtcaaagacctatatctgttaccttttgatgcctatttttatcccaatagcctatatttacgggacgatctataataaaagttgcaagaagtgcaaactgtgtggactagcgcatcaccccttcactgagtgcggcacacattgtgtatgcggcgcaagatacgacaccagcgataggatgaagctccaccgggcctctgggctgtgtcctggatacaaatcccttcgcgctgcccgagtgatgtgcaagtcaaaaggtccagcaagcatcctgagtattatcactgctgtcttggtgctcacatttgttacccccattaactctatggtgctgggcgaatccaaggagacgttcgagttagaagacctgcctgatgacatgctcgagatggccagcagaataaattcgtattacccaacctgtatccttaactatgcggtctcttgggggctggtgattatcggattgctaatcggcctgctctttaaaaagtaccaacacaggttcctgaatgtatatgccatgtactgcgaagagtgtgacatgtatcatgataagtccggtgttaaacggcacggggacttcacaaacaagtgccgtcagtgtacttgcggacagtacgaagatgcagctggccttatggcccatcgcaaaacctacaattgcctggtgcagtataaggctaaatggatgatgaactttttgattatatacatcttcctcattctgatcaaggactcagccattgtcgtgcaagcagccggcacagattttactacctgtttagagacagagagtatcaactggaattgcaccgggccgttcctgaacctaggaaattgtcagaagcagcagaaaaaggaaccctatactaacatagctacgcaactcaaaggtctgaaggcgatcagcgtccttgacattcctatcattacaggcatcccagatgacatagcaggggccttgagatacattgaggaaaaagaggattttcacgtgcagctgaccatcgaatatgctatgctctccaagtactgcgactattacactcagttctctgataatagcggatactcacaaaccacatggagggtttatctgcggagtcatgactttgaggcctgtattctttaccccaaccagcacttctgccgatgtgtgaagaatggcgagaaatgctccagctctaaccgcgactttgcaaatgaaatgaaggattattactcaggtaaacagaccaagttcgacaaagatctgaacttggccctcactgctctgcacagtcaggtaatgcattgtagctccgcctatatcgcaacaatgttatctaagaagtcgaatgacgatctgatagcgtacacgaacaaaatcaagaccaaatttcctgggaatgctctactcaaggccattatcgactatattgcatacatgaaaagcctgccaggcatggccaacttcaagtacgatgagttttgggacgaacttttgtataaacccaatccggctaaggcctccaacctggcaagaggaaaggagtcaagttacaacttcaaactcgctatctctagcaagtccataaaaacttgcaagaatgtcaaagatgtggcctgtctgtcacctaggagcggcgcgatttatgcctctatcatcgcttgcggggaacccaacggaccatccgtttaccggaagcctagtggtggcgtgttccaaagctctacagaccgctccatttattgcttactggattcacactgtcttgaggagtttgaagcaatcagtcaggaggaattggacgccgtcaagaaaagcaagtgctgggagattgagtaccccgatgtgaaactcatacaggaaggggacggaaccaagtcgtgtagaatgaaagactccggcaattgcaacgtagctacaaataggtggccagtgactcagtgtgagaacgataagttctattactctgacctgcaaaaggattacgacaaaacccaggatatcggtcattattgcctaagccccgggtgtacgaccgttcgttaccctattaatccaaagcacatctcaaactgcaattggcaggtcagtcggtcctctattgccgaaatcgacgtgcacaacatagaggatatcgaacagtataaaaaggcaattacacaaaaactgcagactagcctctccctgtttaagtacgcgaagaccaaaaatcttccgcatatcaagcccatttataaatacatcacaatgaagggcactgagaccgccgagggaatagaatcagcttatattgagagcgaagtgcctgccttggcaggcacgagtatcgggttcaaaatcaactctaaggagggaaaacacctgttagacgtcattgcttacgttaagtccgccagctactcgtcagtgtatacaaagctctactctaccggtccaacaagtggcataaatactaaacatgatgaactgtgtaccgggccctgccctgcaaacatcaatcaccaggtgggatggcttacttttgcccgagagagaacctccagctggggctgtgaggagttcggttgcctggctgtatctgacgggtgcgtctttggcagctgtcaagatattatcaaggaagaattgtccgtgtataggaaagagacagaagaggttacgaacgtggagctctgcctgaccttctcagacaagacttactgtacaaacctaaatccagtcacccccattatcacagatctgtttgaagtgcagttcaaaactgttgagacctatagtctcccgcgcatagtggcggtacagaaccatgaaatcaagattggacagatcaatgacctgggcgtctacagcaaggggtgcggaaacgtgcaaaaagtgaatggcacgatttatggtaacggggtccctcggtttgactacctttgtcacttggcctctagaaaggaggttatcgtgaggaaatgcttcgataatgactaccaggcatgtaagtttctgcagtccccagcttcatatcgcttagaggaagatagtggaacagtaaccataattgactacaaaaagatcctcggcactatcaagatgaaagccattctgggtgatgtgaagtataaaaccttcgccgacagcgtcgatatcacagctgagggctcctgcactgggtgtataaactgcttcgaaaatattcactgtgagcttaccctgcatacaacgatcgaagcatcttgccccattaagtcgagctgcaccgtgtttcacgaccgaatcctagttactcctaacgagcataaatacgccctcaagatggtgtgtacagagaagcccggaaataccctgactataaaagtctgcaacacaaagattgaagcgtcaatggctttggtggatgccaaaccaatcatcgagctggcacctgttgaccagaccgcctatattcgggaaaaggatgagcgttgtaaaacgtggatgtgcagagtgagggacgaaggcttacaagtcatcctcgagcccttcaagaatctgtttgggtcctacattggaatattctatacttttatcattagtatcgtagcacttctggtgatcatttacgttttgctcccaatatgtttcaagctgcgcgacaccctacggaaacacgaggatgcttacaagagagaaatgaaaatcaggtga

SEQ ID NO: 11013 - RNA, 4326 nt, synthetic construct
  misc_feature 1..4326: note = derived and/or modified CDS sequence (opt3) from LACV__KP271105.1__GP
  source 1..4326: mol_type = other RNA
atgatcaggattctggtgctcatagccgtcaccgctgcaagccccgtttaccagagatgcttccaagacggcgccatcgtgaagcagaacccttccaaagaggcggtaacagaagtgtgtcttaaggatgacgtctctatgattaaaactgaggctcggtatgtgcgcaatgccacgggggttttctcaaacaatgtggcaatccgaaagtggctggtcagtgattggcacgactgccgtccgaaaaagattatcggaggtcatataaacgtgatcgaagtaggcgatgacttgagcttacacaccgagtcctacgtttgttctgccgattgctcgattggggtggacaaggaaacagctcaggtcagactgcagactgataccacaaatcatttcgagatcgcaggaaccactgtgaaatcaggctggtttaagagcacaacctatattacgctagaccaaacttgtgagcacctcaaagtgagttgcggtccaaagtccgtccagttccatgcctgttttaaccagcacatgtcttgcgttaggttcctgcaccggaccatccttcccgggagcatagctaattccatttgtcagaacatcgaaattatcatcctggtgacattgactctcctgatttttatactgctctcaatcttaagtaaaacctacatttgctatctgcttatgcctatcttcataccaattgcctacatgtatggaatcatctacaataagagctgtaagaaatgcaagttgtgcggcctggtataccatccctttacagagtgtggcacccactgcgtgtgtggggcgcgctatgatacgtctgacagaatgaaactacatagggcatccggactctgccctggttacaagtcactgcgggccgctcgcgtcatgtgtaaaagcaagggcccagccagtattctttctatcattactgcagtgctggttttgacattcgtgacccccataaactccatggtcctcggggaaagcaaagagacttttgagctggaagagttacctgatgacatgctggaaatggcttcgcgaatcaattcttattacttcacatgcattctcaactatgccgtgtcctggggacttgtaatcatcggcctgttgaccggtctactgtttaagaagtaccaacacagattcctcaatgtttatgcgatgtactgtgaggaatgcgacatgtaccacgataaatcagggctgaagaggcatggagacttcacgaacaaatgtcggcagtgcacctgtggccagtatgaggatgccgcaggccttatggctcaccgtaagacatacaattgcctggtgcagtataaagccaagtggatgatgaactttttgattatatacatcttcctcattctgatcaaggacagtgctattgtcgtgcaagccgcagggactgattttaccacatgcttagagactgaaagcatcaactggaattgtaccggaccattcctgaacctaggtaattgccagaaacagcaaaagaaagagccgtatacaaacatagccacccagctcaagggcctgaaagctatctccgtccttgacattcccatcattactgggatccctgatgacatagcgggagcattgcgctacattgaagagagagaagattttcatgtgcagctgacgatcgagtatgccatgctctctaagtactgtgactactatacacagttcagcgataattcaggctacagtcaaaccacttggagggtttatctgcggtcccacgactttgaggcttgcattctttacccaaaccagcatttctgtcgatgcgtgaagaatggtgaaaaatgttcatcttcaaactgggactttgccaatgagatgaaggattattacagtgggaaacagaccaagttcgacaaagatctgaacttggcactcacagccctgcaccacgcttttcgcggcaccagctccgcctatatcgcaactatgttatctaagaagtcgaatgacgatctgatagcgtacacaaacaaaatcaaggctaaattccccggaaatgccctactcaaggcaattatcgactacattgcctatatgaaaagcctgcctggcatggctaactttaagtacgatgaattttgggacgagcttttgtataaaccaaatcccgccaaggcatccaacctggctagagggaaggaatcaagttacaacttcaaactcgccatctctagcaagtccataaaaacgtgcaagaatgtaaaagatgtcgcgtgtctgtcaccgaggagcggagccatttatgcttctatcatcgcatgcggtgagccttccggccccagtgtgtaccggaagccaagcgggggagtttttcagtcttccaccgaccgctcaatttattgtttactggatagtcattgccttgaggagttcgaagccatcaaccaagaagagttggacgctgtgaagaaaagcaagtgctgggagattgaatactcggatgtcaaacctctccaggagggcgacggtactaagtcctgtaaaatgaaggactctgggaattgcaacgtggccacaaatagatggcccgtaatacagtgtgaaaacgataagttttactatagcgagctgcagaaagactacgataagacccaagacatcggccactattgcctatcaccaggatgtacaactgtgaggtaccccattaatcctaaacatatcagtaactgcaattggcaggtttcccgttctagcattgcaaagatcgatgtccacaacatagaagacatcgagcagtataaaaaggcgattacccagaagctgcaaacgtccctctcactgttcaaatacgccaagaccaaaaatcttccacacatcaagccgatttataaatacatcacaatagagggcactgaaaccgctgaggggattgaaagcgcctacatcgagagtgaagtgcccgcattggctggaacatctatcggttttaagattaactccaaagagggcaagcatctgttagatgtgatagcctatgtcaagagcgcatcgtactcatctgtttatgccaaactctacagtactgggcctacctccggaatcaatacgaagcacgacgagctgtgtacaggcccatgccccgctaacattaatcatcaggtgggttggcttaccttcgcgaaagaacggactagctcttgggggtgtgaggaatttggctgcctggccgtgagcgatggatgtgtattcggctcctgccaggacatcattaaggaggaattgtcagtctatcgaaaagagacagaggaagtgaccgatgttgagctctgcctgacttttagtgacaagacctactgtacaaacctaaaccctgtgacgccaatcataaccgatctgttcgaagtccaatttaagactgtggagacatatagcctccccagaatcgttgcagtgcagaatcacgagattaaaatcgggcagattaacgacctgggagtatactctaagggctgcggtaatgtccagaaagtgaacgggaccgtgtacggaaatggcgtcccgaggttcgactatctttgtcatttggcttcccgcaaggaagttatcgtgcggaaatgctttgataacgactaccaagcctgtaagttcctgcagagccctgccagttatagattagaggaagatagcggtacagtaactataattgactacaagaaaatcctcggcaccatcaagatgaaagctattctgggggatgtgaagtataaaacgttcgcagactccgtcgatatcacagccgagggatcttgcaccggctgtataaattgctttgaaaacattcactgtgagcttactctgcacaccacaatcgaggcgtcgtgcccaattaagagctcatgtactgtgttccatgacaggatcctagttacccccaatgaacacaagtacgctctcaaaatggtgtgcacagagaagcctgggaacacgctgaccataaaagtctgcaatactaagattgaagcctccatggcattggtggatgccaaacccatcatcgagctggctccagttgaccagacagcatatattcgcgaaaaggatgagcgatgtaagacctggatgtgccgggtgcgtgacgagggattacaggtcatcctcgaaccttttaaaaacctgttcggcagttacattggtatattttacactttcatcatttctatcgtagcccttctggtgatcgtttatgtgttgctccccatttgttttaagctgagagacacactaaggaaacatgaggatgcgtacaagcgcgaaatgaaaatacggtga

SEQ ID NO: 11014 - RNA, 4326 nt, synthetic construct
  misc_feature 1..4326: note = derived and/or modified CDS sequence (opt3) from LACV(74-32813)__D10370.1__GP
  source 1..4326: mol_type = other RNA
atgatcagaatgctggtgctcattgtcgttaccgccgctagccccgtgtaccagaggtgcttccaagacggcgcaatagtaaagcagaacccttccaaagaggccgtgacagaagtctgtcttaaggatgacgtgtctatgatcaaaactgaggcgcggtatgttaagaatgctacgggggtgttttcaaacaatgtcgccattcgcaaatggctggtgagtgattggcacgactgccgaccaaagaagatcgtaggaggtcatattaacgttatcgaagtgggcgatgacttgagcttacacaccgagtcctacgtctgttctgcagattgcacaataggggtggacaaagaaactgcccaggtgcgtctgcagaccgatacaaccaatcatttcgagatcgctggaactacagtcaagtcgggctggtttaaatcaaccacgtatattactctagaccaaacctgtgagcacctcaaggttagctgcgcaccgaaaagtgtgcagttccatgcctgttttaaccagcacatgtcctgcgtaagattcctgcacaggacaatccttcccggttctattgctaatagcatctgtcagaacatagaaattatcattctggtgactttgaccctcctgatctttatcctgctctccattttatcaaagacatacatatgctatctgcttatgcctatcttcattccaatcgcctacatgtatggggtcatatacaataagagttgtaaaaagtgcaaattgtgcggactggtgtaccatccctttaccgagtgtggcacgcactgcgtttgtggcgcgcggtatgatactagcgaccgcatgaagctacatagagcatctgggctctgccctggatacaaatccctgagggccgctcgggtgatgtgtaagtcaaaaggtccagccagcattcttagtatcatcacagcagtcctggtgttgaccttcgtaactcccattaactctatggttctcggcgaatccaaggagacatttgagctggaagagttacctgatgacatgctggaaatggctctccgcatcaatagctattactttacctgcattcttaactatgccgtgtcgtgggggctgataatcgcgggattgctagtcggcctgattttcaagaaataccaacaccgattcctcaatatctatgccatgtactgtgaggaatgcaacatgtaccacgacaagtctggtctgaaaagacatggggatttcacgaataagtgtaggcagtgcacctgtggacagtatgaggacgcaacaggccttatcactcaccggaaaacctacaactgcctggtgcagtataaggctaagtggatgatgaactttttgattatatacatcttcctcattctgatcaaagattccgccattgtcggccaagctacagggactgactttaccacatgcttagagaccgaatcaatcaattggaactgtactggaccattcctgaatctaggtaactgccagaagcagcagaaaaaggagccgtatacgaatatagccacacaactcaaaggcctgaaggcaatcagtgtgcttgatattcccatcattaccagcatccctgacgatatagccggggctttgcgttacattgaagagaaggaagactttcatgttcagctgactaccgagtatgcgatgctctccaaatactgtgattactatacacagttctctgacaacagcggatactcacaaaccacttggcgcgtgtatctgagaagtcacgattttgaggcatgcatcctttacccaaatcagcatttctgtaagtgcgtcaaaaacggcgaaaagtgttccagctctaattgggactttgccaacggtatgaaaaattattactcagggaagcaggctaagttcgacaaagatctgaacttggccctcacagcactgcaccacgcctttaggggcacgagtagcgcttatattgccgcaatgttatccaagaaatctaatgacgatctgatcgcgtacaccaacaagataaaagctaagttccccggaaatgccctactcaaagcaatcattgactacatcgcctatatgaagggcctgcctgagatggctaactttaagtacgatgagttctgggacgaacttttgtataaaccaaaccccgccaaggcatcgaatctggctcgggggaaagaaagctcctacaacttcaagctcgccatttcaagtaaatctatcaagacttgcaagaatgtaaaagatgtggcgtgtctgagcccgcgatccggagccatatattcaagcattatcgcttgcggtgagcctaacggcccctctgtttaccgcaagccatccgggggagtgtttcagagtagcacagacagatctatctattgtttactggattcccattgccttgaggagttcgaagcaatttcacaagaagagttggacgccgtcaaaaagagtaaatgctgggagatcgaataccctgatgtgaggcccctccaggagagcgacggcgctaagtcgtgtcggatgaaggattccggtaattgcaacgtagccaccaatcgctggccagtgatgcagtgtgaaaacgacaaattttactattctgagctgcagaaggactacgataaaacacaagacattgggcactattgcctaagccccggctgtactaccataagataccctatcaatccaaagcatatttcaaactgcaattggcaggttagtaggtcctctatcgcaaaaattgatgtccacaacgtggaagacatcgagcagtataagaaggcgataacgcagaaactgcaaaccagcctctccctgttcaagtacgccaaaacaaagaatcttccgcacatccgtcccatttataaatacatcactatgaaggagaccgaaacagctgagggaattgaatcagcctacatcgagagcgaagtgcctgcattggctggcaccagtgtcgggtttaaaataaactctaaggagggaaagcatctgttagatgttattgcctatgtgaaatccgcaagctactcgtcagtgtatgccaagctctactctactggtccaacgagtggcatcaatacaaaacacgacgagctgtgtaccgggccctgccctgctaacatcaaccatcaggtaggatggcttactttcgcgcgggaacgaacatccagctggggctgtgaggaatttggttgcctggccgtctctgatgggtgtgtgttcggcagctgccaggacattataaaggaggaattgtccgtttatagaaaagagaccgaggaagtgactaatgtcgagctctgcctgaccttttcagataagacatactgtacgaacctaaatccagtgacccccatcattactgacctgttcgaagttcaatttaagacagtggagacctatagtctcccgaggatcgtagcagtccagaaccacgagattaaaatcggacagataaatgatctgggcgtgtacagcaaggggtgcggaaacgtgcagaaagtcaatggcacagtttacggtaacggggtgcctcgcttcgactatctttgtcatttggcttctcggaaggaagtaatcgtgagaaaatgctttgataatgactaccaagcctgtaagttcctgcagtccccagcctcatataggttagaggaagacagtggaactgtcaccattatcgattacaagaaaattctcggcacgatcaagatgaaagctatactgggtgacgtgaagtataaaacattcgcagatagcgttgacattaccgccgagggctcctgcgcggggtgtatcaactgctttcagaatatccactgtgaacttactctgcacaccacaattgaggcttcttgccccatcaagtcgagctgtactgtgttccatgatcgcattctagtcacccctaacgagcacaagtacgccctcaaaattgtgtgcacagaaaagcccggaaatacgctgaccatcaaagtttgcaacactcgaattgaggcatcaatggccttggtggacgctaagccaatcatagaactggcacctgtcgatcagacagcctatattcgggagaaagacgaacgttgtaagacctggatgtgcagagtaagggatgagggcttacaagtgatcctcgagccctttaagaatctgttcgggtcctacatcggaatattttacactttcatcattagtataatcgcgcttctggttattatctatgtgttgctcccaatctgttttaaactgcgcgacacactacggaagcatgatgacgcttacaaaagagaaatgaagattaggtga

SEQ ID NO: 11015 - RNA, 4326 nt, synthetic construct
  misc_feature 1..4326: note = derived and/or modified CDS sequence (opt3) from LACV(Craig County/VA/2009)__KP226848.1__GP
  source 1..4326: mol_type = other RNA
atgatcaggattctggtgctcatagccgtcaccgctgcaagccccgtttaccagagatgcttccaagacggcgccatcgtgaagcagaacccttccaaagaggcggtaacagaagtgtgtcttaaggatgacgtctctatgattaaaactgaggctcggtatgtgcgcaatgccacgggggtgttttcaaacaatgtggcaatccgaaagtggctggtcagtgattggcacgactgccgtccgaaaaagattatcggaggtcatataaacgtgatcgaagtaggcgatgacttgagcttacacaccgagtcctacgtttgttctgccgattgcacaattggggtggacaaggaaactgctcaggtcagactgcagaccgatacaaccaatcatttcgagatcgcaggaactacagtgaaatcgggctggtttaagtcaaccacgtatattactctagaccaaacctgtgagcacctcaaagtgagctgcggtccaaagagtgtccagttccatgcctgttttaaccagcacatgtcctgcgttaggttcctgcaccggacaatccttcccgggtctatagctaatagcatttgtcagaacatcgaaattatcatcctggtgactttgaccctcctgatttttatactgctctccatcttatcaaaaacatacatttgctatctgcttatgcctgtattcatcccaatagcctgtatttacggaatcatctataataagagttgcaagaaatgcaagttgtgtggcctggtgtaccatccctttaccgagtgcggcacgcactgtgtctgcggggcgcgctacgatactagcgacagaatgaaactacatagggcatctggactctgtcctggttataagtccctgcgggccgctcgcgtgatgtgcaaatcaaagggcccagccagcattcttagtatcattacagcagttctggtgttgaccttcgtcactcccataaactctatggtgctcggggaatccaaagagacatttgagctggaagagttacctgatgacatgctggaaatggctagccgaatcaattcgtactatttcacctgtattctcaactacgccgtatcttggggacttgttatcatcggcctgttgattggtctactgtttaagaagtatcaacacagattcctcaatatatacgcgatgtattgcgaggaatgtgacatgtaccacgataaatccgggctgaagaggcatggagacttcacgaacaaatgccggcagtgtacctgcggccagtacgaggatgccgcaggccttatggctcaccgtaagacatataattgcctggtgcagtacaaagccaagtggatcatgaactttttgattatctatattttcctcatcctgataaaggactcagctatcgtcgtgcaagccgcagggactgattttaccacatgtttagagactgaaagtattaactggaattgcaccggaccattcctgaacctaggtaattgtcagaaacagcaaaagaaagagccgtacacaaacatcgccacccagctcaagggcctgaaagctattagcgtccttgacatccccataattactgggatccctgatgacattgcgggagcattgcgctatatcgaagagagagaagattttcatgtgcagctgacgatagagtacgccatgctctccaagtattgcgactactacacacagttctctgataatagcggctattcacaaaccacttggagggtttacctgcggagtcacgactttgaggcttgtatcctttatccaaaccagcatttctgccgatgtgtgaagaatggtgaaaaatgctccagctctaactgggactttgccaatgggatgaaggattactattcaggcaaacaggcaaagttcgacaaagatctgaacttggccctcaccgctctgcaccacgcctttcgcggaacaagtagcgcatacattgcgaccatgttatccaagaagtctaatgacgatctgatcacttatacaaacaaaattaagacgaaattccccggcaatgctctactcaaggccatcatagactacattgcatacatgaaatcgctgcctgggatggccaactttaagtatgatgagttctgggacgaacttttgtacaaaccaaatcccgctaaggccagcaacctggcaagaggaaaggagtcctcatataacttcaaactcgctatcagttctaagagcatcaaaacctgtaagaatgtaaaagatgtcgcctgcctgtccccgaggtcaggtgcgatttacgccagcatcattgcttgtggcgaacctaacgggccctctgtgtatcggaagccatccggaggcgtttttcagagtagcactgaccgctctatatactgcttactggattcccattgccttgaggagttcgaagcaatctcacaagaggaattggacgccgtgaagaaaagtaagtgttgggagattgagtatcctgatgtcaaacccctccaggaaagcgacggtacaaagtcgtgcagaatgaaagactccgggaattgtaacgtggctaccaataggtggccaatcattcagtgcgagaacgataagttttactactctgaactgcagaaggactatgataaaacacaagacatcggccactactgtctaagccccggatgcactaccgtacgttatcctataaatccaaagcatatctcaaactgtaattggcaggttagtcggtcctctattgccaaaatcgatgttcacaacattgaggacatcgaacagtacaagaaagcaataacgcagaagctgcaaaccagcctctccctgttcaagtatgcgaaaacaaagaatcttccgcacattaaacccatctacaagtatatcactattgagggcaccgagacagccgaagggatagagtcagcttacatcgaaagcgaggtccctgccttggcaggagctagtattggttttaaaatcaactctaaggaaggcaaacatctgttagatgtgattgcctacgtgaagtccgcaagctattcgtcagtctacgccaagctctattctactgggccaaccagtggaatcaatacgaaacacgacgagctgtgcacaggcccctgtcctgctaacataaatcatcaggttggttggcttaccttcgcgcgagagagaacttccagctgggggtgcgaagagtttggctgtctggccgtgtctgatggatgcgtgttcggcagctgccaggacatcattaaggaagagttgtccgtatacaggaaagaaacagaggaggtcaccgatgtggaactctgtctgactttttcagacaagacctattgcacaaacctaaacccagttacgcccatcattaccgatctgttcgaggtgcaatttaaaactgtcgaaacatacagtctcccgcgcatcgtggcagttcagaatcacgagataaagattgggcagatcaacgacctgggagtgtatagcaagggctgtggtaatgtacagaaagtcaacgggaccgtgtacggaaatggcgtgcctcggttcgactacctttgccatttggcttctagaaaggaggtcatcgttaggaaatgttttgataacgactatcaagcctgcaagttcctgcagtccccagcctcataccgcttagaagaggatagtggtacagtgactattatcgactataaaaagatactcggcaccattaagatgaaagctatcctgggggatgtaaagtacaaaacgttcgcagacagcgtggatattacagccgaaggatcctgtaccggctgcatcaattgttttgagaacatacactgcgaacttactctgcacaccacaattgaggcgtcttgtcccatcaagtcgagctgcactgtcttccatgaccgaatcctagtgacccctaatgagcacaaatatgctctcaagatggtttgcacagaaaagcccgggaacacgctgaccattaaagtgtgtaatactaagatcgaggcctcaatggcattggtcgatgccaaaccaattatagaactggctcctgtggaccagacagcatacatccgggagaaggatgaacgttgcaaaacctggatgtgtagagttagggacgagggattacaggtgattctcgagccctttaagaacctgttcggctcctatatcggtatcttttacactttcattataagtatcgtcgccattcttgtaatcatttacgtgctgttgccaatctgctttaagctccgcgacacactgcggaaacatgaagatgcgtataagagagagatgaaaataaggtga

SEQ ID NO: 11016 - RNA, 4326 nt, synthetic construct
  misc_feature 1..4326: note = derived and/or modified CDS sequence (opt3) from LACV(Dallas/TX/2009)__GU591165.1__GP
  source 1..4326: mol_type = other RNA
atgatcagaattttggtgctcatagtcgttaccgccgctagccccgtgtaccagaggtgcttccaagacggcgcaatcgtaaagcagaacccttccaaagaggccgtgacagaagtctgtcttaaggatgacgtgtctatgattaaaactgaggcgcggtatgttaagaatgctacgggggtgttttcaaacaatgtcgccatccgcaaatggctggtgagtgattggcacgactgccgaccaaagaagattgtaggaggtcatatcaacgttatagaagtgggcgatgacttgagcttacacaccgagtcctacgtctgttctgcagattgcacaatcggggtggacaaagaaactgcccaggtgcgtctgcagaccgatacaaccaatcatttcgagattgctggaactacagtcaagtcgggctggtttaaatcaaccacgtatatcactctagaccaaacctgtgagcacctcaaggttagctgcggtccgaaaagtgtgcagttccatgcatgttttaaccagcacatgtcctgcgtaagattcctgcacaggacaattcttcccgggtctatcgccaatagcatatgtcagaacattgaaatcattatcctggtgactttgaccctcctgatctttattctgctctccatattatcaaagacatacatctgctatctgcttatgcctattttcatcccaatggcttacatgtatggagtcatatacaataagagttgtaaaaagtgcaaattgtgcggcctggtgtaccatccctttaccgagtgtggcacgcactgcgtttgtggggcccggtatgatactagcgaccgcatgaagctacatagagcgtctggactctgccctggttacaaatccctgagggcagcccgggtgatgtgtaagtcaaaaggcccagctagcattcttagtatcatcacagccgtcctggtgttgaccttcgtaactcccattaactctatggttctcggggaatccaaggagacatttgagctggaagagttacctgatgacatgctggaaatggcactccgcatcaatagctattactttacctgcattcttaactatgctgtgtcgtggggactgataatcgccggcttgctagtcggtctgatttttaagaaataccaacaccgattcctcaatatctatgcgatgtactgtgaggaatgcgacatgtaccacgataagtctgggctgaaaagacatggagacttcacgtccaagtgtaggcagtgcacctgtggccagtatgaggatgccacaggccttatcactcaccggaaaacctacaactgcctggtgcagtataaggcaaagtggatgatgaattttctgattatatacatcttcctcattctgatcaaagactcagctattgtcgtgcaagccacagggactgattttaccacatgcttagagaccgaaagtatcaactggaactgtactggaccattcctgaatctaggtaactgccagaagcagcagaaaaaggagccgtatacgaatatagctacacagctcaaaggcctgaaggccatcagcgttcttgacattcccatcattaccgggatccctgatgacatagcaggagccttgcgttacattgaagagaaggaagattttcatgtgcagctgactaccgagtatgctatgctctccaaatactgtgactactatacacagttctctgataacagcggctactcacaaaccacttggcgcgtatatctgagaagtcacgactttgaggcgtgcatcctttacccaaatcagcatttctgtaggtgcgtcaagaacggtgaaaaatgttccagctctaattgggactttgcaaacgagatgaagaattattactcagggaaacaggccaagttcgataaggacctgaacttggctctcacagccctgcaccacgcatttcggggcacgagtagcgcctatattgctaccatgttatccaaaaagtctaatgatgacctggtggcctacactaacaaaatcaaggcaaaattccccggaaatgcgctactcaaggctataatcgattacattgcctatatgaaaggcctgcctgacatggcaaactttaagtacgatgagttctgggacgaacttttgtataagccaaatcccgccaaggcttcgaacctggcccgagggaaagaaagctcctacaacttcaaactcgcagtttcaagtaagtctatccgcacatgcaaaaatgtgaaggatgtcgcttgtctgagcccgagatccggagccatttattcaagcatcatagcgtgcggtgagcctaacggcccctctgtgtacaggaagccatccgggggagtatttcagagtagcaccgaccggtctatttattgtttactggattcccattgccttgaggagttcgaagccatctcacaagaagagttggacgctgtgaaaaagagtaaatgctgggagatcgaataccctgatattcgccccctccaggagagcgacggctcgaagtcctgtagaatgaaagactctggtaattgcaacgttgcaacaaataggtggccagtcatgcagtgtgaaaacgataagttttactatagcgagctgcagaaggactacgataaaactcaagacatcgggcactattgcctatcacccggctgtaccacgattcgttaccctataaatccaaagcatatcagtaactgcaattggcaagtgtcccggtctagcattgccaaaatcgatgtgcacaacgtcgaagacattgagcagtataagaaagctatcacccagaagctgcaaacatccctctcactgttcaagtacgccaaaactaagaatcttccgcacataaaacccatctataagtacattaccatcgagggaacagaaactgcagagggcattgaaagcgcgtacatcgagagtgaagttcctgccttggctgggacctctataggatttaaaattaactccaaggagggtaaacatctgttagatgtgatcgcctatgtaaagagcgcatcgtactcatctgtgtatgctaagctctacagtacgggcccaacatccgggatcaataccaaacacgacgagctgtgtactggaccctgccctgccaacattaatcatcaggtcggctggcttacattcgcacgagaaagaaccagctcttggggttgtgaggaatttgggtgcctggccgtgagcgatggctgtgttttcggatcctgccaggacataatcaaggaggaattgtcagtgtataggaaagatactgaggaggtcaccaacgtggaactctgcctgacatttagtgacaagacgtactgtaccaacctaaatccagttactcccattatcacagatctgttcgaggtgcaatttaaaaccgtagaaacatatagcctcccgcgcattgtcgctgtgcagaaccacgagatcaagataggccagatcaatgacctgggggtgtactctaagggatgcggcaacgtccagaaagttaatggtactgtgtacgggaacggagtacctcggttcgactatctttgtcatttggcgtccagaaaggaggtgattgtcaggaaatgctttgataatgactaccaagcctgtaagttcctgcagtcaccagcaagttatcgcttagaagaggatagcggcaccgtgacgatcattgactacaaaaagatcctcggtacaataaagatgaaagctattctgggcgatgttaagtataaaaccttcgccgactccgtggatatcactgccgaagggtcttgcgctggatgtatcaactgctttgagaatattcactgtgaacttaccctgcacacaactatcgaggcatcgtgccccataaagagctcatgtaccgtcttccatgaccggattctagtgacacctaacgagcacaaatacgccctcaagatggtttgcacggaaaagcccggcaataccctgactatcaaagtgtgcaacacacgaattgaggtctccatggcgttggtagatgctaagccaatcatagaactggcccctgtggaccagaccgcatatattcgtgagaaagatgaaagatgtaagacttggatgtgcagggttcgcgacgaggggttacaggtgatcctcgagccctttaaaaatctgttcggaagttacatcggcattttctacacattcatcatttctataatcgcccttctggtcattatctatgtgttgctcccaatctgttttaagctgcgggacaccctaagaaagcatgatgacgcttacaaaagggaaatgaagattcgatga

SEQ ID NO: 11017 - RNA, 4326 nt, synthetic construct
  misc_feature 1..4326: note = derived and/or modified CDS sequence (opt3) from LACV(Fort Bend County/TX/2009)__GU591168.1__GP
  source 1..4326: mol_type = other RNA
atgatcagaatgctggtgctcattgtcgttaccgccgctagccccgtgtaccagaggtgcttccaagacggcgcaatagtaaagcagaacccttccaaagaggccgtgacagaagtctgtcttaaggatgacgtgtctatgatcaaaactgaggcgcggtatgttaagaatgctacgggggtgttttcaaacaatgtcgccattcgcaaatggctggtgagtgattggcacgactgccgaccaaagaagatcgtaggaggtcatattaacgttatcgaagtgggcgatgacttgagcttacacaccgagtcctacgtctgttctgcagattgcacaataggggtggacaaagaaactgcccaggtgcgtctgcagaccgatacaaccaatcatttcgagatcgctggaactacagtcaagtcgggctggtttaaatcaaccacgtatattactctagaccaaacctgtgagcacctcaaggttagctgcggtccgaaaagtgtgcagttccatgcatgttttaaccagcacatgtcctgcgtaagattcctgcacaggacaatccttcccgggtctattgccaatagcatctgtcagaacatagaaattatcattctggtgactttgaccctcctgatctttatcctgctctccattttatcacggacatacatatgctatctgcttatgcctatcttcattccaatcgcttacatgtatggagtcatatacaataagagttgtaagaaatgcaagttgtgcggcctggtgtaccatccctttaccgagtgtggcacgcactgcgtttgtggggcccgctatgatactagcgacagaatgaaactacatagggcgtctggactctgccctggttacaagtccctgcgggcagcccgcgtgatgtgtaaatcaaagggcccagctagcattcttagtatcatcacagccgtcctggtgttgaccttcgtaactcccattaactctatggttctcggggaatccaaagagacatttgagctggaagagttacctgatgacatgctggaaatggcactccgaatcaatagctattacttcacttgcattcttaactatgctgtgtcgtggggactgataatcgccggcttgctagtcggtctgatttttaagaagtaccaacacagattcctcaatatctatgcgatgtactgtgaggaatgcgacatgtaccacgataaatctgggctgaagaggcatggagacttcacgaacaaatgtcggcagtgcacctgtggccagtatgaggatgccgcaggccttatggctcaccgtaagacatacaattgcctggtgcagtataaagccaagtggatgatgaactttttgatcatttacatattcctcatcctgattaaggactccgctatcgtcgtgcaagccactgggaccgattttacaacttgcttagagaccgaatcaattaactggaattgtacaggaccattcctgaacctaggtaattgccagaaacagcaaaagaaagagccgtataccaacatcgcaactcagctcaagggcctgaaagccataagtgttcttgacatccccattatcacggggattcctgatgacatcgctggagcgttgcgctacatagaagagaaggaagattttcatattcagctgacaaccgagtatgcaatgctcagcaagtactgtgactactatactcagttctccgataattctggctacagccaaaccacatggagagtgtatctgaggtcacacgactttgaggcctgcatcctttacccaaaccagcatttctgtcggtgcgtcaaaaatggtgaaaagtgtagttccagcaactgggactttgctaatgagatgaaaaactattactctgggaagcaggccaaattcgataaggacctgaatttggcactcaccgccctgcaccacgcttttcgaggcacttcaagtgcctatattgcaacaatgttaagcaagaaatccaacgatgacctgatcgcgtacacgaataagataaaagctaagttccccggaaacgccctactcaaagcaatcattgattacatcgcctatatgaagggcctgcctgacatggctaattttaaatacgatgagttctgggacgaacttttgtataagccaaaccccgccaaggcatctaacctggctcgcgggaaagaatcgagctacaatttcaagctcgccatttcctcaaaaagtatcaagacctgcaaaaacgtaaaggatgtggcgtgtctgtctccgagaagcggagccatatattcctcaattatcgcttgcggtgagcctaatggccccagcgtttacaggaagccatctgggggagtgtttcagtccagtactgaccggagcatctattgtttactggattctcattgccttgaggagttcgaagcaatttcccaagaagagttggacgccgtcaaaaagtcaaaatgctgggagatcgaataccctgatgtgcgccccctccaggagagtgacggcgctaagagctgtagaatgaaagactcgggtaactgcaatgtagccacaaacaggtggccagtgatgcagtgtgaaaatgataagttttactattccgagctgcagaaggactacgataaaacccaagacattgggcactattgcctatctcccggctgtacaactatacgttaccctatcaacccaaagcatattagcaattgcaactggcaggtttcacggagttccatcgcaaaaattgatgtccacaatgtggaagacatcgagcagtataagaaagcgataacccagaagctgcaaacgtctctcagcctgttcaagtacgccaaaaccaagaaccttccgcacatcaaacccatttataagtacatcacaattgagggaactgaaaccgctgagggcatcgaatccgcctacatagagtcagaagtgcctgcattggctgggacaagcattggatttaaaatcaatagtaaggagggtaaacatctgttagatgtcatcgcctatgttaagtctgcatcctacagctcggtgtatgccaagctctactcaactggcccaacctctgggattaacacgaaacacgacgagctgtgtacaggaccctgccctgctaatataaaccatcaggtgggctggcttaccttcgcgcgagaaagaaccagttcctggggttgtgaggaatttgggtgcctggccgtaagcgatggctgtgtcttcggatcttgccaggacatcattaaggaggaattgagcgtgtataggaaagagacagaggaagttaccaacgtggagctctgcctgactttttccgataagacctactgtacatcactaaatccagtcacgcccatcattaccgacctgttcgaagtgcaatttaaaactgttgagacatatagtctcccgcgcatcgtggcagtacagaaccacgagataaagatcggccagattaatgatctgggggtctacagcaagggatgcggcaacgtgcagaaagtgaatggtaccgtctacgggaacggagttcctcggttcgactatctttgtcatttggcttctagaaaggaagtgatcgtaaggaaatgctttgacaatgattaccaagcctgtaagttcctgcagtccccagcctcatatcgcttagaggaagacagtggcacagtgactattatcgattacaaaaagatactcggtaccattaagatgaaagctatcctgggcgacgtcaagtataaaacgttcgcagatagcgtggacatcacagccgaggggtcctgcgcgggatgtattaactgctttgaaaatatccactgtgagcttaccctgcacactaccatagaggcttcttgccccattaagtcgagctgtacagttttccatgatcgaatcctagtgactcctaacgaacacaaatacgccctcaagatggtctgcaccgagaagcccggcaatacactgacgattaaagtgtgcaacacccggatcgaagcatcaatggccttggttgacgctaagccaataattgagctggcacctgtggatcagactgcctatatccgtgaaaaagacgagagatgtaagacatggatgtgcagggtccgcgatgaggggttacaggtaatcctcgaaccctttaaaaatctgttcggatcctacattggcatcttttacaccttcattataagtatcattgcgcttctggtgatcatctatgttttgctcccaatttgttttaagctgcgggacactctaagaaagcatgacgatgcttacaaaagggagatgaagatacgatga

SEQ ID NO: 11018 - RNA, 4326 nt, synthetic construct
  misc_feature 1..4326: note = derived and/or modified CDS sequence (opt3) from LACV(LAC22988-89)__U18980.1__GP
  source 1..4326: mol_type = other RNA
atgatctgcattctggtgctcataaccgtcgccgctgcaagccccgtttaccagagatgtttccaagacggcgccatcgtgaagcagaacccttccaaagaggcggtaacagaagtgtgccttaaggatgacgtctctatgattaaaactgaggctaggtatgtgcggaatgccacgggggttttctcaaacaatgtggcaatccgcaagtggctggtcagtgattggcacgactgtcgaccgaaaaagattgtgggaggtcatatcaacgtaatagaagttggcgatgacttgagcttacacaccgagtcctacgtgtgctctgccgattgtacaatcggggtcgacaaggaaactgctcaggtgcgtctgcagaccgatacaaccaatcatttcgagattgcaggaactacagtgaaatcgggctggtttaagtcaaccacgtatatcactctagaccaaacctgcgagcacctcaaagtcagctgtggtccaaagagtgttcagttccatgcctgctttaaccagcacatgtcctgtgtgagattcctgcacaggacaattcttcccgggtctatcgctaatagcatatgccagaacattgaaatcattatcctggtaactttgaccctcctgatctttattctgctctccatattatcaaaaacatacatctgttatctgcttatgcctattttcatcccaatagcctacatttatggaatcatctacaataagagttgcaagaaatgcaagttgtgtggcctggtgtaccatccctttaccgagtgcggcacgcactgtgtctgcggggcgcggtatgatactagcgaccgcatgaaactacatagagcatctggactctgtcctggttacaagtccctgagggccgctcgggtgatgtgcaaatcaaagggcccagccagcattcttagtatcattacagcagttctggtgttgaccttcgtcactcccataaactctatggtgctcggggaatccaaagagacatttgagctggaagatttacctgacgacatgctggagatggctagccgcatcaattcgtattacctcacctgtattcttaactatgccgtatcttggggactggttatcatcggcttgctaattggtctgctctttaagaagtaccaacaccgatttctgaatgtgtatgcgatgtactgcgaagagtgtgatatgtaccacgacaaatccgggcttaagagacatggagatttcacgaacaaatgcaggcagtgtacctgcggccagtatgaagacgccgcaggcctgatggctcaccggaagacatacaattgcttggtccagtataaagccaagtggatgatgaacttcctcataatctacatttttctgatcttaattaaggattcagctatcgtggtccaagccgcagggactgacttcaccacatgtctggagactgagagtataaactggaattgcaccggaccatttctaaacctcggtaattgtcagaaacagcaaaagaaagaaccgtatacaaacatcgccacccagctgaagggccttaaagctattagcgtgttggatgttcccatcattactgggatccctgacgatatagcgggagcactgcgttacattgaggaaaaggaggacttccatgtgcagctcacgatcgaatatgccatgctgtccaagtactgcgattactatacacagttttctgacaatagcggctactcacaaaccacttggcgcgtatatcttagaagtcacaacttcgaggcttgtattctgtacccaaatcagcatttttgtaggtgcgtcaaaaacggtgagaagtgctccagctctaattgggacttcgccaacgaaatgaaagattattactcagggaagcagaccaaatttgacaaggatttgaatctcgcactgacagccttacaccacgctttccggggcaccagtagcgcctatatcgcaactatgctgtccaagaaatctaacgacgatctaatagcgtacacaaataagatcaaaacgaagtttcccggaaacgctctcctgaaagccattatcgactacattgcatatatgaagtcgcttcctggcatggccaatttcaaatacgatgagttttgggacgaattgctgtataagccaaaccccgctaaggccagcaacctcgcacgagggaaagagtcctcatacaatttcaagctggctatcagttctaaaagcataaagatttgtaaaaacgtgaaggatgttgcctgcttatccccgcgctcaggagcgatctatgccagcatcattgcttgtggtgaacctaatggcccctctgtgtacagaaagccatccgggggagtcttccagagtagcaccgacaggtctatctattgcctgcttgattcccattgcttggaggagtttgaagcaattggccaagaggaactcgacgccgtgaaaaagtcaaaatgttgggagatagagtaccctgatgtaaagctgatccaggaaggtgacgggactaaaagttgccggatgaaggacagcggcaactgtaatgtggctacaaaccgctggcccgttattcagtgcgagaatgataagttctactattcggaactacagaaagactacgataaggcccaagacatcggacactattgtctgtccccaggctgcaccacagtcagataccccattaaccctaaacatatctctaattgtaactggcaagtgagcaggtcaagtatagcaaagatcgatgtgcacaatattgaggacatcgaacagtataaaaaggcgattactcagaagctccaaacctccctgtctctttttaaatacgccaagacgaaaaacttgccacacatcaagccgatatataaatacattaccatcgaggggacagagactgctgaaggaatcgagagcgcctacattgaatccgaggtccccgcactggctggtacctcaataggcttcaagatcaatagcaaagaagggaagcatttactcgatgttattgcctatgtgaagagtgcatcttactccagcgtgtatacaaaactgtactcgactggacctacctcaggcatcaacacgaagcacgacgagctttgcacaggtccatgtcccgccaatattaaccatcaggtagggtggctgacctttgctcgtgagcggacttctagttggggctgcgaagagttcggatgtttggcggtctccgatggctgcgtgtttgggagctgccaggacatcataaaagaggaactctctgtttatcgaaaggaaacagaggaggtgaccgatgtcgaactgtgtctaactttcagcgacaaaacctactgcacaaacctgaatcctgtgacgccaatcattaccgatctctttgaggttcaattcaagactgtggaaacatattccctgcccagaatcgtagccgtccagaaccacgagattaagatcggacagataaatgaccttggcgtgtactcaaaaggttgtgggaacgtgcagaaggtcaatggaaccatttacggcaacggtgttccgaggtttgactatttgtgccatctggcaagtcgcaaagaggtgatcgtacggaagtgtttcgataatgactaccaggcttgcaaatttttacagagccctgcctcttatagactcgaagaggattccggcacagtgactatcattgactacaagaagatcctggggaccataaaaatgaaggccattcttggagatgtcaaatataagacgttcgctgactcagtggatatcacagcagaaggcagttgtaccgggtgcattaactgtttcgagaatatccactgcgaactgactctacacaccacaatagaggccagctgtccaattaaatcctcttgcactgtttttcatgacaggatcctcgtgacccccaacgagcacaagtacgcgctgaagatggtctgcacagaaaaacctggaaatacgttgaccatcaaggtgtgtaacactaaagttgaggcttcgatggccctggtggatgcaaagcccattatcgaattagccccagtcgaccagacagcttatattcgcgagaaagatgaacgatgcaagacctggatgtgtcgggtacgtgacgagggcctccaggtgatactggagcctttcaagaatctttttggtagctacatcgggattttctacacttttatcatctcaattgttgtgctgttggtcataatctatgtgctcctgcccatttgcttcaaactaagagacacactgaggaagcatgaagatgcatacaaacgcgagatgaagatccggtga

SEQ ID NO: 11019 - RNA, 4326 nt, synthetic construct
  misc_feature 1..4326: note = derived and/or modified CDS sequence (opt3) from LACV(LAC30928-31)__U18979.1__GP
  source 1..4326: mol_type = other RNA
atgatctgcattctggtgctcataaccgtcgccgctgcaagccccgtttaccagagatgtttccaagacggcgccatcgtgaagcagaacccttccaaagaggcggtaacagaagtgtgccttaaggatgacgtctctatgattaaaactgaggctaggtatgtgcggaatgccacgggggttttctcaaacaatgtggcaatccgcaagtggctggtcagtgattggcacgactgtcgaccgaaaaagattgtgggaggtcatatcaacgtaatagaagttggcgatgacttgagcttacacaccgagtcctacgtgtgctctgccgattgtacaatcggggtcgacaaggaaactgctcaggtgcgtctgcagaccgatacaaccaatcatttcgagattgcaggaactacagtgaaatcgggctggtttaagtcaaccacgtatatcactctagaccaaacctgcgagcacctcaaagtcagctgtggtccaaagagtgttcagttccatgcctgctttaaccagcacatgtcctgtgtgagattcctgcacaggacaattcttcccgggtctatcgctaatagcatatgccagaacattgaaatcattatcctggtaactttgaccctcctgatctttattctgctctccatattatcaaaaacatacatctgttatctgcttatgcctattttcatcccaatagcctacatttatggaaccatctacaataagagttgcaagaaatgcaagttgtgtggcctggtgtaccatccctttacggagtgcggcactcactgtgtctgcggggcgcggtatgatacaagcgaccgcatgaaactacatagagcatctggactctgtcctggttacaagtccctgagggccgctcgggtgatgtgcaaatcaaagggcccagccagcatccttagtattatcaccgcagttctggtgttgactttcgtcacacccattaactctatggtgctcggggaatccaaagagacctttgagctggaagatttacctgacgacatgctggagatggctagccgcataaattcgtattacctcacgtgtatccttaactatgccgtatcttggggactggttattatcggcttgctaatcggtctgctctttaagaagtaccaacaccgatttctgaatgtgtatgcgatgtactgcgaagagtgtgatatgtaccacgacaaatccgggcttaagagacatggagatttcaccaacaaatgcaggcagtgtacatgcggccagtatgaagacgccgcaggcctgatggctcaccggaagacttacaattgcttggtccagtataaagccaagtggatgatgaacttcctcattatatacatctttctgattttaatcaaggattcagctattgtggtccaagccgcagggaccgacttcacaacttgtctggagaccgagagtatcaactggaattgcacaggaccatttctaaacctcggtaattgtcagaaacagcaaaagaaagaaccgtataccaacatagccactcagctgaagggccttaaagctatcagcgtgttggatgttcccattatcacggggattcctgacgatatcgcgggagcactgcgttacatagaggaaaaggaggacttccatgtgcagctcacaattgaatatgccatgctgtccaagtactgcgattactatacccagttttctgacaatagcggctactcacaaactacctggcgcgtatatcttagaagtcacgacttcgaggcttgtatcctgtacccaaaccagcatttttgtaggtgcgtcaaaaatggtgagaagtgctccagctctaaccgggatttcgccaatgaaatgaaagactattactcagggaagcagacaaaatttgataaggacttgaacctcgcactgaccgccttacaccacgctttccgaggcacaagtagcgcctatattgcaacaatgctgtccaagaaatctaatgatgacctaatcgcgtacacgaacaagataaaaaccaagtttcccggaaatgctctcctgaaagccatcattgattacatcgcatatatgaagtcgcttcctggcatggccaacttcaaatacgacgagttttgggatgaattgctgtataagccaaatcccgctaaggccagcaacctcgcacgcgggaaagagtcctcatacaacttcaagctggctattagttctaaaagcatcaagatatgtaaaaatgtgaaggacgttgcctgcttatccccgagatcaggagcgatttatgccagcatcatcgcttgtggtgaacctaacggcccctctgtgtacaggaagccatccgggggagtcttccagagtagcactgatccttctatttattgcctgcttgactcccattgcttggaggagtttgaagcaatcggccaagaggaactcgatgccgtgaaaaagtcaaaatgttgggagattgagtaccccgacgtaaagctgatacaggaaggtgacgggacaaaaagttgccggatgaaggatagcggcaattgtaacgtggctaccaatcgctggccagttatccagtgcgagaacgacaagttctactattcggaactacagaaagattacgacaagacacaagatattggacactattgtctgtcccccggctgcactaccgtcagataccctatcaatccaaaacatatttctaactgtaattggcaagtgagcaggtcaagtatcgccaagatagacgtgcacaacatcgaggatattgaacagtataaaaaggcaatcacgcagaagctccagacctccctgtctctttttaaatacgcgaagactaaaaatttgccgcacattaagcccatctataaatacataactattgaggggaccgagacagccgaaggaatcgagagcgcttacatcgaatccgaggtccctgccctggcaggtacttcaattggcttcaagataaacagcaaagaagggaagcatttactcgacgttatcgcttatgtgaagagtgcctcttactccagcgtgtataccaaactgtactcgacgggaccaacatcaggcattaataccaagcacgatgagctttgcactggtccctgtcctgcaaacatcaatcatcaggtagggtggctgacatttgcccgtgagcggacctctagttggggctgcgaagagttcggatgtttggctgtctccgacggctgcgtgtttgggagctgccaggatattatcaaagaggaactctctgtttatcgaaaggaaactgaggaggtgaccgacgtcgaactgtgtctaacattcagcgataaaacgtactgcaccaacctgaacccagtgactcccataatcacagacctctttgaggttcaattcaagaccgtggaaacatattccctgccgagaattgtagcggtccagaatcacgagatcaagattggacagatcaacgaccttggcgtgtactcaaaaggttgtgggaatgtgcagaaggtcaacggaactatatacggcaatggtgttcctaggtttgattatttgtgccatctggccagtcgcaaagaggtgattgtacggaagtgtttcgacaacgattaccaagcatgcaaatttttacagagcccagcttcttatagactcgaagaggactccggcaccgtgacgatcatcgattacaagaagattctggggacaatcaaaatgaaggccatacttggagacgtcaaatataagaccttcgccgattcagtggacattactgctgaaggcagttgtaccgggtgcatcaattgtttcgagaacattcactgcgaactgacactacacactaccatcgaggcaagctgtcccataaaatcctcttgcacagtttttcatgataggattctcgtgacgcctaatgagcacaagtacgccctgaagatggtctgcaccgaaaaacccggaaacactttgacaatcaaggtgtgtaataccaaaatcgaggcgtcgatggctctggttgacgccaagccaattatcgaattagcacctgtggatcagactgcctatattcgcgagaaagacgaacgatgcaagacatggatgtgtcgggtccgtgacgagggcctccaggtaatactggagcccttcaagaacctttttggtagctacatcgggattttctacacctttatcatctcaattgtggctctgttggttataatctatgtgctcctgccaatttgcttcaaactaagagatacgctgaggaagcatgaagacgcatacaaacgcgagatgaagatccggtga

SEQ ID NO: 11020 - RNA, 4326 nt, synthetic construct
  misc_feature 1..4326: note = derived and/or modified CDS sequence (opt3) from LACV(LAC76-40)__U70206.1__GP
  source 1..4326: mol_type = other RNA
atgatctgcattctggtgctcataaccgtcgccgctgcaagccccgtttaccagagatgtttccaagacggcgccatcgtgaagcagaacccttccaaagaggcggtaacagaagtgtgccttaaggatgacgtctctatgattaaaactgaggctaggtatgtgcggaatgccacgggggttttctcaaacaatgtggcaatccgcaagtggctggtcagtgattggcacgactgtcgaccgaaaaagattgtgggaggtcatatcaacgtaatagaagttggcgatgacttgagcttacacaccgagtcctacgtgtgctctgccgattgtacaatcggggtcgacaaggaaactgctcaggtgcgtctgcagaccgatacaaccaatcatttcgagattgcaggaactacagtgaaatcgggctggtttaagtcaaccacgtatatcactctagaccaaacctgcgagcacctcaaagtcagctgtggtccaaagagtgttcagttccatgcctgctttaaccagcacatgtcctgtgtgagattcctgcacaggacaattcttcccgggtctatcgctaatagcatatgccagaacattgaaatcattatcctggtaactttgaccctcctgatctttattctgctctccatattatcaaaaacatacatctgttatctgcttatgcctattttcatcccaatagcctacatttatggaatcatctacaataagagttgcaagaaatgcaagttgtgtggcctggtgtaccatccctttaccgagtgcggcacgcactgtgtctgcggggcgcggtatgatactagcgaccgcatgaaactacatagagcatctggactctgtcctggttacaagtccctgagggccgctcgggtgatgtgcaaatcaaagggcccagccagcattcttagtatcattacagcagttctggtgttgaccttcgtcactcccataaactctatggtgctcggggaatccaaagagacatttgagctggaagatttacctgacgacatgctggagatggctagccgcatcaattcgtattacctcacctgtattcttaactatgccgtatcttggggactggttatcatcggcttgctaattggtctgctctttaagaagtaccaacaccgatttctgaatgtgtatgcgatgtactgcgaagagtgtgatatgtaccacgacaaatccgggcttaagagacatggagatttcacgaacaaatgcaggcagtgtacctgcggccagtatgaagacgccgcaggcctgatggctcaccggaagacatacaattgcttggtccagtataaagccaagtggatgatgaacttcctcataatctacatttttctgatcttaattaaggattcagctatcgtggtccaagccgcagggactgacttcaccacatgtctggagactgagagtataaactggaattgcaccggaccatttctaaacctcggtaattgtcagaaacagcaaaagaaagaaccgtatacaaacatcgccacccagctgaagggccttaaagctattagcgtgttggatgttcccatcattactgggatccctgacgatatagcgggagcactgcgttacattgaggaaaaggaggacttccatgtgcagctcacgatcgaatatgccatgctgtccaagtactgcgattactatacacagttttctgacaatagcggctactcacaaaccacttggcgcgtatatcttagaagtcacgacttcgaggcttgtattctgtacccaaaccagcatttttgtaggtgcgtcaaaaatggtgagaagtgctccagctctaactgggatttcgccaatgaaatgaaagactattactcagggaagcagaccaaatttgataaggacttgaacctcgcactgacagccttacaccacgctttccggggcaccagtagcgcctatatcgcaactatgctgtccaagaaatctaatgatgacctaatagcgtacacaaacaagatcaaaacgaagtttcccggaaatgctctcctgaaagccattatcgattacattgcatatatgaagtcgcttcctggcatggccaacttcaaatacgacgagttttgggatgaattgctgtataagccaaatcccgctaaggccagcaacctcgcacgagggaaagagtcctcatacaacttcaagctggctatcagttctaaaagcataaagacctgtaaagacgtgaaggatgttgcctgcttatccccgcgctcaggagcgatttatgccagcatcatcgcttgtggtgaacctaatggcccctctgtgtacagaaagccatccgggggagtcttccagagtagcactgacaggtctatttattgcctgcttgattcccattgcttggaggagtttgaagcaatcggccaagaggaactcgacgccgtgaaaaagtcaaaatgttgggagattgagtaccctgacgtaaagctgatacaggaaggtgatgggacaaaaagttgccggatgaaggacagcggcaactgtaatgtggctaccaaccgctggcccgttatccagtgcgagaatgataagttctactattcggaactacagaaagactacgataagacacaagacattggacactattgtctgtccccaggctgcactaccgtcagataccccatcaaccctaaacatatttctaattgtaactggcaagtgagcaggtcaagtatcgccaagatagatgtgcacaatatcgaggacattgaacagtataaaaaggcaatcacgcagaagctccaaacctccctgtctctttttaaatacgcgaagactaaaaacttgccacacattaagccgatctataaatacataacaattgaggggaccgagacagccgaaggaatcgagagcgcttacatcgaatccgaggtccccgccctggcaggtacttcaattggcttcaagataaatagcaaagaagggaagcatttactcgatgttatcgcttatgtgaagagtgcctcttactccagcgtgtatgcaaaactgtactcgaccggacctacgtcaggcattaacacaaagcacgacgagctttgcaccggtccatgtcccgccaatatcaaccatcaggtagggtggctgacttttgctcgtgagcggacatctagttggggctgcgaagagttcggatgtttggcggtctccgatggctgcgtgtttgggagctgccaggacattatcaaagaggaactctctgtttatcgaaaggaaaccgaggaggtgactgatgtcgaactgtgtctaaccttcagcgacaaaacatactgcacgaatctgaaccctgtgaccccaataatcactgacctctttgaggttcaattcaagacagtggaaacctattccctgcccagaattgtagccgtccagaaccacgagatcaagattggacagatcaatgatcttggcgtgtactcaaaaggttgtgggaacgtgcagaaggtcaatggaacaatatacggcaacggtgttccgaggtttgactatttgtgccatctggcaagtcgcaaagaggtgattgtacggaagtgtttcgataatgactaccaggcttgcaaatttttacagagccctgcctcttatagactcgaagaggattccggcactgtgaccatcatcgactacaagaagattctggggacgatcaaaatgaaggccatacttggagatgtcaaatataagacattcgctgactcagtggatattaccgcagaaggcagttgtactgggtgcatcaactgtttcgagaatattcactgcgaactgaccctacacacaactatcgaggccagctgtccaataaaatcctcttgcaccgtttttcatgacaggattctcgtgacacccaacgagcacaagtacgcgctgaagatggtctgcacggaaaaacctggaaataccttgactatcaaggtgtgtaacacaaaaatcgaggcttcgatggccctggttgatgcaaagcccattatcgaattagccccagtggaccagaccgcttatattcgcgagaaagacgaacgatgcaagacttggatgtgtcgggtccgtgatgagggcctccaggtaatactggagcctttcaagaatctttttggtagctacatcgggattttctacacatttatcatctcaattgtggcactgttggttataatctatgtgctcctgcccatttgcttcaaactaagagacaccctgaggaagcatgaagatgcctacaaacgcgagatgaagatccggtga

SEQ ID NO: 11021 - RNA, 4326 nt, synthetic construct
  misc_feature 1..4326: note = derived and/or modified CDS sequence (opt3) from LACV(LAC79-283)__U70207.1__GP
  source 1..4326: mol_type = other RNA
atgatcagaatactggtgctcatagccgtcaccgctgcaagccccgtttaccagaggtgcttccaagacggcgccatcgtgaagcagaacccttccaaagaggcggtaacagaagtgtgtcttaaggatgacgtctctatgattaaaactgaggctcggtatatccgcaatgccacgggggtgttttcaaacaatgttgcaattcgaaagtggctggtgagtgattggcacgactgccgtccaaaaagaatcataggaggtcatatcaacgtcattgaagtgggcgatgacttgagcttacacaccgagtcctacgtatgttctgccgattgcacaatcggggttgacaaggaaactgctcaggtgaggctgcagaccgatacaaccaatcatttcgagattgcaggaactacagtcaagtcgggctggtttaaatcaaccacgtatatcactctagaccaaacctgtgagcacctcaaggtgagctgcggtccgaaaagtgtgcagttccatgcctgttttaaccagcacatgtcctgcgtccggttcctgcaccgcacaatacttcccgggtctattgctaatagcatctgtcagaacattgaaatcatcattctggttactttgaccctcctgatatttatcctgctctccattttatcaaagacatacatctgctatctgcttatgcctatattcattccaatcgcctacatctatggaattatctacaataaaagttgtaagaagtgcaaattgtgcggcctggtgtaccatccctttaccgagtgtggcacgcactgcgtatgtggggcgagatatgatactagcgacaggatgaagctacatcgggcatctggactctgccctggttacaaatccctgcgcgccgctcgagtgatgtgtaagtcaaaaggcccagccagcattcttagtataatcacagcagtcctggtgttgaccttcgttactcccattaactctatggtgctcggggaatccaaggagacatttgagctggaagagttacctgatgacatgctgggaatggctagcagaatcaattcgtattacttcacttgcatcctcaactatgccgtctcttggggccttgtgattataggtctgttgacggggctactgtttaaaaagtaccaacacaggttcctcaatgtatatgcgatgtactgtgaagagtgcgacatgtaccacgataagtccggactgaaacggcatggcgacttcaccaacaagtgtcgtcagtgcacatgtggccagtatgaagatgccactgggcttatggcacaccgcaaaacctacaattgcctggttcagtataaggctaaatggatgatgaactttttggtgatctacattttcctcatcctgattaaggactcagccatcgtcgtgcaagctgccggaacagattttactacctgcttagagacagagagtataaactggaattgtaccggtccattcctgaacctaggcaattgccagaagcagcagaaaaaggaaccgtatactaacatcgcaacgcaactcaaagggctgaaggccattagcgtccttgacatccccattatcacaggaatacctgatgacattgctggcgcgttgagatacatcgaggaaagggaggattttcatgtgcagctgaccattgaatatgcaatgctctccaaatactgtgactactatactcagttctctgataatagcggttactcacaaaccacatggcgggtttatctgcgaagtcacgactttgaggcctgcatcctttacccaaaccagcatttctgtcgctgcgtgaagaatggggagaagtgttccagctctaactgggactttgctaatgaaatgaaagatttctattcaggcaagcagaccaaatttgacaaggatctgaacttggccctcactgcactgcaccacgccttcagaggaacaagtagcgcttacatagccacgatgttatccaaaaagtctaatgacgatctgatcgcatataccaacaagattaaaactaagtttcccggcaatgcgctactcaaagctatcattgactacatcgcctacatgaagtcgctgcctgggatggcaaacttcaaacatgatgagttctgggacgaacttttgtataagccaaatcccgccaaagctagcaacctggccaggggaaaggagtcctcatacaactttaagctcgcaataagttctaaaagcattaagacatgcaaaaatgtaaaggatgtcgcttgtctgtccccgcggtcaggtgccatctatgcgagcatcattgcctgcggcgaacctaacgggccctctgtgtaccgcaaaccatccggaggcgttttccagagtagcaccgacagatctatctattgtttactggattcccactgccttgaggagtttgaagctatttcacaagaggaattggacgcagtgaagaagagtaaatgctgggagatagagtaccctgatgtcaagcccctccaggaaggtgacgggacaaaaagctgtaggatgaaggactcgggcaattgcaacgtggccactaatcgttggccagtaatccagtgtgagaacgataaattctattactccgaactgcagaaggactacgataagacccaagacattggacattattgcctatctcccggctgtacgaccgtgcggtaccctatcaatccaaaacacattagcaactgcaattggcaggtttcacgaagttccatcgctaagatagatgtccacaacatcgaggacattgaacagtataaaaaggccatcacacagaaactgcaaacttctctcagcctgtttaagtacgcaaagaccaaaaatcttccgcatattaagcccatctataaatacataacaattgaggggactgagaccgcggaaggaatcgagtccgcctatatcgaatcagaggtgcctgctttggccggtacgagcattggcttcaagataaacagtaaagaagggaagcacctgttagatgtgatcgcatacgtcaaatctgcttcctacagctcggtttatgccaagctctactcaacaggaccaacctctggcattaatactaagcatgacgagctgtgtacaggtccctgccctgcaaacatcaatcaccaggtggggtggcttacctttgccagagagaggaccagttcctggggctgtgaagagttcggatgcctggctgtgagcgatggctgtgtatttgggtcttgccaggacattatcaaagaagagttgagcgtctatcgcaaggaaaccgaggaggtgacagatgttgaactctgcctgacgttctccgacaaaacctactgtactaacctaaacccagtgacacccataatcaccgatctgtttgaggtccaattcaatacagtggaaacttattcactcccgcggattgttgcggtgcagaaccatgagatcaagattggacagatcaatgacctgggcgtatacagtaaaggttgcgggaacgtccagaaggtgaatggaaccgtgtatggcaacggtgtccctagatttgactacctttgtcacttggccagcaggaaggaggttatagtgcgcaaatgcttcgataatgactaccaagcatgtaagttcctgcagtctccagcttcctatcgattagaagaggattcaggcacggtaacaattatcgactacaaaaagatcctcgggaccattaaaatgaaggccatcctgggagatgtgaagtataaaacttttgccgacagtgtcgatataaccgctgaaggcagctgcacagggtgtattaactgcttcgagaatatccactgtgaacttactctgcataccacaattgaggcatcctgccccatcaagtcttcgtgtacggtgtttcacgaccggattctagttacccctaacgagccccagtacgccctcaaaatggtgtgcactgaacgtccaggaaatacactgaccattaaggtctgcaacactaaaatcgaggcgagcatggctttggtggatgccaagcctatcattgaactggcacccgttgaccagacagcctatatcagagagaaggatgaaaggtgtaaaacctggatgtgccgcgtgcgggacgagggcttacaagtcattctcgagccattcaagaatctgtttggttcatacatagggatcttctatacgtttattatctccatggtagcacttctggtgatcatttacgttttgctcccgatatgtttcaaactgagagacactctaaggaagcatgaagatgcttacaaacgagagatgaagatccgctga

SEQ ID NO: 11022 - RNA, 4326 nt, synthetic construct
  misc_feature 1..4326: note = derived and/or modified CDS sequence (opt3) from LACV(LAC81-4)__U70208.1__GP
  source 1..4326: mol_type = other RNA
atgatcaggattctggtgctcatagccgtcaccgctgcaagccccgtttaccagagatgcttccaagacggcgccatcgtgaagcagaacccttccaaagaggcggtaacagaagtgtgtcttaaggatgacgtctctatgattaaaactgaggctcggtatatccgcaatgccacgggggtgttttcaaacaatgttgcaattcgaaagtggctggtgagtgattggcacgactgccgtccgaaaaagatcataggaggtcatatcaacgtcattgaagtgggcgatgacttgagcttacacaccgagtcctacgtatgttctgccgattgcacaatcggggttgacaaggaaactgctcaggtgagactgcagaccgatacaaccaatcatttcgagattgcaggaactacagtcaaatcgggctggtttaagtcaaccacgtatatcactctagaccaaacctgtgagcacctcaaagtgagctgcggtccaaagagtgtgcagttccatgcctgttttaaccagcacatgtcctgcgtcaggttcctgcaccggacaatacttcccgggtctattgctaatagcatctgtcagaacattgaaatcatcattctggttactttgaccctcctgatatttatcctgctctccattttatcaaaaacatacatctgctatctgcttatgcctatattcattccaatcgcctacgtgtatggaatcatttacaataagagttgtaagaaatgcaagttgtgcggcctggtataccatccctttaccgagtgtggcacgcactgcgtgtgtggggcgcgctatgatactagcgacagaatgaaactacatagggcatctggactctgccctggttacaagtccctgcgggccgctcgcgtcatgtgtaaatcaaagggcccagccagcatccttagtattataacagcagtgctggttttgaccttcgtgactcccatcaactctatggtcctcggggaatccaaagagacatttgagctggaagagttacctgatgacatgctgggaatggctagccgaattaattcgtattacttcacttgcatcctcaactatgccgtgtcttggggccttgtaatcattggtctgttgacggggctactgtttaagaagtaccaacacagattcctcaatgtttatgcgatgtactgtgaagagtgcgacatgtaccacgataaatccggactgaagaggcatggcgacttcaccaacaaatgtcggcagtgcacatgtggccagtatgaagatgccactgggcttatggcacaccgtaagacctacaattgcctggtgcagtataaagctaagtggatgatgaactttttggtcatatacatcttcctcattctgatcaaggactcagccattgtggtccaagctgccggaacagattttactacctgcttagagacagagagtatcaactggaattgtaccggtccattcctgaacctaggcaattgccagaaacagcaaaagaaagaaccgtatactaacatagcaacgcagctcaaggggctgaaagccatcagcgtgcttgacattcccatcattacaggaatccctgatgacatagctggcgcgttgcgctacattgaggaaagagaggattttcatgttcagctgaccatcgaatatgcaatgctctccaagtactgtgactactatactcagttctctgataatagcggttactcacaaaccacatggagggtgtatctgcggagtcacgactttgaggcctgcattctttacccaaaccagcatttctgtcgatgcgtaaagaatggggagaaatgttccagctctaactgggactttgctaatgaaatgaaggatttctattcaggcaaacagaccaagtttgacaaagatctgaacttggccctcactgcactgcaccacgccttccgcggaacaagtagcgcttacatcgccacgatgttatccaagaagtctaatgacgatctgatagcatataccaacaaaatcaagactaaatttcccggcaatgcgctactcaaggctattatcgactacattgcctacatgaaatcgctgcctgggatggcaaacttcaagcatgatgagttctgggacgaacttttgtataaaccaaatcccgccaaggctagcaacctggccagaggaaaggagtcctcatacaactttaaactcgcaatcagttctaagagcataaaaacatgcaagaatgtcaaagatgtggcttgtctgtccccgaggtcaggtgccatttatgcgagcatcatcgcctgcggcgaacctaacgggccctctgtttaccggaagccatccggaggcgtgttccagagtagcaccgaccgctctatttattgtttactggattcccactgccttgaggagtttgaagctatctcacaagaggaattggacgcagtcaagaaaagtaagtgctgggagattgagtaccctgatgtgaaacccctccaggaaggtgacgggacaaagagctgtagaatgaaagactcgggcaattgcaacgtagccactaataggtggccagtgatacagtgtgagaacgataagttctattactccgaactgcagaaggactacgataaaacccaagacatcggacattattgcctatctcccggctgtacgaccgttcgttaccctattaatccaaagcacatcagcaactgcaattggcaggtctcacggagttccattgctaaaatcgatgtgcacaacatagaggacatcgaacagtataagaaagccattacacagaagctgcaaacttctctcagcctgtttaagtacgcaaaaaccaagaatcttccgcatatcaaacccatttataagtacatcacaatagaggggactgagaccgcggaaggaattgagtccgcctatatcgaatcagaggtgcctgctttggccggtacgagcatcggcttcaaaattaacagtaaggaagggaaacacctgttagatgtcatagcatacgttaagtctgcttcctacagctcggtgtatgccaagctctactcaacaggaccaacctctggcatcaatactaaacatgacgagctgtgtacaggtccctgccctgcaaacattaatcaccaggtggggtggcttacctttgcccgagagagaaccagttcctggggctgtgaagagttcggatgcctggctgtaagcgatggctgtgtctttgggtcttgccaggacatcattaaggaagagttgagcgtgtataggaaagaaaccgaggaggttacagatgtggaactctgcctgacgttctccgacaagacctactgtactaacctaaacccagtcacacccatcataaccgatctgtttgaggtgcaattcaaaacagttgaaacttattcactcccgcgcatcgtggcggtacagaatcatgagattaagatcggacagattaacgacctgggcgtctacagtaagggttgcgggaatgtgcagaaagtgaacggaaccgtctatggcaatggtgttcctcggtttgactacctttgtcacttggccagcagaaaggaggtgatcgtaaggaaatgcttcgataacgactaccaagcatgtaagttcctgcagtctccagcttcctatcgcttagaagaggattcaggcacggtgacaataattgactacaaaaagatcctcgggaccatcaagatgaaagccattctgggagatgtcaagtataaaacttttgccgacagtgtggatatcaccgctgaaggcagctgcacagggtgtataaattgcttcgagaacattcactgtgaacttactctgcataccacaatcgaggcatcctgccccattaagtcttcgtgtacggtttttcacgaccgaatcctagtgacccctaatgagccccagtacgccctcaaaatggtctgcactgaacggccaggaaacacactgaccataaaggtgtgcaatactaagattgaggcgagcatggctttggttgatgccaaacctatcatcgaactggcacccgtggaccagacagcctatattcgtgagaaggatgaaagatgtaaaacctggatgtgcagggtccgcgacgagggcttacaagtaatcctcgagccattcaagaacctgtttggttcatacattgggatattctatacgtttatcatttccatggtggcacttctggttatcatctacgtgttgctcccgatttgtttcaaactgcgggacactctaagaaagcatgaagatgcttacaagagggagatgaaaatacgatga

SEQ ID NO: 11023 - RNA, 4326 nt, synthetic construct
  misc_feature 1..4326: note = derived and/or modified CDS sequence (opt3) from LACV(LACR56869)__U70205.1__GP
  source 1..4326: mol_type = other RNA
atgatctgcattctggtgctcataaccgtcgccgctgcaagccccgtttaccagagatgtttccaagacggcgccatcgtgaagcagaacccttccaaagaggcggtaacagaagtgtgccttaaggatgacgtctctatgattaaaactgaggctaggtatgtgcggaatgccacgggggtattttcaaacaatgtggcaatccgcaagtggctggtcagtgattggcacgactgtcgaccgaaaaagattgtgggaggtcatatcaacgtaatagaagttggcgatgacttgagcttacacaccgagtcctacgtgtgctctgccgattgtacaatcggggtcgacaaggaaactgctcaggtgcgtctgcagaccgatacaaccaatcatttcgagattgcaggaactacagtgaaatcgggctggtttaagtcaaccacgtatatcactctagaccaaacctgcgagcacctcaaagtcagctgtggtccaaagagtgttcagttccatgcctgctttaaccagcacatgtcctgtgtgagattcctgcacaggacaattcttcccgggtctatcgctaatagcatatgccagaacattgaaatcattatcctggtaactttgaccctcctgatctttattctgctctccatattatcaaaaacatacatctgttatctgcttatgcctattttcatcccaatagcctacatttatggaatcatctacaataagagttgcaagaaatgcaagttgtgtggcctggtgtaccatccctttaccgagtgcggcacgcactgtgtctgcggggcgcggtatgatactagcgaccgcatgaaactacatagagcatctggactctgtcctggttacaagtccctgagggccgctcgggtgatgtgcaaatcaaagggcccagccagcattcttagtatcattacagcagttctggtgttgaccttcgtcactcccataaactctatggtgctcggggaatccaaagagacatttgagctggaagatttacctgacgacatgctggagatggctagccgcatcaattcgtattacctcacctgtattcttaactatgccgtatcttggggactggttatcatcggcttgctaattggtctcctgttcaagaagtaccaacaccgatttctgaatatatatgcgatgtactgcgaagagtgtgatatgtaccacgacaaatccgggcttaagagacatggagatttcacgaacaaatgcaggcagtgtacctgcggccagtatgaagacgccgcaggcctgatggctcaccggaagacatacaattgcttggtgcagtataaagccaagtggatgatgaacttcctcatcatttacatctttctgattttaatcaaggattcagctatagtcgtgcaagccgcagggactgacttcaccacatgtctggagactgagagtatcaactggaattgcaccggaccatttctaaacctcggtaattgtcagaaacagcaaaagaaagaaccgtatacaaacattgccacccagctgaagggccttaaagctatcagcgtcttggatgtgcccattatcactgggatacctgacgatattgcgggagcactgcgttacatcgaggaaaaggaggacttccatgttcagctcacgattgaatatgccatgctgtccaagtactgcgattactatacacagttttctgacaatagcggctactcacaaaccacttggcgcgtgtatcttagaagtcacgacttcgaggcttgtatcctgtacccaaaccagcatttttgtaggtgcgttaaaaatggtgagaagtgctccagctctaactgggatttcgccaatgaaatgaaagactattactcagggaagcagaccaaatttgataaggacttgaacctcgcactgacagccttacaccacgctttccggggcaccagtagcgcctatatggcaactatgctgtccaagaaatctaatgatgacctaatagcgtacacaaacaagatcaaaacgaagtttcccggaaatgctctcctgaaagccattatcgattacattgcatatatgaagtcgcttcctggcatggccaacttcaaatacgacgagttttgggatgaattgctgtataagccaaatcccgctaaggccagcaacctcgcacgagggaaagagtcctcatacaacttcaagctggctatcagttctaaaagcataaagacctgtaaaaatgtcaaggacgtggcctgcttatccccgcgctcaggagcgatttatgccagcatcatcgcttgtggtgaacctaacggcccctctgtttacagaaagccatccgggggagtgttccagagtagcactgataggtctatttattgcctgcttgactcccattgcttggaggagtttgaagcaatcggccaagaggaactcgatgccgtcaaaaagtcaaaatgttgggagattgagtaccctgacgtgaagctgatacaggaaggtgacgggacaaaaagttgccggatgaaggatagcggcaattgtaacgtagctaccaatcgctggcccgtgatccagtgcgagaacgacaagttctactattcggaactacagaaagattacgacaagacacaagatattggacactattgtctgtccccaggctgcactaccgttagataccccatcaatcctaaacatatttctaactgtaattggcaggtcagcaggtcaagtatcgccaagatagacgtgcacaacatcgaggatattgaacagtataaaaaggcaatcacgcagaagctccaaacctccctgtctctttttaaatacgcgaagactaaaaatttgccacacattaagccgatctataaatacataacaattgaggggaccgagacagccgaaggaatcgagagcgcttacatcgaatccgaggtgcccgccctggcaggtacttcaattggcttcaagataaacagcaaagaagggaagcatttactcgacgtcatcgcttatgttaagagtgcctcttactccagcgtgtataccaaactgtactcgacgggacctacatcaggcattaataccaagcacgatgagctttgcactggtccatgtcccgcaaacatcaatcatcaggacgggtggctgacatttgcccgtgagcggacctctagttggggctgcgaagagttcggatgtttggctgtgtccgatggctgcgtatttgggagctgccaggacattatcaaagaggaactctctgtctatcgaaaggaaactgaggaggtgaccgatgttgaactgtgtctaacattcagcgacaaaacgtactgcaccaacctgaaccctgtgactccaataatcacagacctctttgaggtccaattcaagaccgtggaaacatattccctgcccagaattgttgcggtgcagaatcacgagatcaagattggacagatcaacgatcttggcgtatactcaaaaggttgtgggaatgtccagaaggtgaacggaactatatacggcaatggtgtgccgaggtttgactatttgtgccatctggccagtcgcaaagaggtcattgttcggaagtgtttcgataacgactaccaagcatgcaaatttttacagagccctgcttcttatagactcgaagaggattccggcaccgtgacgatcatcgactacaagaagattctggggacaatcaaaatgaaggccatacttggagatgtaaaatataagaccttcgccgactcagtggatattactgctgaaggcagttgtaccgggtgcatcaattgtttcgagaacattcactgcgaactgacactacacactaccatcgaggcaagctgtccaataaaatcctcttgcacagtctttcatgacaggattctcgtgacgcccaatgagcacaagtacgccctgaagatggtttgcaccgaaaaacctggaaacactttgacaatcgaggtgtgtaataccaagatcgaagcgtcgatggctctggtcgatgccaaacccattatcgagttagcaccagtggaccagactacatatattcgcgaaaaggacgagcgatgcaaaacctggatgtgtcgggttcgtgatgagggcctccaggtgatactggaacctttcaagaacctttttggtagctacatcgggattttctacacgtttatcatctcaattgtcgccctgttggtaataatctatgtgctcctgcccatttgcttcaagctaagagacactctgaggaaacatgaggatgcttacaagcgcgaaatgaaaatccggtga

SEQ ID NO: 11024 - RNA, 4326 nt, synthetic construct
  misc_feature 1..4326: note = derived and/or modified CDS sequence (opt3) from LACV(NAT_Crawford_WI_2007)__GU596383.1__GP
  source 1..4326: mol_type = other RNA
atgatcaggattctggtgctcatagccgtcaccgctgcaagccccgtttaccagagatgcttccaagacggcgccatcgtgaagcagaacccttccaaagaggcggtaacagaagtgtgtcttaaggatgacgtctctatgattaaaactgaggctcggtatgtgcgcaatgccacgggggttttctcaaacaatgtggcaatccgaaagtggctggtcagtgattggcacgactgccgtccgaaaaagattatcggaggtcatataaacgtgatcgaagtaggcgatgacttgagcttacacaccgagtcctacgtttgttctgccgattgcacaattggggtggacaaggaaactgctcaggtcagactgcagaccgatacaaccaatcatttcgagatcgcaggaactacagtgaaatcgggctggtttaagtcaaccacgtatattactctagaccaaacctgtgagcacctcaaagtgagctgcggtccaaagagtgtccagttccatgcctgttttaaccagcacatgtcctgcgttaggttcctgcaccggacaatccttcccgggtctatagctaatagcatttgtcagaacatcgaaattatcatcctggtgactttgaccctcctgatttttatactgctctccatcttatcaaaaacatacatttgctatctgcttatgcctatcttcataccaattgcctacgtatatggaatcatctacaataagagttgtaagaaatgcaagttgtgcggcctggtgtaccatccctttaccgagtgtggcacgcactgcgtctgtggggcgcgctatgatactagcgacagaatgaaactacatagggcatctggactctgccctggttacaagtccctgcgggccgctcgcgtgatgtgtaaatcaaagggcccagccagcattcttagtatcattacagcagttctggtgttgaccttcgtcactcccataaactctatggtgctcggggaatccaaagagacatttgagctggaagagttacctgatgacatgctggaaatggctagccgaatcaattcgtattactttacctgcattctcaactatgccgtatcttggggacttgttatcatcggcctgttgacgggtctactgtttaagaagtaccaacacagattcctcaatgtgtatgcgatgtactgtgaggaatgcgacatgtaccacgataaatccgggctgaagaggcatggagacttcaccaacaaatgtcggcagtgcacatgtggccagtatgaggatgccactggccttatggcacaccgtaagacctacaattgcctggtccagtataaagctaagtggatgatgaactttttgattatatacatcttcctcattctgatcaaggactcagccattgtggtccaagctgccgggacagattttactacctgcttagagacagaaagtatcaactggaattgtaccggaccattcctgaacctaggtaattgccagaaacagcaaaagaaagagccgtatactaacatagcaacgcagctcaagggcctgaaagccatcagcgtgcttgacattcccatcattacagggatccctgatgacatagctggagcgttgcgctacattgaagagagagaagattttcatgttcagctgaccatcgagtatgcaatgctctccaagtactgtgactactatactcagttctctgataatagcggctactcacaagccacctggagggtgtatctgcggagtcacgactttgaggcttgcattctttacccaaaccagcatttctgtcgatgcgtaaagaatggtgaaaaatgttccagctctaactgggactttgccaatgagatgaaggatttctattcagggaaacagacaaagtttgacaaagatctgaacttggcactcaccgccctgcaccacgctttccgcggcacttcaagcgcctacatcgcaacaatgttatccaagaagtctaatgacgatctgatagcgtatacgaacaaaatcaagaccaaatttcccggaaatgctctactcaaggccattatcgactacattgcatacatgaaatcgctgcctggcatggccaacttcaagtatgatgagttctgggacgaacttttgtacaaaccaaatcccgctaaggccagcaacctggcaagagggaaggaatcctcatataactttaaactcgctatcagttctaagagcataaaaacttgcaagaatgtcaaagatgtggcctgtctgtccccgaggtcaggagcgatttacgccagcatcatcgcttgcggtgagcctaacggcccctctgtttatcggaagccatccgggggagtgttccagagtagcacagaccgctctatttactgtttactggattcccattgccttgaggaatttgaggcaatctcacaagaagagttggacgccgtcaagaaaagtaagtgctgggagattgaatatcctgatgtgaaacccctccaggagagcgacggcaccaagtcgtgtagaatgaaagactccggtaattgcaacgtagctacaaataggtggccagtgatacagtgtgaaaacgataagttctactactctgagctgcagaaggactatgataaaactcaagacatcgggcactactgcctaagccccggctgtaccacggttcgttatcctattaatccaaagcatatctcaaactgcaattggcaggtcagtcggtcctctattgccaaaatcgatgtgcacaacatagaagacatcgagcagtacaagaaagcaattacccagaagctgcaaacaagcctctccctgtttaagtatgcgaaaactaagaatcttccgcacatcaaacccatttacaagtatatcaccatagagggaacagaaactgccgagggcattgaatcagcttacatcgagagcgaagtgcctgccttggcagggaccagtatcggattcaaaattaactctaaggagggtaaacatctgttagatgtcatagcttacgttaagtccgccagctattcgtcagtgtacgcaaagctctattctacgggcccaacaagtgggatcaataccaaacacgacgagctgtgtactggaccctgccctgccaacattaatcatcaggtgggctggcttacatttgctcgagaaagaacctccagctggggttgtgaggagttcgggtgcctggcggtatctgatggctgtgtctttggaagctgccaggacatcattaaggaagaattgtccgtgtacaggaaagagactgaggaagttaccgatgtggagctctgcctgacattctcagacaagacgtattgtaccaacctaaacccagtcactcccatcataacagatctgtttgaagtgcaattcaaaaccgttgagacatacagtctcccgcgcatcgtggccgtacagaatcacgagattaagatcggccagattaacgacctgggggtctatagcaagggatgcggcaatgtgcagaaagtgaacggtactgtctacgggaatggagttcctcggtttgactacctttgtcatttggcatctagaaaggaagtgatcgtaaggaaatgcttcgataacgactatcaggcttgtaagttcctgcaatccccagcctcataccgcttagaggaagatagtggcaccgtgacgataattgactataaaaagatcctcggtacaatcaagatgaaagccattctgggcgatgtcaagtacaaaacctttgctgacagcgtggatatcactgcagaggggtcctgcaccggatgtataaattgcttcgaaaacattcactgtgagcttacactgcacactaccatcgaggcctcttgccccattaagtcgagctgtacagtttttcatgaccgaatcctagtgacgcctaatgaacacaaatatgcgctcaagatggtctgcaccgagcggcccggcaacactctgacaataaaggtgtgcaataccaaaattgaagctagtatggccttggttgatgcaaagccaatcatcgagctggcccctgtggaccagactgcttacattcgtgaaaaagatgagagatgtaagacatggatgtgcagggtccgcgacgaggggttacaggtaatcctcgaacccttcaaaaacctgtttggatcctatattggcatattctacacctttatcattagtatcgtggcacttctggttatcatttacgtgttgctcccaatatgtttcaagctgcgggacacgctaagaaagcatgaggatgcctataaaagggaaatgaagatccgatga

SEQ ID NO: 11025 - RNA, 4326 nt, synthetic construct
  misc_feature 1..4326: note = derived and/or modified CDS sequence (opt3) from LACV(77)__DQ196119.1__GP
  source 1..4326: mol_type = other RNA
atgatctgcattctggtgctcataaccgtcgccgctgcaagccccgtttaccagagatgtttccaagacggcgccatcgtgaagcagaacccttccaaagaggcggtaacagaagtgtgccttaaggatgacgtctctatgattaaaactgaggctaggtatgtgcggaatgccacgggggtttttagtaacaatgtggcaatccgcaagtggctggtcagtgattggcacgactgtcgaccgaaaaagattgtgggaggtcatatcaacgtaatagaagttggcgatgacttgagcttacacaccgagtcctacgtgtgctctgccgattgtacaatcggggtcgacaaggaaactgctcaggtgcgtctgcagaccgatacaaccaatcatttcgagattgcaggaactacagtgaaatcgggctggtttgagtcaaccacgtatatcactctagaccaaacctgcgaacacctcaaggtcagctgtggtccaaaaagtgttcagttccatgcctgctttaaccagcacatgtcctgtgtgagattcctgcacaggacaattcttcccgggtctatcgctaatagcatatgccagaacattgagatcattatcctggtaactttgaccctcctgatctttattctgctctccatattatcaaagacatacatctgttatctgcttatgcctattttcatcccaatagcctacatttatggaaccatctacaataaaagttgcaagaagtgcaaattgtgtggcctggtgtaccatccctttacggaatgcggcactcactgtatctgcggggcgcggtatgatacaagcgaccgcatgaagctacatagagcatctggactctgtcctggttacaaatccctgagggccgctcgggtcatgtgcaagtcaaaaggcccagccagcattcttagtatcattaccgcagtgctggttttgactttcgtgacacccataaactctatggtcctcggggagtccaaggagacctttgaactggaggatttacctgacgacatgctggaaatggctagccgcatcaattcgtattacctcacgtgtattcttaactatgccgtgtcttggggactggtaatcatcggcttgctaattggtctcctgttcaaaaagtaccaacaccgatttctgaatgtttatgcgatgtactgcgaggaatgtgatatgtaccacgacaagtccgggcttaaaagacatggagatttcaccaacaagtgcaggcagtgtacatgcggccagtatgaggacgccgcaggcctgatggctcaccggaaaacttacaattgcttggtgcagtataaggccaaatggatgatgaacttcctcataatctacatttttctgatcttaattaaggattcagctatcgtcgtgcaagccgcagggaccgacttcacaacttgtctggagaccgaaagtataaactggaattgcacaggaccatttctaaacctcggtaattgtcagaagcagcagaaaaaggagccgtataccaacatcgccactcaactgaaaggccttaaggctattagcgtcttggatgtgcccatcattacggggatccctgacgatatagcgggagcactgcgttacattgaagagaaagaagacttccatgttcagctcacaatcgagtatgccatgctgtccaagtactgcgattactatacccagttttctgacaatagcggctactcacaaactacctggcgcgtgtatcttagaagtcacgacttcgaggcttgtattctgtacccaaaccagcatttttgtaggtgcgtaaagaatggtgaaaaatgctccagctctaaccgggatttcgccaatgagatgaaggactattactcagggaaacagacaaagtttgataaagacttgaacctcgcactgaccgccttacaccacgctttccgaggcacttcaagcgcctatatcgcaacaatgctgtccaagaagtctaatgatgacctaatagcgtacacgaacaaaatcaagaccaaatttcccggaaatgctctcctgaaggccattatcgattacattgcatatatgaaatcgcttcctggcatggccaacttcaagtacgacgaattttgggatgagttgctgtataaaccaaatcccgctaaggccagcaacctcgcacgcgggaaggaatcctcatacaacttcaaactggctatcagttctaagagcataaaaacttgtaagaatgtcaaagacgtggcctgcttatccccgagatcaggagcgatttatgccagcatcatcgcttgtggtgagcctaacggcccctctgtttacaggaagccatccgggggagtgttccagagtagcacagatcaatctatttattgcctgcttgactcccattgcttggaggaatttgaggcaatcggccaggaggaactcgatgccgtcaagaaatcaaagtgttgggagattgaataccctgacgtgaaactgatacaggagggtgacgggaccaagagttgccggatgaaagatagcggcaattgtaacgtagctacaaatcgctggcccgtgatccagtgcgaaaacgacaagttctactattcggagctacaaaaggattacgacaaaactcaggatattggacactattgtctgtccccaggctgcaccacggttagataccccatcaatcctaagcatatttctaactgtaattggcaggtcagcaggtcaagtatcgccaaaatagacgtgcacaacatcgaagatattgagcagtataagaaagcaatcacccaaaagctccagacatccctgtctctttttaagtacgcgaaaactaagaatttgccacacattaaaccgatctataagtacataaccattgaggggacagaaactgccgagggaatcgaaagcgcttacatcgagtccgaagtgcccgccctggcaggtacctcaattggcttcaaaataaacagcaaggaggggaaacatttactcgacgtcatcgcttatgttaagagtgcctcttactccagcgtgtatacgaagctgtactcgacaggacctacctcaggcattaatactaaacacgatgagctttgcacaggtccatgtcccgcaaacatcaatcatcaggtggggtggctgacctttgcccgtgaacggacttctagttggggctgcgaggagttcggatgtttggctgtatccgacggctgcgtctttgggagctgccaagatattatcaaggaagaactctctgtgtatcgaaaagagaccgaggaagttacagacgtggagctgtgtctaacgttcagcgataagacctactgcactaacctgaaccctgtcacaccaataatcaccgacctctttgaagtgcagttcaaaacagttgaggcgtattccctgcccagaattgtggccgtacagaatcacgagatcaagattggacagatcaacgaccttggcgtctactcaaagggttgtgggaatgtgcaaaaagtgaacggaactatatacggcaatggtgtcccgaggtttgattatttgtgccatctggcaagtcgcaaggaagttattgtgcggaaatgtttcgacaacgattaccaggcttgcaagtttttacagagccctgcctcttatagactcgaggaagactccggcaccgtaacgatcatcgattacaaaaagattctggggacaatcaagatgaaagccatacttggagacgtgaagtataaaaccttcgctgattcagtcgacattactgcagagggcagttgtaccgggtgcatcaattgtttcgaaaacattcactgcgagctgacactacacactaccatcgaggccagctgtccaataaagtcctcttgcacagtgtttcatgataggattctcgttacgcccaatgaacacaaatacgcgctgaagatggtgtgcaccgagaagcctggaaacactttgacaatcaaagtctgtaataccaagatcgaggcttcgatggccctggtggacgcaaaacccattatcgaattagccccagttgatcagactgcttatattcgcgaaaaggacgagcgatgcaaaacatggatgtgtcgggtgcgtgacgagggcctccaagtcatactggaacctttcaagaacctttttggtagctacatcgggattttctacacctttatcatctcaattgtagcactgttggtgataatctatgttctcctgcccatttgcttcaagctaagagatacgctgaggaaacatgaggacgcctacaagcgcgaaatgaaaatccggtga

SEQ ID NO: 11026 - RNA, 4326 nt, synthetic construct
  misc_feature 1..4326: note = derived and/or modified CDS sequence (opt3) from LACV(LACV/00/NC-M (NC00-283))__GU206112.1__GP
  source 1..4326: mol_type = other RNA
atgatcaggattctggtgctcatagccgtcaccgctgcaagccccgtttaccagagatgcttccaagacggcgccatcgtgaagcagaacccttccaaagaggcggtaacagaagtgtgtcttaaggatgacgtctctatgattaaaactgaggctcggtatgtgcgcaatgccacgggggttttctcaaacaatgtggcaatccgaaagtggctggtcagtgattggcacgactgccgtccgaaaaagattatcggaggtcatataaacgtgatcgaagtaggcgatgacttgagcttacacaccgagtcctacgtttgttctgccgattgcacaattggggtggacaaggaaactgctcaggtcagactgcagaccgatacaaccaatcatttcgagatcgcaggaactacagtgaaatcgggctggtttaagtcaaccacgtatattactctagaccaaacctgtgagcacctcaaagtgagctgcggtccaaagagtgtccagttccatgcctgttttaaccagcacatgtcctgcgttaggttcctgcaccggacaatccttcccgggtctatagctaatagcatttgtcagaacatcgaaattatcatcctggtgactttgaccctcctgatttttatactgctctccatcttatcaaaaacatacatttgctatctgcttatgcctatcttcataccaattgcctacatgtatggaatcatctacaataagagttgtaagaaatgcaagttgtgcggcctggtataccatccctttaccgagtgtggcacgcactgcgtgtgtggggcgcgctatgatactagcgacagaatgaaactacatagggcatctggactctgccctggttacaagtccctgcgggccgctcgcgtcatgtgtaaatcaaagggcccagccagcattcttagtatcattacagcagtgctggttttgaccttcgtgactcccataaactctatggtcctcggggaatccaaagagacatttgagctggaagagttacctgatgacatgctggaaatggctagccgaatcaattcgtattactttacctgcattctcaactatgccgtgtcttggggacttgtaatcatcggcctgttgacgggtctactgtttaagaagtaccaacacagattcctcaatgtttatgcgatgtactgtgaggaatgcgacatgtaccacgataaatccgggctgaagaggcatggagacttcaccaacaaatgtcggcagtgcacatgtggccagtatgaggatgccgcaggccttatggctcaccgtaagacttacaattgcctggtgcagtataaagccaagtggatgatgaactttttgattatatacatcttcctcattctgatcaaggactcagctattgtcgtgcaagccgcagggaccgattttacaacttgcttagagaccgaaagtatcaactggaattgtacaggaccattcctgaacctaggtaattgccagaaacagcaaaagaaagagccgtataccaacatagccactcagctcaagggcctgaaagctatcagcgtccttgacattcccatcattacggggatccctgatgacatagcgggagcattgaagtacattgaggaacgcgaagattttcatgtgcagctgacaatcgagtatgccatgctctccaagtactgtgactactatacccagttctctgataatagcggctactcacaaactacctggagagtttatctgaggagtcacgactttgaggcttgcattctttacccaaaccagcatttctgtcggtgcgtgaaaaatggtgaaaagtgttccagctctaactgggactttgccaatgagatgaaagattattactcagggaagcagacaaaattcgacaaggatctgaacttggcactcaccgccctgcaccacgcttttcgaggcacaagtagcgcctatatcgcaactatgttatccaagaaatctaatgacgatctgatagcgtacacgaacaagatcaaaaccaagttccccggaaatgctctactcaaagccattatcgactacattgcatatatgaagtcgctgcctggcatgactaactttaaatacgataagttctgggacgaacttttgtataagccaaatcccgccaaagctagcaacctggcccgcgggaaggagtcctcatacaacttcaaactcgcaatcagttctaagagcataaaaacatgcaagaatgtaaaggatgtcgcttgtctgtccccgagatcaggagccatttatgcgagcatcatcgcctgcggtgaacctaacggcccctctgtgtacaggaaaccatccgggggagtttttcagagtagcaccgaccggtctatttattgtttactggattcccattgccttgaggagttcgaagctatcaatcaagaggaattggacgcagtgaagaaatcaaagtgctgggagattgagtacagtgatgtcaaacctctccaggaaggcgacggtacaaagagctgtcgcatgaaggactcggggaactgcaatgtggccactaacagatggcccgtaatacagtgtgagaatgataaattttactattccgaactgcagaaggactacgataaaacccaagacatcggccactattgcctatctccaggatgtacgaccgtgaggtaccccattaaccctaagcatatcagcaattgcaactggcaggtttcacgtagttccattgctaaaatcgatgtccacaatatagaggacatcgaacagtataagaaggccattacacagaaactgcaaacttctctcagcctgttcaagtacgcaaaaaccaagaaccttccacacatcaaaccgatttataagtacatcacaatagagggcactgagaccgcggaagggattgagtccgcctacatcgaatcagaggtgcccgctttggccggaacgagcatcggttttaaaattaatagtaaggaaggcaagcatctgttagatgtgatagcatatgtcaaatctgcttcctacagctcggtttatgccaagctctactcaacagggcctacctctggaatcaacactaaacacgacgagctgtgtacaggcccatgccccgcaaatattaaccatcaggtgggttggcttaccttcgccaaggagcggaccagttcctgggggtgtgaagagtttggctgcctggctgtgagcgatggatgtgtattcggctcttgccaggacatcattaaagaagagttgagcgtctatcgaaaggaaactgaggaggtgacagatgttgaactctgcctgacgttttccgacaagacctactgtactaacctaaatcctgtgacaccaatcataaccgatctgttcgaggtccaatttaaaacagtggaaacttattcactccccagaatcgttgcggtgcagaaccacgagattaagatcgggcagattaatgacctgggagtatacagtaaaggctgcggtaacgtccagaaggtgaatgggaccgtgtacggaaacggcgtcccgaggttcgactatctttgtcatttggccagccgcaaagaggttatcgtgcggaagtgctttgataatgactaccaagcatgtaagttcctgcagtctcctgcttcctatagattagaagaggattcaggtacggtaacaataattgactacaaaaagatcctcggcaccatcaaaatgaaggccattctgggggatgtgaaatataagactttcgccgacaacgtcgatatcaccgctgaaggaagttgcacaggctgtataaattgctttgagaacattcactgtgaacttactctgcacaccacaatcgaggcaagctgcccaattaagtcctcttgtacggtgttccatgacaggatcctagttaccccctcggagcacaaatacgccctcaagatggtgtgcactgaaaaacctgggaatacactgaccataaaggtctgcaacactaaaattgaggcgagcatggctttggtggatgccaagcccatcatcgaactggcaccagttgaccagacagcctatattcgcgagaaggatgaacgatgtaaaacctggatgtgccgggtgcgtgacgagggattacaggtcatcctcgagccttttaagaatctgttcggctcatacattggtatattttacacgttcatcatttccatcatggcacttctggtaatcatttatgtgttgctccccatatgttttaaactgagagacactctaaggaagcatgaagatgcttacaaacgcgagatgaagatccggtga

SEQ ID NO: 11027 - RNA, 4326 nt, synthetic construct
  misc_feature 1..4326: note = derived and/or modified CDS sequence (opt3) from LACV(LACV/00/WV-M (WV00-3178))__GU206148.1__GP
  source 1..4326: mol_type = other RNA
atgatcaggattctggtgctcatagccatcaccgctgcaagccccgtctaccagagatgcttccaagacggcgccattgttaagcagaacccttccaaagaggcggtgacagaagtatgtcttaaggatgacgtgtctatgatcaaaactgaggctcggtatgtccgcaatgccacgggggtgttttcaaacaatgttgcaattcgaaagtggctggtgagtgattggcacgactgccgtccaaagaagatcataggaggtcatatcaacgtcattgaagtgggcgatgacttgagcttacacaccgagtcctacgtatgttcttcggattgcacaatcggggttgacaaggaaactgcccaggtgagactgcagaccgatacaaccaatcatttcgagattgctggaactacagtcaaatcaggctggtttaagagcaccacgtatatcactctagaccaaacctgtgagcacctcaaagtgagttgcggtccgaagtccgtgcagttccatgcatgttttaaccagcacatgtcttgcgtcaggttcctgcaccggacaatacttcccgggagcattgccaattccatctgtcagaacattgaaatcatcattctggttactttgaccctcctgatatttatcctgctctcaattttaagtaaaacatacatctgctatctgcttatgcctatattcattccaatcgcttacatctatggaattatctacaataagagctgtaagaaatgcaagttgtgcggcctggtgtaccatccctttaccgagtgtggcacgcactgcgtatgtggggcccgctatgatacttctgacagaatgaaactacatagggcgtccggactctgccctggttacaagtcactgcgggcagcccgcgtgatgtgtaaaagcaagggcccagctagtattctttctataatcacagccgtcctggtgttgaccttcgttactcccattaactccatggtgctcggggaaagcaaagagacatttgagctggaagagttacctgatgacatgctggaaatggcatcgcgaatcaattcttattacctgacctgcatccttaactatgctgtctcctggggactggtgattataggcttgctaacgggtctcctcttcaagaagtaccaacacagatttctgaatacctatgccatgtactgtgaggaatgcgacatgtaccacgataaatcagggcttaagaggcatggagacttcacaaacaaatgtcggcagtgcacttgtggccagtatgaggatgcggccggcctgatgacccaccgtaagacatacaattgcttggtacagtataaagcaaagtggatgatgaacttcctcatcatttacatctttctgattttaatcaaggacagtgctataatcgttcaagccgctgggactgatttcaccacatgcctggagaccgaaagcattaactggaattgtactggaccatttctaaacctcggtaattgccagaaacagcaaaagaaagagccgtatacgaacatcgccacacagctgaagggccttaaagcaatttccgtgttggacatccccataattaccgggatccctgatgacattgccggagctctgcgctacatcgaagagagagaagatttccatgtccagctcactaccgagtatgcgatgctgtctaggtactgtgactactatacacagtttagcgataattcacggtacagtcaaaccacttggcgagtgtatcttcgctcccacgacttcgaggcatgcatactgtacccaaaccagcatttttgtagatgcgtcaagaatggcgaaaagtgtagttcttcaaactgggacttcgccaatgagatgaaagattattacagtggtaagcagacaaaatttgacaaggatttgaacctcgctctgacggccttacaccacgcattcagggggaccagctccgcctatatcgctactatgctgtctaaaaagtcgaatgacgatctaattacatacaccaacaagatcaaaacaaagtttcccggcaatgccctcctgaaagcaattatcgactacatagcgtatatgaaaagccttcctggaatggctaacttcaaatacgatgaattttgggacgagttgctgtataagccaaatcccgccaaaacttccaacctcgcacggggcaaggaatcaacctacaacttcaagctggccattagttctaaaagcatcaagacgtgcaaaaatgtgaaggatgttgcttgtttatccccgcgctcaggggccatctatgcaagcattatcgcttgcggagagcctaacggtccctctgtgtacagaaaaccatccggcggggtattccagagtagcaccgacaggtctatttattgtctgcttgattcccattgcttggaggaatttgaggccatatcacaagaggaactcgacgcggtcaagaagagtaaatgctgggagacagaataccctgaggtgaagcccctgcaggaaagcgatggaactaaatcgtgtcgtatgaaggactccggcaattgcaacgttgccaccaatcggtggccagtgatccagtgtgagaacgacaaattctactattctgaactacagaaggattacgacaagacacaagatattggtcactattgcctgagccccgggtgtactaccgtccgataccctatcaatccaaaacatatttcaaactgcaattggcaagtgagtagatcctctatcgctaagatagacgtacacaacatcgaggatattgagcagtataaaaaggcaatcacgcagaaactccaaacaagcctgtccctttttaagtacgccaagaccaaaaatttgccgcacattaagcccatctataaatacataactattgaaggcacagagaccgctgaaggaatcgagtcagcctacatcgaaagcgaggtgcctgcactggcgggcactagcattgggttcaagataaactctaaagagggaaagcatttactcgacgttatcgcctatgtcaaatccgctagctactcgtcagtgtatgccaagctgtactctaccggtccaacaagtggcattaatacgaagcacgatgaactttgtaccgggccctgccctgcaaacatcaatcatcagattggatggctgacttttgctaaagagaggacatccagctggggctgtgaagagttcggttgcttggccgtgtctgacgggtgtgtctttggcagctgccaggatatcataaaggaggaactctccgtttatcgcaaagagaccgaagaggtgacagacgtggaactgtgcctaactttctcagataagacctactgtacgaacctgaacccagtaacacccatcattaccgacctctttgaggtccaattcaaaactgtggagacctatagtctgccgcggatcgttgcagtgcagaatcacgaaattaagatcggacagataaacgatcttggcgtctacagcaaggggtgcggaaatgtgcagaaagttaacggcacagtgtacggtaatggggtacctagatttgactatttgtgtcatctggcctctaggaaggaggtcattgtgcgcaaatgcttcgacaacgattaccaggcttgtaagtttttacagtccccagcgtcatatcgactcgaagaggacagtggaactgtgaccatcatcgattacaaaaagattctgggcacaatcaagatgaaagccatacttggtgacgtcaagtataaaacgttcgcagaaagcgttgatattaccgctgagggctcctgcactgggtgtatcaattgcttcgagaacattcactgtgaactgacactacacaccactatcgaggcctcttgccccataaagtcgagctgtacagtgtttcatgaccggattctcgtaacccctaatgaacacaaatacgccctgaagatggtgtgcacggagcgtcccggaaacactttgaccatcaaggtctgcaatacaaaaatcgaggcttcaatgaccctggtggatgcaaagccaattatcgaattagcccctgttgaccagactgcgtatattagagagaaagatgaaaggtgtaagacatggatgtgccgcgtgcgggacgagggcctccaggtcatactggaacccttcaaaaacctttttgggtcctacatcggaattttctacacctttatcatcagtattgtggctctgttggttataatctatgtgctcctgccaatttgtttcaagctaagagatacactgaggaagcatgaggacgcctacaaacgagaaatgaagatccgctga

SEQ ID NO: 11028 - RNA, 4326 nt, synthetic construct
  misc_feature 1..4326: note = derived and/or modified CDS sequence (opt3) from LACV(LACV/03/NY-M (41030016))__GU206130.1__GP
  source 1..4326: mol_type = other RNA
atgatctacattctggtgctcatagccgtcaccgctgcaagccccgtttatcagagatgcttccaagacggcgccatcgtgaagcagaacccttccaaagaggcggtaacagaagtgtgtcttaaggatgacgtctctatgattaaaactgaggctaggtacatccggaatgccacgggggtgttttcaaacaatgttgcaattcgcaagtggctggtgagtgattggcacgactgccgaccgaaaaagatcgtcggaggtcatataaacgtgatcgaagtaggcgatgacttgagcttacacaccgagtcctatgtttgttctgccgattgcacaattggggtggacaaggaaactgctcaggtccgtctgcagaccgatacaaccaatcatttcgagatcgcaggaactacagtgaaatcgggctggtttaagtcaaccacgtacattactctagaccaaacctgtgagcacctcaaagtgagctgcggtccaaagagtatccagttccatgcctgttttaaccagcacatgtcctgcgtcagattcctgcacaggacaatacttcccgggtctattgctaatagcatctgtcagaacattgaaatcatcattctggttactttgaccctcctgatatttatcctgctctccattttatcaaaaacatatatctgctacctgcttatgcctgtgttcataccaattgcctatgtatacggaatcatctacaataagagttgtaagaaatgcaagttgtgcggcctggtgtatcatccctttaccgagtgtggcacgcactgcgtctgtggggcgcggtacgatactagcgaccgcatgaaactacatagagcatctggactctgccctggttataagtccctgagggccgctcgggtgatgtgtaaatcaaagggcccagccagcattcttagtatcattacagcagttctggtgttgaccttcgtcactcccataaactctatggtgctcggggaatccaaagaggtatttgagctggaagagttacctgatgacatgctggaaatggctctccgcatcaatttctactattttacatgcattcttaactacgccgttagctggtcgctggtgatcatcggattgctaaccggcctcctgttcaagcgatatcaacacaagttcctgaatatttacgcgatgtactgtgaggaatgcgacatgtatcacgataaatctggtcttaagagacatggggactttacgaacaaatgtaggcagtgcacctgtggacagtacgaggatgccacaggcctgatgactcaccggaagacctataattgcttggtccagtacaaagcaaagtggataatgaacttcctcatcatttatatctttctggtgttaattaaggactccgctatcatagtccaagccgctggcacagatttctcaagttgcctggagactgaaagcatcaactggaattgtaccgggccatttctaaacctcggaaattgccagaaacagcaaaagaaagagccgtacacaaacattgccgcacagctgaagggtcttcgtgccatctccgtgttggacattcccatgatcaccgaaatacctgatgacattgcttctgcgctgcgctatatcgaggaaagagaggcattccatgttcagctcactgccgagtacgctatgctgacgaggtactgtgattattacacacagtttagcgacaattcaggctatagtcaaaccacttggcgggtgtaccttcgatcccacgatttcgaagcctgcattatgtatccaaaccagcatttttgtcgctgcgtcaaaaatggggagaagtgttctagctcaaactgggacttcgcaaatgaaatgaaggactactatagtggaaaacaggccaagtttgataaagacctgaacttggctctcaccgccctgcaccacgcattcagaggcacaagctccgcgtacatcgctgccatgttatctaagaaatcgaatgatgacctgataacctacactaacaagatcaagacaaaatttcccggtaatgcactactcaaggccattatcgattatattgcttacatgaaagggctgcctggcatggccagcttcaagcatgacgagttctgggatgaacttttgtataaaccaacgcccaccaaggcaccgaacctggctaggggacgggagtcctcatacaattttaaactcgccatcagttctaagagcataaagacttgcaaaaacgtaaaggacgtggcgtgtctgtcccctcgctcaggcgccatttatgctagcatcatcgcatgcggggagcccaacggaccatctgtttacagaaaaccttccaatggtgtgttccagagtagcacagatcaatctatgtattgtttactggactcccactgccttgaagagtttgaagccatttcacaggaggagttggatgctgtcaagaaaagtaagtgctgggaaatcgagtaccccgacattaagccactccaggaaagcgatggcaccaaatcgtgtaggatgaaggactccgggaactgcaatgtggccacaaaccgttggcccgtaatacagtgtgagaatgacaaattctactattctgaactgcaaaaggattacgacaaaactcaggatatcggacattattgcctaagccctggctgtaccacggtgcggtacccaattaacccgaagcacatctcaaattgcaactggcaggttagtcgatcctctattgcaaagatcgacgtccacaatatagaggatatcgagcagtataaaaaggcgattacccaaaaactgcagacaagcctctccctgtttaagtacgccaaaactaagaaccttccccatatcaagcctatttataaatacatcaccatagaaggtacagagactgctgaagggattgagtcagcctacatcgaaagcgaggtgccagcattggctggcaccagtatcggattcaagattaattctaaagagggcaagcacctgttagacgtgatagcctatgtcaaatccgcaagctactcgtcagtttatacgaagctctactctacagggcccaccagtggaatcaacactaaacatgatgaactgtgtacaggtccttgcccagccaatattaaccaccaggtgggctggcttacctttgctaaggagagaacttccagctgggggtgtgaagagttcggatgcctggcggtgtctgacggctgtgtatttggtagctgccaagatatcattaaggaagagttgtccgtctataggaaagagaccgaagaggtgacagacgttgaactctgcctgacgttctcagataagacctactgtactaatctaaaccccgtgacaccgatcataaccgacctgtttgaggtccagttcaaaacagtggagacttatagtctccctcgcatcgttgccgtgcagaaccatgaaattaagatcgggcagattaatgatctgggcgtatacagcaaaggatgcggcaacgtccaaaaggtgaatgggaccgtgtacggaaacggcgtcccacggtttgactatctttgtcacttggcatctagaaaggaggttatcgtgaggaaatgcttcgacaatgattaccaggcttgtaagttcctgcagtcccccgcctcatatcgcttagaagaggacagtggtacggtaacagtgatagattacaaaaagattctcgggaccatcaaaatgaaggccatcctgggagacgtcaagtataaaacttttgctgataacgtggacattaccgcagaaggcagctgcacaggttgtatcaattgcttcgagaacatacactgtgagcttactctgcataccacaattgaagcctcctgccctatcaagtcttcgtgtacggtttttcacgatcggattctagtgacccccaatgagcataaatacgcgctcaaggtcgtgtgcactgaaaaaccaggcaacacactgaccatcaaggtttgcaatactaagatagaggctagcatggccttggtggacgcaaaacctattatcgaactggcccccgtcgatcagacagcttatatccgagagaaggacgagcgttgtaaaacctggatgtgcagagtaagggatgaagggttacaagtgattctcgagccattcaagaacctgtttggatcatacatcggcattttctacacgtttataatctccattgttgcacttctggtgatcatctatattttgctcccgatatgtttcaaactgcgcgacactctacggaagcacgaagacgcctacaagagagagatgaaaatcaggtga

SEQ ID NO: 11029 - RNA, 4326 nt, synthetic construct
  misc_feature 1..4326: note = derived and/or modified CDS sequence (opt3) from LACV(LACV/06/NY(1)-M (06MS2900303))__GU206118.1__GP
  source 1..4326: mol_type = other RNA
atgatctacattctggtgctcatagccgtcaccgctgcaagccccgtttatcagagatgcttccaagacggcgccatcgtgaagcagaacccttccaaagaggcggtaacagaagtgtgtcttaaggatgacgtctctatgattaaaactgaggctaggtacatccggaatgccacgggggtgttttcaaacaatgttgcaattcgcaagtggctggtgagtgattggcacgactgccgaccgaaaaagatcgtcggaggtcatataaacgtgatcgaagtaggcgatgacttgagcttacacaccgagtcctatgtttgttctgccgattgcacaattggggtggacaaggaaactgctcaggtccgtctgcagaccgatacaaccaatcatttcgagatcgcaggaactacagtgaaatcgggctggtttaagtcaaccacgtacattactctagaccaaacctgtgagcacctcaaagtgagctgcggtccaaagagtatccagttccatgcctgttttaaccagcacatgtcctgcgtcagattcctgcacaggacaatacttcccgggtctattgctaatagcatctgtcagaacattgaaatcatcattctggttactttggccctcctgatatttatcctgctctccattttatcaaaaacctatatctgctacctgcttatgcctgtgttcataccaattgcgtatgtatacggagtgatctacaataagagttgtaagaaatgcaagttgtgcggcctggtctatcatccctttacagagtgtggcacccactgcgtgtgtggggcacggtacgatacgagcgaccgcatgaaactacatagagcctctggactctgccctggttataagtccctgagggctgcccgggttatgtgtaaatcaaagggcccagcaagcatccttagtattatcactgctgtgctggtcttgacattcgtgacccccattaactctatggtactcggggaatccaaagaggtttttgagctggaagagttacctgatgacatgctggaaatggccctccgcataaatttctactattttacttgcatccttaactacgcggtgagctggtcgctggtcattatcggattgctaacaggcctcctgttcaagcgatatcaacacaagttcctgaatatctacgccatgtactgtgaggaatgcgacatgtatcacgataaatctggtcttaagagacatggggactttaccaacaaatgtaggcagtgcacgtgtggacagtacgaggatgcaaccggcctgatgacacaccggaagacttataattgcttggtgcagtacaaagctaagtggattatgaacttcctcataatctatatttttctggtcttaatcaaggactccgccattatcgtgcaagctgccggcaccgatttctcaagttgcctggagacagaaagcataaactggaattgtactgggccatttctaaacctcggaaattgccagaaacagcaaaagaaagagccgtacgcaaacatcgccgctcagctgaagggtcttaaagcgatttccgttttggacatccccatgattaccgaaatccctgatgacatagcatctgccctgcgttatattgaggaacgcgaggctttccatgtgcagctcacagccgagtacgcaatgctgaccagatactgtgattattacactcagtttagcgacaattcaggctatagtcaaacgacatggagggtataccttcggtcccacgatttcgaagcctgcatcatgtatccaaaccagcatttttgtcgatgcgtcaagaatggggagaagtgttctagctcaaactgggacttcgctaatggaatgaaagactactatagtggcaagcaggccaaatttgataaggacctgaacttggcactcaccgcgctgcaccacgctttccgcggtactagctccgcctacattgcaaccatgttatctaaaaagtcgaatgatgacctgatcgcctacacaaacaagataaaaaccaagtttcccgggaatgctctactcaaagccatcattgattatatcgcatacatgaagggcctgcctggaatggctaacttcaaacatgacgagttctgggatgagcttttgtataagccaactcccacaaaagccccgaatctggcgagaggcagggaaagctcctacaactttaagctcgccatttcaagtaagtctatcaaaacgtgcaagaacgtgaaagacgttgcttgtctgagccctcggtccggggcaatatatgcctcaattatcgcttgcggagagcccaatggtccaagcgtgtaccgcaagcctttaaacggcgtcttccagtcttccaccgatcaaagtatgtattgtctgcttgacagccactgcttggaggaatttgaggccatctctcaggaagaactcgatgcagtgaaaaagtccaagtgctgggagattgaatactcagacatcaaacccctgcaggagagtgatgggactaagagctgtagaatgaaagactcgggaaattgcaacgtagcgacaaataggtggccagtgattcagtgtgaaaacgacaagttctactattccgagctacaaaaagattacgacaagacccaggatataggccattattgcctgtctcccggttgtacaactgttcgttaccctatcaatccaaagcacattagcaactgcaattggcaggtctcacggagttccatcgccaaaattgacgtgcacaacatcgaagatatagagcagtataagaaagctatcacccaaaagctccagacgtctctgagcctttttaaatacgccaagaccaagaatttgccgcatattaaacccatctataagtacattacaatcgaggggactgaaaccgcagagggcatagaatccgcttacattgagtcagaagtgcctgccctggcaggaacaagcatcggcttcaaaatcaacagtaaggaggggaaacacttactcgacgtcattgcctatgttaagtctgcttcctacagctcggtgtatactaaactgtactcaaccggaccaacgtctggtataaatacaaagcatgatgagctttgtaccggcccctgccctgcgaacatcaatcaccaggtggggtggctgacttttgccaaggaacgaacaagttcctggggatgtgaggagttcggctgcttggcagtaagcgacggttgtgtctttgggtcttgccaagatattatcaaagaagaactcagcgtgtatagaaaggagaccgaggaagttactgacgtggagctgtgcctaaccttctccgataaaacatactgtacgaacctgaacccagtcacccccattatcactgacctctttgaagtgcagttcaagacagttgagacctattcactgccgaggatagtggctgtacagaatcatgagatcaaaattggccagatcaacgatcttggagtctacagtaagggctgcgggaatgtgcaaaaggtgaacggaacagtctacggcaatggtgttcctcgctttgactatttgtgtcacctggccagccggaaagaagtgattgtaagaaagtgcttcgacaacgattaccaggcctgtaaattcttacagtctccagcttcctataggctcgaggaagactcagggactgtgaccgtcatcgattacaagaaaatactgggaacgattaagatgaaggcaatccttggcgacgtgaaatataagacatttgccgataatgttgacatcaccgcggagggtagttgcactggctgtattaactgcttcgaaaatatccactgtgagctgaccctacatacaactatagaggctagctgccccattaaatcctcttgtaccgtgtttcacgatcgcatcctcgtcacacctaacgaacataagtacgccctgaaagtggtttgcacggagaagcccgggaataccttgactattaaggtgtgcaacacaaaaatcgaagcatcgatggccctggtcgacgctaagccaataattgagttagcacctgtagatcagaccgcctatatccgagaaaaagacgagcggtgtaagacttggatgtgccgtgtgagagatgagggactccaagttatcctggaacccttcaaaaatctttttggcagctacattgggatcttctacacatttattatatcaatcgtgaccctgttggtcattatctatatcctcctgccaatttgtttcaaggtgagggacacgctacgcaagcacgaggacgcgtacaaacgggaaatgaagataagatga

SEQ ID NO: 11030 - RNA, 4326 nt, synthetic construct
  misc_feature 1..4326: note = derived and/or modified CDS sequence (opt3) from LACV(LACV/06/NY(2)-M (06MS350140))__GU206109.1__GP
  source 1..4326: mol_type = other RNA
atgatctacattctggtgctcatagccgtcaccgctgcaagccccgtttatcagagatgcttccaagacggcgccatcgtgaagcagaacccttccaaagaggcggtaacagaagtgtgtcttaaggatgacgtctctatgattaaaactgaggctaggtacatccggaatgccacgggggtgttttcaaacaatgttgcaattcgcaagtggctggtgagtgattggcacgactgccgaccgaaaaagatcgtcggaggtcatataaacgtgatcgaagtaggcgatgacttgagcttacacaccgagtcctatgtttgttctgccgattgcacaattggggtggacaaggaaactgctcaggtccgtctgcagaccgatacaaccaatcatttcgagatcgcaggaactacagtgaaatcgggctggtttaagtcaaccacgtacattactctagaccaaacctgtgagcacctcaaagtgagctgcggtccaaagagtatccagttccatgcctgttttaaccagcacatgtcctgcgtcagattcctgcacaggacaatacttcccgggtctattgctaatagcatctgtcagaacattgaaatcatcattctggttactttggccctcctgatatttatcctgctctccattttatcaaaaacctatatctgctacctgcttatgcctgtgttcataccaattgcgtatgtatacggagtgatctacaataagagttgtaagaaatgcaagttgtgcggcctggtctatcatccctttacagagtgtggcacccactgcgtgtgtggggcacggtacgatacgagcgaccgcatgaaactacatagagcctctggactctgccctggttataagtccctgagggctgcccgggttatgtgtaaatcaaagggcccagcaagcatccttagtattatcactgctgtgctggtcttgacattcgtgacccccattaactctatggtactcggggaatccaaagaggtttttgagctggaagagttacctgatgacatgctggaaatggccctccgcataaatttctactattttacttgcatccttaactacgcggtgagctggtcgctggtcattatcggattgctaacaggcctcctgttcaagcgatatcaacacaagttcctgaatatctacgccatgtactgtgaggaatgcgacatgtatcacgataaatctggtcttaagagacatggggactttaccaacaaatgtaggcagtgcacgtgtggacagtacgaggatgcaaccggcctgatgacacaccggaagacttataattgcttggtgcagtacaaagctaagtggattatgaacttcctcataatctatatttttctggtcttaatcaaggactccgccattatcgtgcaagctgccggcaccgatttctcaagttgcctggagacagaaagcataaactggaattgtactgggccatttctaaacctcggaaattgccagaaacagcaaaagaaagagccgtacgcaaacatcgccgctcagctgaagggtcttaaagcgatttccgttttggacatccccatgattaccgaaatccctgatgacatagcatctgccctgcgttatattgaggaacgcgaggctttccatgtgcagctcacagccgagtacgcaatgctgaccagatactgtgattattacactcagtttagcgacaattcaggctatagtcaaacgacatggagggtataccttcggtcccacgatttcgaagcctgcatcatgtatccaaaccagcatttttgtcgatgcgtcaagaatggggagaagtgttctagctcaaactgggacttcgctaatgaaatgaaagactactatagtggaaagcaggccaaatttgataaggacctgaacttggcactcaccgcgctgcaccacgctttccgcggcactagctccgcctacattgcaaccatgttatctaaaaagtcgaatgatgacctgatcgcctacacaaacaagataaaaaccaagtttcccggtaatgctctactcaaagccatcattgattatatcgcatacatgaaggggctgcctggcatggctaacttcaaacatgacgagttctgggatgaacttttgtataagccaactcccacaaaagccccgaatctggcgagaggaagggagagctcctacaactttaagctcgccatttcaagtaagtctatcaaaacgtgcaagaacgtgaaagacgttgcttgtctgagccctcggtccggcgcaatatatgcctcaattatcgcttgcggggagcccaatggaccaagcgtgtaccgcaagcctttaaacggtgtcttccagtcttccaccgatcaaagtatgtattgtctgcttgacagccactgcttggaagagtttgaagccatctctcaggaggagctcgatgcagtgaaaaagtccaagtgctgggaaattgagtaccccgacatcaaaccactgcaggaatcagatggcactaagagttgtagaatgaaagacagcgggaattgcaacgtagcgacaaataggtggcccgtgattcagtgtgagaacgacaagttctactattcggaactacaaaaagattacgacaagacccaggatataggacattattgcctgtcccctggctgtacaactgttcgttacccaatcaatccgaagcacatttctaactgcaattggcaggtcagccggtcaagtatcgccaaaattgacgtgcacaacatcgaggatatagagcagtataagaaagctatcacccaaaagctccagacgtccctgtctctttttaaatacgccaagaccaagaatttgccccatattaaacctatctataagtacattacaatcgaaggtactgagaccgcagaagggatagagagcgcttacattgaatccgaggtgccagccctggcaggcacatcaatcggattcaaaatcaacagcaaggagggcaaacacttactcgacgtcattgcctatgttaagagtgcttcttactccagcgtgtatactaaactgtactcgaccgggcccacgtcaggaataaatacaaagcatgatgaactttgtaccggtccttgcccagcgaacatcaatcaccaggtgggctggctgacttttgccaaggagcgaacatctagttgggggtgtgaagagttcggatgcttggcagtatccgacggctgtgtctttggtagctgccaagatattatcaaagaggaactctctgtgtatagaaaggagaccgaagaggttactgacgtggaactgtgcctaaccttcagcgataaaacatactgtacgaacctgaaccccgtcaccccgattatcactgacctctttgaggtgcagttcaagacagttgagacctattccctgcctaggatagtggctgtacagaatcatgaaatcaaaattgggcagatcaacgatcttggcgtctactcaaagggatgcggcaatgtgcaaaaggtgaacgggacagtctacggaaatggcgttccacgctttgactatttgtgtcacctggccagtcggaaagaggtgattgtaagaaagtgcttcgacaacgattaccaggcctgtaaattcttacagagccccgcttcttataggctcgaagaggactccggtactgtgaccgtcatcgattacaagaaaatactggggacgattaagatgaaggcaatccttggagacgtgaaatataagacatttgccgataatgttgacatcaccgcggaaggctcatgcactggttgtattaactgcttcgagaatatccactgtgagctgaccctacatacaactatagaagctagttgccctattaaaagctcctgtaccgtgtttcacgatcgcatcctcgtcacacccaacgagcataagtacgccctgaaagtggtttgcacggaaaagccaggcaataccttgactattaaggtgtgcaacacaaaaatcgaggcatctatggccctggtcgacgctaagcctataattgaattagcacccgtagatcagaccgcctatatccgagagaaagacgagcggtgtaagacttggatgtgccgtgtgagagatgaagggctccaagttatcctggagccattcaaaaatctttttggatcgtacattggcatcttctacacatttattataagcatcgtgaccctgttggtcattatctatatcctcctgccgatttgtttcaagctaagggacacgctgcgcaagcacgaagacgcgtacaaacgggagatgaagataagatga

SEQ ID NO: 11031 - RNA, 4326 nt, synthetic construct
  misc_feature 1..4326: note = derived and/or modified CDS sequence (opt3) from LACV(LACV/06/NY(3)-M (06MS270036))__GU206121.1__GP
  source 1..4326: mol_type = other RNA
atgatctacattctggtgctcatagccgtcaccgctgcaagccccgtttatcagagatgcttccaagacggcgccatcgtgaagcagaacccttccaaagaggcggtaacagaagtgtgtcttaaggatgacgtctctatgattaaaactgaggctaggtacatccggaatgccacgggggtgttttcaaacaatgttgcaattcgcaagtggctggtgagtgattggcacgactgccgaccgaaaaagatcgtcggaggtcatataaacgtgatcgaagtaggcgatgacttgagcttacacaccgagtcctatgtttgttctgccgattgcacaattggggtggacaaggaaactgctcaggtccgtctgcagaccgatacaaccaatcatttcgagatcgcaggaactacagtgaaatcgggctggtttaagtcaaccacgtacattactctagaccaaacctgtgagcacctcaaagtgagctgcggtccaaagagtatccagttccatgcctgttttaaccagcacatgtcctgcgtcagattcctgcacaggacaatacttcccgggtctattgctaatagcatctgtcagaacattgaaatcatcattctggttactttggccctcctgatatttatcctgctctccattttatcaaaaacctatatctgctacctgcttatgcctgtgttcataccaattgcgtatgtatacggagtgatctacaataagagttgtaagaaatgcaagttgtgcggcctggtctatcatccctttacagagtgtggcacccactgcgtgtgtggggcacggtacgatacgagcgaccgcatgaaactacatagagcctctggactctgccctggttataagtccctgagggctgcccgggttatgtgtaaatcaaagggcccagcaagcatccttagtattatcactgctgtgctggtcttgacattcgtgacccccattaactctatggtactcggggaatccaaagaggtttttgagctggaagagttacctgatgacatgctggaaatggccctccgcataaatttctactattttacttgcatccttaactacgcggtgagctggtcgctggtcattatcggattgctaacaggcctcctgttcaagcgatatcaacacaagttcctgaatatctacgccatgtactgtgaggaatgcgacatgtatcacgataaatctggtcttaagagacatggggactttaccaacaaatgtaggcagtgcacgtgtggacagtacgaggatgcaaccggcctgatgacacaccggaagacttataattgcttggtgcagtacaaagctaagtggattatgaacttcctcataatctatatttttctggtcttaatcaaggactccgccattatcgtgcaagctgccggcaccgatttctcaagttgcctggagacagaaagcataaactggaattgtactgggccatttctaaacctcggaaattgccagaaacagcaaaagaaagagccgtacgcaaacatcgccgctcagctgaagggtcttaaagcgatttccgttttggacatccccatgattaccgaaatccctgatgacatagcatctgccctgcgttatattgaggaacgcgaggctttccatgtgcagctcacagccgagtacgcaatgctgaccagatactgtgattattacactcagtttagcgacaattcaggctatagtcaaacgacatggagggtataccttcggtcccacgatttcgaagcctgcatcatgtatccaaaccagcatttttgtcgatgcgtcaagaatggggagaagtgttctagctcaaactgggacttcgctaatggaatgaaagactactatagtggcaagcaggccaaatttgataaggacctgaacttggcactcaccgcgctgcaccacgctttccgcggtactagctccgcctacattgcaaccatgttatctaaaaagtcgaatgatgacctgatcgcctacacaaacaagataaaaaccaagtttcccgggaatgctctactcaaagccatcattgattatatcgcatacatgaagggcctgcctggaatggctaacttcaaacatgacgagttctgggatgagcttttgtataagccaactcccacaaaagccccgaatctggcgagaggcagggaaagctcctacaactttaagctcgccatttcaagtaagtctatcaaaacgtgcaagaacgtgaaagacgttgcttgtctgagccctcggtccggggcaatatatgcctcaattatcgcttgcggagagcccaatggtccaagcgtgtaccgcaagcctttaaacggcgtcttccagtcttccaccgatcaaagtatgtattgtctgcttgacagccactgcttggaggaatttgaggccatctctcaggaagaactcgatgcagtgaaaaagtccaagtgctgggagattgaatactcagacatcaaacccctgcaggagagtgatgggactaagagctgtagaatgaaagactcgggaaattgcaacgtagcgacaaataggtggccagtgattcagtgtgaaaacgacaagttctactattccgagctacaaaaagattacgacaagacccaggatataggccattattgcctgtctcccggttgtacaactgttcgttaccctatcaatccaaagcacattagcaactgcaattggcaggtctcacggagttccatcgccaaaattgacgtgcacaacatcgaagatatagagcagtataagaaagctatcacccaaaagctccagacgtctctgagcctttttaaatacgccaagaccaagaatttgccgcatattaaacccatctataagtacattacaatcgaggggactgaaaccgcagagggcatagaatccgcttacattgagtcagaagtgcctgccctggcaggaacaagcatcggcttcaaaatcaacagtaaggaggggaaacacttactcgacgtcattgcctatgttaagtctgcttcctacagctcggtgtatactaaactgtactcaaccggaccaacgtctggtataaatacaaagcatgatgagctttgtaccggcccctgccctgcgaacatcaatcaccaggtggggtggctgacttttgccaaggaacgaacaagttcctggggatgtgaggagttcggctgcttggcagtaagcgacggttgtgtctttgggtcttgccaagatattatcaaagaagaactcagcgtgtatagaaaggagaccgaggaagttactgacgtggagctgtgcctaaccttctccgataaaacatactgtacgaacctgaacccagtcacccccattatcactgacctctttgaagtgcagttcaagacagttgagacctattcactgccgaggatagtggctgtacagaatcatgagatcaaaattggccagatcaacgatcttggagtctacagtaagggctgcgggaatgtgcaaaaggtgaacggaacagtctacggcaatggtgttcctcgctttgactatttgtgtcacctggccagccggaaagaagtgattgtaagaaagtgcttcgacaacgattaccaggcctgtaaattcttacagtctccagcttcctataggctcgaggaagactcagggactgtgaccgtcatcgattacaagaaaatactgggaacgattaagatgaaggcaatccttggcgacgtgaaatataagacatttgccgataatgttgacatcaccgcggagggtagttgcactggctgtattaactgcttcgaaaatatccactgtgagctgaccctacatacaactatagaggctagctgccccattaaatcctcttgtaccgtgtttcacgatcgcatcctcgtcacacctaacgaacataagtacgccctgaaagtggtttgcacggagaagcccgggaataccttgactattaaggtgtgcaacacaaaaatcgaagcatcgatggccctggtcgacgctaagccaataattgagttagcacctgtagatcagaccgcctatatccgagaaaaagacgagcggtgtaagacttggatgtgccgtgtgagagatgagggactccaagttatcctggaacccttcaaaaatctttttggcagctacattgggatcttctacacatttattatatcaatcgtgaccctgttggtcattatctatatcctcctgccaatttgtttcaagctaagggacacgctgcgcaagcacgaggacgcgtacaaacgggaaatgaagataagatga

SEQ ID NO: 11032 - RNA, 4326 nt, synthetic construct
  misc_feature 1..4326: note = derived and/or modified CDS sequence (opt3) from LACV(LACV/65/OH-M (W17258))__GU206124.1__GP
  source 1..4326: mol_type = other RNA
atgatcaggattctggtgctcatagccgtcaccgctgcaaaccccgtttaccagagatgcttccaagacggcgccatcgtgaagcagaatcctagcaaagaggcggtaacagaagtgtgtcttaaggatgacgtctccatgattaaaactgaggctcggtatatccgcaacgccacgggggtgttttctaataacgttgcaattcgaaagtggctggtgtcagattggcacgactgccgtccgaaaaagatcataggaggtcatatcaatgtcattgaagtgggcgatgacttgagtttacacaccgagagctacgtatgttccgccgattgcacaatcggggttgacaaggaaactgctcaggtgagactgcagaccgatacaaccaaccatttcgagattgcaggaactacagtcaaatctggctggtttaagtcgaccacgtatatcactctagaccaaacctgtgagcacctcaaagtgtcatgcggtccaaagagcgtgcagttccatgcctgttttaatcagcacatgagttgcgtcaggttcctgcaccggacagttcttcccgggtccatagctaactctatttgtcagaatatcgaaattatcatcctggtgactttgaccctcctgatttttatactgctcagcatcttatccaaaacatacatttgctatctgcttatgcctatcttcataccaattgcctacgtatatggaatcatctacaacaagtcatgtaagaaatgcaagttgtgcggcctggtgtaccatccctttaccgagtgtggcacgcactgcgtctgtggggcgcgctatgatacaagtgacagaatgaaactacatagggcaagcggactctgccctggttacaagtctctgcgggccgctcgcgtgatgtgtaaatccaagggcccagcctcaattcttagcatcattactgcagttctggtgttgaccttcgtcactcccataaatagtatggtgctcggggaatctaaagagacatttgagctggaagagttacctgatgacatgctggaaatggcttcccgaatcgacagctattactttacctgcattctcaactatgccgtatcgtggggacttgttatcatcggcctgttgacgggtctactgttcaagaagtaccaacacagattcctcaatgtgtatgcgatgtactgtgaggaatgcgatatgtaccacgacaaatctgggctgaagaggcatggagatttcaccaacaaatgtcggcagtgcacatgtggccagtatgaggacgccactggccttatggcacaccgtaagacctacaattgcctggtccagtataaagctaagtggatgatgaactttttgattatatacatcttcctcattctgatcaaggattccgccattgtggtccaagctgccgggacagactttactacctgcttagagacagaaaacatcaattggaactgtaccggaccattcctgaatctaggtaactgccagaaacagcaaaagaaagagccgtatactaatatagcaacgcagctcaagggcctgaaagccatctcagtgcttgatattcccatcattacagggatccctgacgatatagctggagcgttgcgctacattgaagagaaggaagactttcatgttcagctgaccatcgagtatgcaatgctcagtaagtactgtgattactatactcagttcagcgacaactccggctactctcaaaccacatggagagtgtatctgaggagccacgactttgaggcctgcattctttacccaaatcagcatttctgtcggtgcgtcaaaaacggtgaaaagtgttcaagttccaattgggattttgctaacgagatgaaagacttctatagcgggaagcagaccaaatttgataaggacctgaatttggccctcactgcactgcaccacgccttccgaggcacatcttcagcttacatcgccacgatgttaagtaagaaaagcaacgatgacctgatagcatataccaataagatcaaaactaagtttcccggaaacgcgctactcaaagctattatcgattacattgcctacatgaagtccctgcctggcatggcaaatttcaaatatgacgagttctgggatgaacttttgtacaagccaaaccccgccaaggcttctaacctggcccgcgggaaagaatcgagctataattttaagctcgcaatctcctcaaaaagtataaagacatgcaaaaacgtaaaggacgtggcttgtctgtctccgagaagcggagccatttacgcgtccatcatcgcctgcggtgagcctaatggcccctcagtttataggaagccaagcgggggagtgttccagtcttccaccgatcggagtatttactgtttactggacagccattgccttgaggaatttgaggctatctctcaagaagagttggatgcagtcaaaaagtccaaatgctgggagattgaatatcctgacgtgaagcccctccaggagggcgacggtacaaaatcatgtcgcatgaaggatagtgggaactgcaatgtagccactaacagatggccagtgatacagtgtgaaaatgacaagttctactacagcgagctgcagaaagattatgacaagacccaagatatcggccactactgcctatcgcccggatgtacgaccgttaggtatcctattaacccaaaacatatctccaattgcaactggcaggtctctcgtagctcaattgctaagatcgacgtgcacaatatagaagatatcgagcagtacaaaaaggccattacacagaagctgcaaaccagtctctccctgtttaaatatgcaaagactaaaaaccttccgcacatcaagcccatttacaaatatatcacaatagagggcactgaaaccgcggaggggattgaatctgcctacatcgagagcgaagtgcctgctttggccggaacgtccatcggtttcaagattaattcaaaagagggcaagcatctgttagacgtcatagcatacgttaagagcgctagttattcttccgtgtacgccaaactctatagcacagggccaacctcgggaatcaacactaagcacgatgagctgtgtacaggcccctgccctgcaaatattaaccatcaggtgggttggcttacctttgcccgggaacgaacttcatcttgggggtgtgaggagttcggctgcctggctgtaagtgacggatgtgtctttggctcctgccaggatatcattaaagaagaattgagcgtgtacagaaaggagaccgaggaagttacagacgtggagctctgcctgacgttctctgataaaacctattgtactaacctaaatccagtcacacccatcataaccgacctgtttgaagtgcaattcaagacagttgagacttacagcctcccgaggatcgtggcggtacagaaccacgagattaagatcgggcagattaatgacctgggagtctattccaaaggctgcggtaacgtgcagaaggtgaatgggaccgtctacggaaacggcgttcctcgctttgattacctttgtcatttggcctcacggaaagaagtgatcgtaagaaagtgcttcgacaatgattatcaagcatgtaaattcctgcagagtccagctagctacaggttagaggaagactctggtacggtgacaataattgattataagaagatcctcggcaccatcaaaatgaaggccattctgggggacgtcaaatacaagacttttgccgattccgtggacatcaccgctgagggatcatgcacaggctgtataaactgcttcgaaaatattcactgtgagcttactctgcacaccacaatcgaggcaagttgccccattaaaagctcctgtacggtttttcatgatcgcatcctagtgacccctaacgaacacaagtatgccctcaagatggtctgcactgagaaacccgggaatacactgaccataaaggtgtgcaacactaaaattgaagcgtctatggctttggttgacgccaagccaatcatcgagctggcacctgtggatcagacagcctacattcgagaaaaagacgagcggtgtaagacctggatgtgccgtgtcagagacgagggattacaggtaatcctcgaacccttcaagaatctgtttggctcgtatattggtatattctacacgtttatcattagcatcgtggcacttctggttatcatttacgtgttgctcccaatatgtttcaaactgagggatactctacgcaagcatgaggacgcttataaacgggaaatgaagatcagatga

SEQ ID NO: 11033 - RNA, 4326 nt, synthetic construct
  misc_feature 1..4326: note = derived and/or modified CDS sequence (opt3) from LACV(LACV/67/NY-M (67-8109))__GU206115.1__GP
  source 1..4326: mol_type = other RNA
atgatctgcattctggtgctcataaccgtcgccgctgcaagccccgtttaccagagatgtttccaagacggcgccatcgtgaagcagaacccttccaaagaggcggtaacagaagtgtgccttaaggatgacgtctctatgattaaaactgaggctaggtatgtgcggaatgccacgggggtttttagtaacaatgtggcaatccgcaagtggctggtcagtgattggcacgactgtcgaccgaaaaagattgtgggaggtcatatcaacgtaatagaagttggcgatgacttgagcttacacaccgagtcctacgtgtgctctgccgattgtacaatcggggtcgacaaggaaactgctcaggtgcgtctgcagaccgatacaaccaatcatttcgagattgcaggaactacagtgaaatcgggctggtttaagtcaaccacgtatatcactctagaccaaacctgcgagcacctcaaagtcagctgtggtccaaagagtgttcagttccatgcctgctttaaccagcacatgtcctgtgtgagattcctgcacaggacaattcttcccgggtctatcgctaatagcatatgccagaacattgaaatcattatcctggtaactttgaccctcctgatctttattctgctctccatattatcaaaaacatacatctgttatctgcttatgcctattttcatcccaatagcctacatttatggaaccatctacaataagagttgcaagaaatgcaagttgtgtggcctggtgtaccatccctttacggagtgcggcactcactgtgtctgcggggcgcggtatgatacaagcgaccgcatgaaactacatagagcatctggactctgtcctggttacaagtccctgagggccgctcgggtgatgtgcaaatcaaagggcccagccagcatccttagtattatcaccgcagttctggtgttgactttcgtcacacccattaactctatggtgctcggggaatccaaagagacctttgagctggaagatttacctgacgacatgctggagatggctagccgcataaattcgtattacctcacgtgtatccttaactatgccgtatcttggggactggttattatcggcttgctaatcggtctcctgttcaagaagtaccaacaccgatttctgaatgtgtatgcgatgtactgcgaagagtgtgatatgtaccacgacaaatccgggcttaagagacatggagatttcaccaacaaatgcaggcagtgtacatgcggccagtatgaagacgccgcaggcctgatggctcaccggaagacttacaattgcttggtccagtataaagccaagtggatgatgaacttcctcattatatacatctttctgattttaatcaaggattcagctattgtggtccaagccgcagggaccgacttcacaacttgtctggagaccgagagtatcaactggaattgcacaggaccatttctaaacctcggtaattgtcagaaacagcaaaagaaagaaccgtataccaacatagccactcagctgaagggccttaaagctatcagcgtgttggatgttcccattatcacggggattcctgacgatatcgcgggagcactgcgttacatagaggaaaaggaggacttccatgtgcagctcacaattgaatatgccatgctgtccaagtactgcgattactatacccagttttctgacaatagcggctactcacaaactacctggcgcgtatatcttagaagtcacgacttcgaggcttgtatcctgtacccaaaccagcatttttgtaggtgcgtcaaaaatggtgagaagtgctccagctctaaccgggatttcgccaatgaaatgaaagactattactcagggaagcagacaaaatttgataaggacttgaacctcgcactgaccgccttacaccacgctttccgaggcacttcaagcgcctatattgcaacaatgctgtccaagaaatctaatgatgacctaatcgcgtacacgaacaagataaaaaccaagtttcccggaaatgctctcctgaaagccatcattgattacatcgcatatatgaagtcgcttcctggcatggccaacttcaaatacgacgagttttgggatgaattgctgtataagccaaatcccgctaaggccagcaacctcgcacgcgggaaagagtcctcatacaacttcaagctggctattagttctaaaagcatcaagacttgtaaaaatgtgaaggacgttgcctgcttatccccgagatcaggagcgatatatgccagcattatcgcttgtggtgaacctaacggcccctctgtgtacaggaagccatccgggggagtcttccagagtagcacagatcaatctatctattgcctgcttgactcccattgcttggaggagtttgaagcaattggccaggaggaactcgatgccgtgaaaaagtcaaaatgttgggagatcgagtaccctgacgtaaagctgattcaggaaggtgacgggaccaaaagttgccggatgaaggatagcggcaattgtaacgtggctacaaatcgctggcccgttatacagtgcgagaacgacaagttctactattcggaactacaaaaagattacgacaagactcaggatatcggacactattgtctgtccccaggctgcaccacggtcagataccccattaatcctaaacatatctctaactgtaattggcaagtgagcaggtcaagtattgccaagatcgacgtgcacaacatagaggatatcgaacagtataaaaaggcaattacccagaagctccagacatccctgtctctttttaaatacgcgaagactaaaaatttgccacacatcaagccgatttataaatacatcaccatagaggggacagagactgccgaaggaattgagagcgcttacatcgaatccgaggtccccgccctggcaggtacctcaatcggcttcaagattaacagcaaagaagggaagcatttactcgacgttatagcttatgtgaagagtgcctcttactccagcgtgtatacgaaactgtactcgacaggacctacctcaggcatcaatactaagcacgatgagctttgcacaggtccatgtcccgcaaacattaatcatcaggtagggtggctgacctttgcccgtgagcggacttctagttggggctgcgaagagttcggatgtttggctgtctccgacggctgcgtgtttgggagctgccaagatatcattaaagaggaactctctgtttatcgaaaggaaaccgaggaggtgacagacgtcgaactgtgtctaacgttcagcgataaaacctactgcactaacctgaaccctgtgacaccaatcataaccgacctctttgaggttcagttcaagacagtggaaacttattccctgcccagaatcgtagcggtccagaatcacgagattaagatcggacagattaacgaccttggcgtgtactcaaaaggttgtgggaatgtgcaaaaggtcaacggaaccatctacggcaatggtgttccgaggtttgattatttgtgccatctggccagtcgcaaagaggtgatagtacggaagtgtttcgacaacgattaccaggcatgcaaatttttacagagccctgcttcttatagactcgaagaggactccggcacggtgacaattatcgattacaagaagatcctggggaccattaaaatgaaggccatccttggagacgtcaaatataagactttcgccgattcagtggacataaccgctgaaggcagttgtacagggtgcattaattgtttcgagaacatccactgcgaactgactctacacaccacaattgaggcaagctgtccaatcaaatcctcttgcacggtttttcatgataggatactcgtgacccccaatgagcacaagtacgccctgaagatggtctgcactgaaaaacctggaaacacattgaccattaaggtgtgtaatactaaaatcgaggcgtcgatggctctggttgacgccaagcccatcattgaattagcaccagtggatcagacagcctatatccgcgagaaagacgaacgatgcaagacctggatgtgtcgggtccgtgacgagggcctccaagtaattctggagcctttcaagaacctttttggtagctacatagggatcttctacacgtttattatctcaatcgtggctctgttggttattatatatgtgctcctgcccatctgcttcaaactaagagatactctgaggaagcatgaagacgcatacaaacgcgagatgaagattcggtga

SEQ ID NO: 11034 - RNA, 4326 nt, synthetic construct
  misc_feature 1..4326: note = derived and/or modified CDS sequence (opt3) from LACV(LACV/74/NY-M (74-32813))__GU206142.1__GP
  source 1..4326: mol_type = other RNA
atgatcagaatgctggtgctcattgtcgttaccgccgctagccccgtgtaccagaggtgcttccaagacggcgcaatagtaaagcagaacccttccaaagaggccgtgacagaagtctgtcttaaggatgacgtgtctatgatcaaaactgaggcgcggtatgttaagaatgctacgggggtgttttcaaacaatgtcgccattcgcaaatggctggtgagtgattggcacgactgccgaccaaagaagatcgtaggaggtcatattaacgttatcgaagtgggcgatgacttgagcttacacaccgagtcctacgtctgttctgcagattgcacaataggggtggacaaagaaactgcccaggtgcgtctgcagaccgatacaaccaatcatttcgagatcgctggaactacagtcaagtcgggctggtttaaatcaaccacgtatattactctagaccaaacctgtgagcacctcaaggttagctgcggtccgaaaagtgtgcagttccatgcatgttttaaccagcacatgtcctgcgtaagattcctgcacaggacaatccttcccgggtctattgccaatagcatctgtcagaacatagaaattatcattctggtgactttgaccctcctgatctttatcctgctctccattttatcaaagacatacatatgctatctgcttatgcctatcttcattccaatcgcttacatgtatggagtcatatacaataagagttgtaaaaagtgcaaattgtgcggcctggtgtaccatccctttaccgagtgtggcacgcactgcgtttgtggggcccggtatgatactagcgaccgcatgaagctacatagagcgtctggactctgccctggttacaaatccctgagggcagcccgggtgatgtgtaagtcaaaaggcccagctagcattcttagtatcatcacagccgtcctggtgttgaccttcgtaactcccattaactctatggttctcggggaatccaaggagacatttgagctggaagagttacctgatgacatgctggaaatggcactccgcatcaatagctattactttacctgcattcttaactatgctgtgtcgtggggactgataatcgccggcttgctagtcggtctgatttttaagaaataccaacaccgattcctcaatatctatgcgatgtactgtgaggaatgcaacatgtaccacgacaagtctgggctgaaaagacatggagatttcacgaataagtgtaggcagtgcacctgtggccagtatgaggacgccacaggccttatcactcaccggaaaacctacaactgcctggtgcagtataaggcaaagtggatgatgaactttttgattatatacatcttcctcattctgatcaaagattccgctattgtcgtgcaagccacagggactgactttaccacatgcttagagaccgaatcaatcaattggaactgtactggaccattcctgaatctaggtaactgccagaagcagcagaaaaaggagccgtatacgaatatagctacacaactcaaaggcctgaaggccatcagtgttcttgatattcccatcattaccagcatccctgacgatatagcaggggccttgcgttacattgaagagaaggaagactttcatgtgcagctgactaccgagtatgctatgctctccaaatactgtgattactatacacagttctctgacaacagcggatactcacaaaccacttggcgcgtatatctgagaagtcacgattttgaggcgtgcatcctttacccaaatcagcatttctgtaagtgcgtcaaaaacggcgaaaagtgttccagctctaattgggactttgcaaacgagatgaaaaattattactcaggtaagcaggccaagttcgacaaagatctgaacttggctctcacagccctgcaccacgcatttagggggacgagtagcgcctatattgctgccatgttatccaagaaatctaatgacgatctgatcgcatacaccaacaagataaaagcgaagttccccggcaatgctctactcaaagccatcattgactacatcgcatatatgaagggactgcctgaaatggccaactttaagtacgatgagttctgggacgaacttttgtataaaccaaaccccgctaaggcctcgaatctggcacggggcaaagagagctcctacaacttcaagctcgctatttcaagtaaatctatcaagacttgcaagaatgtgaaagatgttgcctgtctgagcccgcgatccggggcgatatattcaagcattatcgcctgcggagagcctaacggtccctctgtgtaccgcaagccatccggcggggtctttcagagtagcacagacagatctatctattgtttactggattcccattgccttgaagagttcgaagctatttcacaagaggagttggacgcagtgaaaaagagtaaatgctgggaaatcgagtaccctgatgtaaggcccctccaggaaagcgacggagccaagtcgtgtcggatgaaggattccggcaattgcaacgtggctaccaatcgctggccagttatgcagtgtgagaacgacaaattttactattctgaactgcagaaggactacgataaaacacaagacattggtcactattgcctaagccccgggtgtactaccataagataccctatcaatccaaagcatatttcaaactgcaattggcaggtcagtaggtcctctatcgccaaaattgatgtgcacaacgtggaggacatcgagcagtataagaaggcaataacgcagaaactgcaaaccagcctctccctgttcaagtacgcgaaaacaaagaatcttccgcacatcaaacccatttataagtacatcactattgaaggcaccgagacagccgaaggaatcgagtcagcttacatagaaagcgaggtccctgccttggcaggcaccagtgttgggtttaaaattaactctaaggagggaaagcatctgttagatgtgatcgcttatgtgaaatccgccagctactcgtcagtatatgcaaagctctactctactggtccaacgagtggcatcaatacaaaacacgacgaactgtgtaccgggccctgccctgccaacattaaccatcaggtcggatggcttactttcgctcgtgagcggacatccagctggggctgtgaagagtttggttgcctggcggtgtctgatgggtgtgttttcggcagctgccaggacataatcaaggaagagttgtccgtgtatcgaaaagagaccgaagaggtcactaatgtggaactctgcctgaccttttcagataagacatactgtacgaacctaaatccagttacccccattatcactgacctgttcgaggtgcaatttaagacagtagagacctatagtctcccgagaattgtcgccgtgcagaaccacgaaatcaaaataggacagatcaatgatctgggcgtgtacagcaaggggtgcggaaacgtccagaaagttaatggcacagtgtacggtaacggggtacctaggttcgactatctttgtcatttggcatctcgcaaggaggtgattgtccggaaatgctttgataatgactaccaggcttgtaagttcctgcaatccccagcctcatatagattagaagaggacagtggaactgtgaccatcattgattacaagaaaatcctcggcacgataaagatgaaagccattctgggtgacgttaagtataaaacattcgctgatagcgtggacatcaccgcagaaggctcctgcgccgggtgtatcaactgctttgagaatattcactgtgagcttactctgcacaccacaatcgaagcgtcttgccccataaagtcgagctgtactgtcttccatgataggattctagtgacccctaacgagcacaagtacgctctcaaaatggtttgcacagaaaagcccggaaatacgctgaccatcaaagtgtgcaacactcgcattgaggcctcaatggcattggtcgacgccaagccaatcatagaactggctcctgtagatcagacagcatatattcgagagaaagacgagcggtgtaagacctggatgtgccgtgtgagagatgaaggcttacaggttatcctcgagccctttaagaatctgttcgggtcctacatcggaattttctacactttcatcattagtataatcgcccttctggtgattatctatgtcttgctcccaatctgttttaaactgagggacacactacgcaagcatgatgacgcgtacaaacgggaaatgaagattagatga

SEQ ID NO: 11035 - RNA, 4326 nt, synthetic construct
  misc_feature 1..4326: note = derived and/or modified CDS sequence (opt3) from LACV(LACV/93/MO-H)__GU206139.1__GP
  source 1..4326: mol_type = other RNA
atgatctgcattctggtgctcataaccgtcgccgctgcaagccccgtttaccagagatgtttccaagacggcgccatcgtgaagcagaacccttccaaagaggcggtaacagaagtgtgccttaaggatgacgtctctatgattaaaactgaggctaggtatgtgcggaatgccacgggggtattttcaaacaatgtggcaatccgcaagtggctggtcagtgattggcacgactgtcgaccgaaaaagattgtgggaggtcatatcaacgtaatagaagttggcgatgacttgagcttacacaccgagtcctacgtgtgctctgccgattgtacaatcggggtcgacaaggaaactgctcaggtgcgtctgcagaccgatacaaccaatcatttcgagattgcaggaactacagtgaaatcgggctggtttaagtcaaccacgtatatcactctagaccaaacctgcgagcacctcaaagtcagctgtggtccaaagagtgttcagttccatgcctgctttaaccagcacatgtcctgtgtgagattcctgcacaggacaattcttcccgggtctatcgctaatagcatatgccagaacattgaaatcattatcctggtaactttgaccctcctgatctttattctgctctccatattatcaaaaacatacatctgttatctgcttatgcctattttcatcccaatagcctacatttatggaatcatctacaataagagttgcaagaaatgcaagttgtgtggcctggtgtaccatccctttaccgagtgcggcacgcactgtgtctgcggggcgcggtatgatactagcgaccgcatgaaactacatagagcatctggactctgtcctggttacaagtccctgagggccgctcgggtgatgtgcaaatcaaagggcccagccagcattcttagtatcattacagcagttctggtgttgaccttcgtcactcccataaactctatggtgctcggggaatccaaagagacatttgagctggaagatttacctgacgacatgctggagatggctagccgcatcaattcgtattacctcacctgtattcttaactatgccgtatcttggggactggttatcatcggcttgctaattggtctcctgttcaagaagtaccaacaccgatttctgaatatatatgcgatgtactgcgaagagtgtgatatgtaccacgacaaatccgggcttaagagacatggagatttcacgaacaaatgcaggcagtgtacctgcggccagtatgaagacgccgcaggcctgatggctcaccggaagacatacaattgcttggtgcagtataaagccaagtggatgatgaacttcctcatcatttacatctttctgattttaatcaaggattcagctatagtcgtgcaagccgcagggactgacttcaccacatgtctggagactgagagtatcaactggaattgcaccggaccatttctaaacctcggtaattgtcagaaacagcaaaagaaagaaccgtatacaaacattgccacccagctgaagggccttaaagctatcagcgtcttggatgtgcccattatcactgggatacctgacgatattgcgggagcactgcgttacatcgaggaaaaggaggacttccatgttcagctcacgattgaatatgccatgctgtccaagtactgcgattactatacacagttttctgacaatagcggctactcacaaaccacttggcgcgtgtatcttagaagtcacgacttcgaggcttgtatcctgtacccaaaccagcatttttgtaggtgcgttaaaaatggtgagaagtgctccagctctaactgggggttcgccaatgaaatgaaagattattactcaggcaagcagaccaaatttgacaaggatttgaacctcgcactgacagccttacaccacgctttccggggaaccagtagcgcctatatggcaactatgctgtccaagaaatctaatgacgatctaatagcgtacacaaacaagatcaaaacgaagtttcccggcaatgctctcctgaaagccattatcgactacattgcatatatgaagtcgcttcctgggatggccaacttcaaatacgatgagttttgggacgaattgctgtataagccaaatcccgctaaggccagcaacctcgcacgaggaaaagagtcctcatacaacttcaagctggctatcagttctaaaagcataaagacctgtaaaaatgtcaaggatgtggcctgcttatccccgcgctcaggtgcgatttatgccagcatcatcgcttgtggcgaacctaacgggccctctgtttacagaaagccatccggaggcgtgttccagagtagcactgacaggtctatttattgcctgcttgattcccattgcttggaggagtttgaagcaatcggtcaagaggaactcgacgccgtcaaaaagtcaaaatgttgggagattgagtaccctgatgtgaagctgatacaggaaggggacggcacaaaaagttgccggatgaaggacagcggaaattgtaacgtagctaccaatcgctggcccgtgatccagtgcgataacgacaagttctactattcggagctacagaaagattacgacaagacacaagatattggccactattgtctgtccccagggtgcactaccgttagataccccatcaatcctaaacatatttctaactgtaattggcaggtcagcaggtcaagtatcgccaagatagacgtgcacaacatcgaagatattgagcagtataaaaaggcaatcacgcagaagctccaaacctccctgtctctttttaaatacgcgaagactaaaaatttgccacacattaagccgatctataaatacataacaattgaaggaaccgagacagccgagggtatcgaaagcgcttacatcgagtccgaagtgcccgccctggcaggcacttcaattgggttcaagataaacagcaaagagggaaagcatttactcgacgtcatcgcttatgttaagagtgcctcttactccagcgtgtataccaaactgtactcgacgggccctacatcaggtattaataccaagcacgatgaactttgcactgggccatgtcccgcaaacatcaatcatcaggacggctggctgacatttgcccgtgagcggacctctagttggggatgcgaggagttcggctgtttggctgtgtccgatgggtgcgtatttggaagctgccaggacattatcaaagaagaactctctgtctatcgaaaggagactgaagaggtgaccgatgttgagctgtgtctaacattcagcgacaaaacgtactgcaccaacctgaaccctgtgactccaataatcacagacctctttgaagtccaattcaagaccgtggagacatattccctgcccagaattgttgcggtgcagaatcacgaaatcaagattggccagatcaacgatcttggtgtatactcaaaagggtgtggaaatgtccagaaggtgaacggcactatatacggtaatggcgtgccgaggtttgactatttgtgccatctggccagtcgcaaagaggtcattgttcggaagtgtttcgataacgactaccaagcatgcaaatttttacagagccctgcttcttatagactcgaggaagattccgggaccgtgacgatcatcgactacaagaagattctgggaacaatcaaaatgaaggccatacttggcgatgtaaaatataagaccttcgccgactcagtggatattactgctgaggggagttgtaccggatgcatcaattgtttcgaaaacattcactgcgagctgacactacacactaccatcgaagcaagctgtccaataaaatcctcttgcacagtctttcatgacaggattctcgtgacgcccaatgagcacaagtacgccctgaaggttgtgtgcaccgagaaacctggcaacactttgacaatcgaagtctgtaataccaagatcgaggcgtcgatggctctggtggatgccaaacccattatcgaattagcaccagttgaccagactacatatattcgcgagaaggacgaacgatgcaaaacctggatgtgtcgggtgcgtgatgagggtctccaggtcatactggagcctttcaagaacctttttgggagctacatcggaattttctacacgtttatcatctcaattgtagccctgttggtgataatctatgttctcctgcccatttgcttcaagctaagagacactctgaggaaacatgaagatgcttacaagcgcgagatgaaaatccggtga

SEQ ID NO: 11036 - RNA, 4326 nt, synthetic construct
  misc_feature 1..4326: note = derived and/or modified CDS sequence (opt3) from LACV(LACV/95/OH-H (CCH-MB96))__GU206136.1__GP
  source 1..4326: mol_type = other RNA
atgatcagaatactggtgctcatagccgtcaccgctgcaagccccgtttaccagaggtgcttccaagacggcgccatcgtgaagcagaacccttccaaagaggcggtaacagaagtgtgtcttaaggatgacgtctctatgattaaaactgaggctcggtatatccgcaatgccacgggggtgttttcaaacaatgttgcaattcgaaagtggctggtgagtgattggcacgactgccgtccgaaaaagatcataggaggtcatatcaacgtcattgaagtgggcgatgacttgagcttacacaccgagtcctacgtatgttctgccgattgcacaatcggggttgacaaggaaactgctcaggtgagactgcagaccgatacaaccaatcatttcgagattgcaggaactacagtcaaatcgggctggtttaagtcaaccacgtatatcactctagaccaaacctgtgagcacctcaaagtgagctgcggtccaaagagtgtgcagttccatgcctgttttaaccagcacatgtcctgcgtcaggttcctgcaccggacaatacttcccgggtctattgctaatagcatctgtcagaacattgaaatcatcattctggttactttgaccctcctgatatttatcctgctctccattttatcaaaaacatacatctgctatctgcttatgcctatattcattccaatcgcctacgtgtatggaatcatttacaataagagttgtaagaaatgcaagttgtgcggcctggtataccatccctttaccgagtgtggcacgcactgcgtgtgtggggcgcgctatgatactagcgacagaatgaaactacatagggcatctggactctgccctggttacaagtccctgcgggccgctcgcgtcatgtgtaaatcaaagggcccagccagcatccttagtatgattacagcagtgctggttttgaccttcgtgactcccataaactctatggtcctcggggaatccaaagagacatttgagctggaagagttacctgatgacatgctggaaatggtgagccgaatcaattcgtattacttcacttgcattctcaactatgctgtatcttggggacttatcatcattggcctgttgacgggtctactgtttaagaagtaccaacacagattcctcaatgtttatgccatgtactgtgaggaatgcgacatgtaccacgataaatccgggctgaagaggcatggagacttcaccaacaaatgtcggcagtgcacatgtggccagtatgaggatgcggccggccttatggcacaccgtaagacttacaattgcctggtgcagtataaagctaagtggatgatgaactttttgataatctacattttcctcatcctgattaaggactcagccatcgtcgtgcaagctgccgggaccgattttacaacttgcttagagaccgaaagtataaactggaattgtacaggaccattcctgaacctaggtaattgccagaaacagcaaaagaaagagccgtataccaacatcgcaactcagctcaagggcctgaaagccattagcgtccttgacatccccattatcacggggatacctgatgacattgctggagcgttgcgctacatcgaagagagagaagattttcatgtgcagctgacaattgagtatgcaatgctctccaagtactgtgactactatacccagttctctgataatagcggctactcacaaactacctggagggtttatctgcggagtcacgactttgaggcctgcatcctttacccaaaccagcatttctgtcgatgcgtgaagaatggtgaaaaatgttccagctctaactgggggtttgctaatgagatgaaggacttctattcaggcaaacagacaaagtttgataaagacctgaacttggccctcaccgcactgcaccacgccttccgcggaaccagtagcgcttacatagccacagtattatccaagaagtctaatgatgacctgatcgcatatacgaacaaaattaagaccaaatttcccggcaatgcgctactcaaggctatcattgattacatcgcctacatgaaatcgctgcctgggatggcaaacttcaagtatgacgagttctgggatgaacttttgtacaaaccaaatcccgccaaggctagcaacctggccagaggaaaggaatcctcatataactttaaactcgcaataagttctaagagcattaaaacttgcaagaatgtcaaagacgtggcttgtctgtccccgaggtcaggtgccatctacgcgagcatcattgcctgcggcgagccttctgggccctccgtttatcggaagccacctggaggcgtgttccagagtagcacagatcgctctatctactgtttactggactcccattgccttgaggaatttgaggctatttcacaagaagagttggatgcagtcaagaaaagtaagtgctgggagatagaatatcccgacgtgaaaccactccaggagagcgatggtaccaagtcgtgtagaatgaaagactccgggaactgcaatgtagccacaaacaggtggcccgtgatccagtgtgaaaatgacaagttctactactctgagctgcagaaggattatgacaaaactcaagatattggccactactgcctaagccctggatgtaccacggttcgttatccaatcaacccgaagcatatttcaaattgcaactggcaggtcagtcggtcctctatcgctaaaatagacgtgcacaatatcgaagatattgagcagtacaagaaagccatcacccagaagctgcaaacaagcctctccctgtttaagtatgcaaaaactaagaaccttccccacattaaacctatctacaagtatataaccattgagggcacagaaactgcggaggggatcgaatcagcctacatcgagagcgaagtgccagctttggccggaaccagtattggtttcaaaataaattctaaggagggcaaacatctgttagacgtcatcgcatacgttaagtccgctagctattcgtcagtgtacacgaagctctattctacagggcccaccagtggaattaacactaaacacgatgagctgtgtacaggcccttgcccagccaatatcaaccatcaggtgggttggcttacctttgcacgagaaagaacttccagctgggggtgtgaggagttcggctgcctggccgtatctgacggatgtgtctttggcagctgccaggatattatcaaggaagaattgtccgtgtacaggaaagagaccgaggaagttacagacgtggagctctgcctgacgttctcagataagacctattgtactaatctaaaccccgtcacaccgataatcaccgacctgtttgaagtgcaattcaaaacagttgagacttacagtctccctcgcattgtggctgtacagaaccacgagatcaagattgggcagatcaatgatctgggagtctatagccggggctgcggtaacgtgcagaaggtgaatgggaccgtctacggaaacggcgttccaagatttgactacctttgtcatttggcgtctaggaaagaagtgatagtacgcaagtgcttcgacaatgattatcaagcctgtaaattcctgcagtcccccgcatcataccgattagaggaagacagtggtacggtgacaattatcgattataagaaaatcctcggcaccattaagatgaaggctatcctgggggacgtcaaatacaagacttttgccgatagcgtggacataaccgccgagggatcctgcacaggctgtattaactgcttcgaaaatatccactgtgagcttactctgcacaccacaattgaggcttcttgccctatcaaatcgagctgtacggtttttcatgatcggattctagtgacccccaacgaacacaagtatgcactcaaaatggtctgcactgagaagccagggaatacactgaccattaaggtgtgcaacactaaaatcgaagcctcaatggcgttggttgacgctaagcctatcattgagctggcccccgtggatcagacagcatacatccgtgaaaaagacgagagatgtaagacctggatgtgcagggtccgcgatgagggattacaggtaattctcgaaccattcaaaaatctgtttggctcctatataggtatcttctacacgtttattatcagtatcgtggcccttctggttattatatacgtgttgctcccgatctgtttcaagctgcgggacactctaagaaagcatgaggacgcttataaaagggaaatgaagattcgatga

SEQ ID NO: 11037 - RNA, 4326 nt, synthetic construct
  misc_feature 1..4326: note = derived and/or modified CDS sequence (opt3) from LACV(LACV/95/WV-H)__GU206133.1__GP
  source 1..4326: mol_type = other RNA
atgatctgcattctggtgctcataaccgtcgccgctgcaagccccgtttaccagagatgtttccaagacggcgccatcgtgaagcagaacccttccaaagaggcggtaacagaagtgtgccttaaggatgacgtctctatgattaaaactgaggctaggtatgtgcggaatgccacgggggtttttagtaacaatgtggcaatccgcaagtggctggtcagtgattggcacgactgtcgaccgaaaaagattgtgggaggtcatatcaacgtaatagaagttggcgatgacttgagcttacacaccgagtcctacgtgtgctctgccgattgtacaatcggggtcgacaaggaaactgctcaggtgcgtctgcagaccgatacaaccaatcatttcgagattgcaggaactacagtgaaatcgggctggtttaagtcaaccacgtatatcactctagaccaaacctgcgagcacctcaaagtcagctgtggtccaaagagtgttcagttccatgcctgctttaaccagcacatgtcctgtgtgagattcctgcacaggacaattcttcccgggtctatcgctaatagcatatgccagaacattgaaatcattatcctggtaactttgaccctcctgatctttattctgctctccatattatcaaaaacatacatctgttatctgcttatgcctattttcatcccaatagcctacatttatggaaccatctacaataagagttgcaagaaatgcaagttgtgtggcctggtgtaccatccctttacggagtgcggcactcactgtgtctgcggggcgcggtatgatacaagcgaccgcatgaaactacatagagcatctggactctgtcctggttacaagtccctgagggccgctcgggtgatgtgcaaatcaaagggcccagccagcatccttagtattatcaccgcagttctggtgttgactttcgtcacacccattaactctatggtgctcggggaatccaaagagacctttgagctggaagatttacctgacgacatgctggagatggctagccgcataaattcgtattacctcacgtgtatccttaactatgccgtatcttggggactggttattatcggcttgctaatcggtctcctgttcaagaagtaccaacaccgatttctgaatgtgtatgcgatgtactgcgaagagtgtgatatgtaccacgacaaatccgggcttaagagacatggagatttcaccaacaaatgcaggcagtgtacatgcggccagtatgaagacgccgcaggcctgatggctcaccggaagacttacaattgcttggtccagtataaagccaagtggatgatgaacttcctcattatatacatctttctgattttaatcaaggattcagctattgtggtccaagccgcagggaccgacttcacaacttgtctggagaccgagagtatcaactggaattgcacaggaccatttctaaacctcggtaattgtcagaaacagcaaaagaaagaaccgtataccaacatagccactcagctgaagggccttaaagctatcagcgtgttggatgttcccattatcacggggattcctgacgatatcgcgggagcactgcgttacatagaggaaaaggaggacttccatgtgcagctcacaattgaatatgccatgctgtccaagtactgcgattactatacccagttttctgacaatagcggctactcacaaactacctggcgcgtatatcttagaagtcacgacttcgaggcttgtatcctgtacccaaaccagcatttttgtaggtgcgtcaaaaatggtgagaagtgctccagctctaactgggatttcgccaatgaaatgaaagactattactcagggaagcagacaaaatttgataaggacttgaacctcgcactgaccgccttacaccacgctttccggggcacttcaagcgcctatattgcaacaatgctgtccaagaaatctaatgatgacctaatcgcgtacacgaacaagataaaaaccaagtttcccggaaatgctctcctgaaagccatcattgattacatcgcatatatgaagtcgcttcctggcatggccaacttcaaatacgacgagttttgggatgaattgctgtataagccaaatcccgctaaggccagcaacctcgcacgagggaaagagtcctcatacaacttcaagctggctattagttctaaaagcatcaagacttgtaaaaatgtgaaggacgttgcctgcttatccccgcgctcaggagcgatatatgccagcattatcgcttgtggtgaacctaacggcccctctgtgtacagaaagccatccgggggagtcttccagagtagcacagatcaatctatctattgcctgcttgactcccattgcttggaggagtttgaagcaattggccaggaggaactcgatgccgtgaaaaagtcaaaatgttgggagatcgagtaccctgacgtaaagctgattcaggaaggtgacgggaccaaaagttgcaggatgaaggatagcggcaattgtaacgtggctacaaatcggtggcccgttatacagtgcgagaacgacaagttctactattcggaactacaaaaagattacgacaagactcaggatatcggacactattgtctgtccccaggctgcaccacggtccgctaccccattaatcctaaacatatctctaactgtaattggcaagtgagcagatcaagtattgccaagatcgacgtgcacaacatagaggatatcgaacagtataaaaaggcaattacccagaagctccagacatccctgtctctttttaaatacgcgaagactaaaaatttgccacacatcaagccgatttataaatacatcaccatagaggggacagagactgccgaaggaattgagagcgcttacatcgaatccgaggtccccgccctggcaggtacctcaatcggcttcaagattaacagcaaagaagggaagcatttactcgacgttatagcttatgtgaagagtgcctcttactccagcgtgtatacgaaactgtactcgacaggacctacctcaggcatcaatactaagcacgatgagctttgcacaggtccatgtcccgcaaacattaatcatcaggtagggtggctgacctttgccagggagcgtacttctagttggggctgcgaagagttcggatgtttggctgtctccgacggctgcgtgtttgggagctgccaagatatcattaaagaggaactctctgtttatcggaaggaaaccgaggaggtgacagacgtcgaactgtgtctaacgttcagcgataaaacctactgcactaacctgaaccctgtgacaccaatcataaccgacctctttgaggttcagttcaagacagtggaaacttattccctgccccgaatcgtagcggtccagaatcacgagattaagatcggacagattaacgaccttggcgtgtactcaaaaggttgtgggaatgtgcaaaaggtcaacggaaccatctacggcaatggtgttccgagatttgattatttgtgccatctggccagtaggaaagaggtgatagtacgcaagtgtttcgacaacgattaccaggcatgcaaatttttacagagccctgcttcttatcggctcgaagaggactccggcacggtgacaattatcgattacaagaagatcctggggaccattaaaatgaaggccatccttggagacgtcaaatataagactttcgccgattcagtggacataaccgctgaaggcagttgtacagggtgcattaattgtttcgagaacatccactgcgaactgactctacacaccacaattgaggcaagctgtccaatcaaatcctcttgcacggtttttcatgatagaatactcgtgacccccaatgagcacaagtacgccctgaagatggtctgcactgaaaaacctggaaacacattgaccattaaggtgtgtaatactaaaatcgaggcgtcgatggctctggttgacgccaagcccatcattgaattagcaccagtggatcagacagcctatatcagggagaaagacgaacgctgcaagacctggatgtgtcgagtccgggacgagggcctccaagtaattctggagcctttcaagaacctttttggtagctacatagggatcttctacacgtttattatctcaatcgtggctctgttggttattatatatgtgctcctgcccatctgcttcaaactacgtgatactctgagaaagcatgaagacgcatacaaaagggagatgaagattcgctga

SEQ ID NO: 11038 - RNA, 4326 nt, synthetic construct
  misc_feature 1..4326: note = derived and/or modified CDS sequence (opt3) from LACV(LACV/96/WV-M (WV96-3955))__GU206145.1__GP
  source 1..4326: mol_type = other RNA
atgatctacattctggtgctcatagccgtcaccgctgcaagccccgtttatcagagatgcttccaagacggcgccatcgtgaagcagaacccttccaaagaggcggtaacagaagtgtgtcttaaggatgacgtctctatgattaaaactgaggctaggtacatccggaatgccacgggggtgttttcaaacaatgttgcaattcgcaagtggctggtgagtgattggcacgactgccgaccaaagaagatcaccggaggtcatataaacgtcatcgaagtgggcgatgacttgagcttacacacagagtcctatgtatgttctgccgattgcactattggggttgacaaggaaaccgctcaggtgcgtctgcagacagataccactaatcatttcgagatcgcaggaacaaccgtcaaatcgggctggtttaagtcaacgacttacattaccctagaccaaacatgtgagcacctcaaagtgagctgcggtccgaagagtgtgcagttccatgcctgttttaaccagcacatgtcctgcgtcagattcctgcacaggactatccttcccgggtctatagctaatagcatttgtcagaacatcgaaattatcatcctggttaccttgacactcctgatttttatactgctctccatcttatcaaaaacctatatttgctacctgcttatgcctatcttcataccaattgcctatgtgtacggaatcatctacaataagagttgtaagaaatgcaagttgtgcggcctggtatatcatccctttacggagtgtggcactcactgcgtgtgtggggcgcggtacgatacaagcgaccgcatgaaactacatagagcatctggactctgccctggttataagtccctgagggccgctcgggtcatgtgtaaatcaaagggcccagccagcattcttagtatcattaccgcagtgctggttttgactttcgtgacacccataaactctatggtcctcggggaatccaaagaggtgtttgagctggaagagttacctgatgacatgctggaaatggctctccgcatcaatagctactatttcacttgcattcttaactacgccgtatcgtggggactgatcatcattggcttgctaacgggtctgctctttaagaagtatcaacaccgattcctgaatatatacgcgatgtactgtgaggaatgcgacatgtatcacgataaatctgggcttaagagacatggagacttcaccaacaaatgtaggcagtgcacatgtggccagtacgaggatgccgcaggcctgatgactcaccggaagacctataattgcttggttcagtacaaagctaagtggatcatgaactttctcattgtgtatatcttcctgattttaatcaaggactccgccataatcgtccgtgctgccgggacagatttttcaagttgcctggagactgaaattatcaactggaattgtaccggaccattcctaaacctcggtaattgccaacgccagcagaaaaaggagccgtacgcaaacattgccgctcaactgaaaggccttaaggcgatcagcgtgttggacatacccatgattacagaaatccctgatgacattgcatccgccctgagatatatcgaggaaagggaggcttttcatgtccagctcaccgccgagtacgcaatgctgtctcggtactgtgattattacactcagttcagcgacaattcagggtatagtcagacgacatggcgagtgtaccttcgctcccacgattttgaagcctgcatactgtatccaaaccaacatttctgtagatgcgttaaaaatggagagaagtgtagctctgctaactgggactttgccaatgaaatgaaggactactattcaggcaaacaggcaaagttcgataaagacttgaacctcgcgctgaccgctatgcaccacgcctttaggggtaccagtagcgcatacatggccgctatgttatccaagaaatctaatgatgacctgatcacctacacaaacaagctaaagaccaaattccccgggaatgccctcctgaaggcaattatcgattatattgcttacatgaaaggccttcctggaatggccaactttaagcatgacgagttctgggatgaattgctgtataaaccaactcccacaaaggcgccgaatctcgcccggggccgcgagtcgagctacaacttcgagctggctatctcctcaaaaagtataaagacgtgcaagaacgtgaaagacgtagcatgtttatctcctagaagcggggccatttatgcttccatcatcgcctgcggagaacccaatggtccatcagtctacaggaagcctagcggcggggtgtttcagtcttccaccgatcagagtatgtattgtctgcttgacagccactgcttggaggagttcgaagcaatttctcaagaggaactcgatgcggttaaaaagtccaaatgctgggagatcgaataccccgacgtgaagctgctacaggagaacgatggaactaagtcatgtcgtatgaaagacagtggcaattgcaacgtcgccacaaatcggtggccagtgattcagtgtgaaaacgacaagttttactatagcgagctgcagaaagattacgacaagacccaagatataggtcattattgcctctcgcccgggtgtgctacaatccgataccctattaatccaaaacacatctccaactgcaattggcaggtatctagaagctcaattgccaagatcgacgtgcacaacatagaggatatcgaacagtataagaaagcaattactcagaagctgcaaaccagtctttccttgttcaaatacgctaagacgaaaaatctgccgcatatcaagcccatttataagtacatcaccatagagggcacagaaactgccgagggaattgaatctgcatacatcgagagcgaggttcctgccttagctggcacctccatcgggtttaaaattaactcaaaggaaggaaaacacctcctggacgtcatagcgtatgtgaaaagcgccagttactcttccgtgtatacaaaactttacagcactggtccaacctcgggcgtcaatacgaagcatgatgagctgtgtacagggccctgccctgcaaacatcaatcaccaggttggatggttgaccttcgctagggaacgcacttcatcttggggctgtgaggaatttggttgcctcgccgtgagtgacgggtgtgtgttcggctcctgccaggatattatcaaagaggagctgagcgtatatcggaaggaaacagaggaagtcaccgacgtggagctatgcctgactttttctgataagacctactgtacaaacctcaacccagttacgcccattatcaccgacctgttcgaggtgcaatttaaaactgtcgaaacatatagccttccgagaatagtggccgttcagaatcatgagatcaagattggacagatcaacgatttgggcgtgtactccaaagggtgcggaaatgtacagaaggtcaacggcaccatttacggtaatggggtgcctaggttcgactatctgtgtcacttagcttcacgcaaagaagtgatcgtccgaaagtgctttgacaacgattaccaagcatgtaagttcctccagagtccagccagctatcggctggaggaagactctggaacagttactataattgattacaaaaagatccttggcaccatcaaaatgaaggcgattctgggtgacgtgaaatataagacgttcgctgataatgtagacatcacagccgagggctcctgcaccgggtgtataaactgctttgagaatattcactgtgaactaactctccataccacaatcgaggcatcatgccccattaagagtagctgtactgtgttccacgatcgtatcctggtcacccctaacgaacataaatacgccttgaaggtggtttgcacagagaaacccggaaatacgctgaccataaaggtgtgcaacactaaaattgaagctgcaatggccttagtcgacgcgaagccaatcatcgagctcgctcctgtggatcagacagcctatattagagagaaggacgaaaggtgtaaaacctggatgtgccgcgttcgggatgagggccttcaggtgatcctggaaccctttaagaatctgttcgggtcctacattggaatattttacactttcatcatttctatcgtcgcattgctcgtaatcatttatatactgctaccaatctgttttaaactgagagacacacttaggaagcacgaggacgcctacaaacgagaaatgaagattcgctga

SEQ ID NO: 11039 - RNA, 4326 nt, synthetic construct
  misc_feature 1..4326: note = derived and/or modified CDS sequence (opt3) from LACV(LACV/97/NC-M (NC97-7306))__GU206127.1__GP
  source 1..4326: mol_type = other RNA
atgatcaggattctggtgctcatagccgtcaccgctgcaagccccgtttaccagagatgcttccaagacggcgccatcgtgaagcagaacccttccaaagaggcggtaacagaagtgtgtcttaaggatgacgtctctatgattaaaactgaggctcggtatatccgcaatgccacgggggtgttttcaaacaatgttgcaattcgaaagtggctggtgagtgattggcacgactgccgtccgaaaaagatcataggaggtcatatcaacgtcattgaagtgggcgatgacttgagcttacacaccgagtcctacgtatgttctgccgattgcacaatcggggttgacaaggaaactgctcaggtgagactgcagaccgatacaaccaatcatttcgagattgcaggaactacagtcaaatcgggctggtttaagtcaaccacgtatatcactctagaccaaacctgtgagcacctcaaagtgagctgcggtccaaagagtgtgcagttccatgcctgttttaaccagcacatgtcctgcgtcaggttcctgcaccggacaatacttcccgggtctattgctaatagcatctgtcagaacattgaaatcatcattctggttactttgaccctcctgatatttatcctgctctccattttatcaaaaacatacatctgctatctgcttatgcctatattcattccaatcgcctacgtgtatggaatcatttacaataagagttgtaagaaatgcaagttgtgcggcctggtataccatccctttaccgagtgtggcacgcactgcgtgtgtggggcgcgctatgatactagcgacagaatgaaactacatagggcatctggactctgccctggttacaagtccctgcgggccgctcgcgtcatgtgtaaatcaaagggcccagccagcatccttagtatgattacagcagtgctggttttgaccttcgtgactcccataaactctatggtcctcggggaatccaaagagacatttgagctggaagagttacctgatgacatgctggaaatggtgagccgaatcaattcgtattacttcacttgcattctcaactatgctgtatcttggggacttatcatcattggcctgttgacgggtctactgtttaagaagtaccaacacagattcctcaatgtttatgccatgtactgtgaggaatgcgacatgtaccacgataaatccgggctgaagaggcatggagacttcaccaacaaatgtcggcagtgcacatgtggccagtatgaggatgcggccggccttatggcacaccgtaagacttacaattgcctggtgcagtataaagctaagtggatgatgaactttttgataatctacattttcctcatcctgattaaggactcagccatcgtcgtgcaagctgccgggaccgattttacaacttgcttagagaccgaaagtataaactggaattgtacaggaccattcctgaacctaggtaattgccagaaacagcaaaagaaagagccgtataccaacatcgcaactcagctcaagggcctgaaagccattagcgtccttgacatccccattatcacggggatacctgatgacattgctggagcgttgcgctacatcgaagagagagaagattttcatgtgcagctgacaattgagtatgcaatgctctccaagtactgtgactactatacccagttctctgataatagcggctactcacaaactacctggagggtttatctgcggagtcacgactttgaggcctgcatcctttacccaaaccagcatttctgtcgatgcgtgaagaatggtgaaaaatgttccagctctaactgggactttgctaatgagatgaaggatttctattcagggaaacagacaaagtttgacaaagatctgaacttggccctcaccgcactgcaccacgccttccgcggcaccagtagcgtatacatagctacaatgttatccaagaagtctaatgacgatctgatcgcctatacgaacaaaattaagaccaaatttcccggaaatgcactactcaaggcgatcattgactacatcgcttacatgaaatcgctgcctggcatggccaacttcaagtatgatgagttctgggacgaacttttgtacaaaccaaatcccgcaaaggccagcaacctggctagagggaaggaatcctcatataactttaaactcgccataagttctaagagcattaaaacttgcaagaatgtcaaagatgtggcatgtctgtccccgaggtcaggagctatctacgccagcatcattgcgtgcggtgagcctaacggcccctctgtttatcggaagccacctgggggagtgttccagtccagtacagaccgcagcatctactgtttactggattctcattgccttgaggaatttgaggccatttcccaagaagagttggacgctgtcaagaaatcaaagtgctgggagatagaatatcccgatgtgaaaccactccaggagagtgacggcaccaagagctgtagaatgaaagactcgggtaattgcaacgtagcaacaaataggtggcccgtgatccagtgtgaaaacgataagttctactactccgagctgcagaaggactatgataaaactcaagacattgggcactactgcctatctcctggctgtaccacggttcgttatccaatcaatccgaagcatattagcaactgcaattggcaggtctcacggagttccatcgccaaaatagatgtgcacaacatcgaagacattgagcagtacaagaaagctatcacccagaagctgcaaacatctctcagcctgtttaagtatgccaaaactaagaatcttccccacattaaacctatctacaagtatataaccattgagggaacagaaactgcagagggcatcgaatccgcgtacatcgagtcagaagtgccagccttggctgggaccagcattggattcaaaataaacagtaaggagggtaaacatctgttagatgtcatcgcctacgttaagtctgcatcctatagctcggtgtacacgaagctctattcaacaggccccacctctgggattaatactaaacacgacgagctgtgtacaggaccttgcccagctaacatcaatcatcaggtgggctggcttacctttgcccgagaaagaaccagttcctggggttgtgaggagttcgggtgcctggcagtaagcgatggctgtgtctttggatcttgccaggacattatcaaggaagaattgagcgtgtacaggaaagagactgaggaagttacagatgtggagctctgcctgacgttctccgacaagacctattgtactaacctaaaccccgtcacaccgataatcaccgatctgtttgaagtgcaattcaaaacagttgagacttactcactccctcgcattgtggccgtacagaatcacgagatcaagattggccagatcaacgacctgggggtctatagtaaggcttgcggaaatgtgcagaaagtgaacggcaccgtctacggtaatggggttccacggtttgactacctttgtcatttggcgagcagaaaggaagtgatagtaaggaaatgcttcgataacgactatcaagcctgtaagttcctgcagtctcccgcatcctaccgcttagaggaagattcaggaacggtgacaattatcgactataaaaagatcctcggcaccattaagatgaaagctatcctgggtgatgtcaagtacaaaacttttgccgacagtgtggatataaccgccgagggcagctgcacagggtgtattaattgcttcgaaaacatccactgtgagcttactctgcacaccacaattgaggcttcctgccctatcaagtcttcgtgtacggtttttcatgaccgaatactcgtgacccccaatgaacacaaatatgcactaaagatggtctgcactgagcggccaggaaacacactgaccattaaggtgtgcaatactaaaatcgaagccagcatggcgttggttgatgctaagcctatcattgagctggcccccgtggaccagacagcatacatccgtgaaaaagatgagagatgtaagacctggatgtgcagggtccgcgacgagggcttacaggtaattctcgaaccattcaaaaacctgtttgggtcatatataggaatcttctacacgtttattatctccatcgtggcccttctggttattatatacgtgttgctcccgatctgtttcaagctgcgggacactctaagaaagcatgaggatgcttataaaagggaaatgaagattcgatga

SEQ ID NO: 11040 - RNA, 4326 nt, synthetic construct
  misc_feature 1..4326: note = derived and/or modified CDS sequence (opt3) from LACV(LACV/human/1960)__EF485031.1__GP
  source 1..4326: mol_type = other RNA
atgatctgcattctggtgctcataaccgtcgccgctgcaagccccgtttaccagagatgtttccaagacggcgccatcgtgaagcagaacccttccaaagaggcggtaacagaagtgtgccttaaggatgacgtctctatgattaaaactgaggctaggtatgtgcggaatgccacgggggtttttagtaacaatgtggcaatccgcaagtggctggtcagtgattggcacgactgtcgaccgaaaaagattgtgggaggtcatatcaacgtaatagaagttggcgatgacttgagcttacacaccgagtcctacgtgtgctctgccgattgtacaatcggggtcgacaaggaaactgctcaggtgcgtctgcagaccgatacaaccaatcatttcgagattgcaggaactacagtgaaatcgggctggtttaagtcaaccacgtatatcactctagaccaaacctgcgagcacctcaaagtcagctgtggtccaaagagtgttcagttccatgcctgctttaaccagcacatgtcctgtgtgagattcctgcacaggacaattcttcccgggtctatcgctaatagcatatgccagaacattgaaatcattatcctggtaactttgaccctcctgatctttattctgctctccatattatcaaaaacatacatctgttatctgcttatgcctattttcatcccaatagcctacatttatggaaccatctacaataagagttgcaagaaatgcaagttgtgtggcctggtgtaccatccctttacggagtgcggcactcactgtgtctgcggggcgcggtatgatacaagcgaccgcatgaaactacatagagcatctggactctgtcctggttacaagtccctgagggccgctcgggtgatgtgcaaatcaaagggcccagccagcatccttagtattatcaccgcagttctggtgttgactttcgtcacacccattaactctatggtgctcggggaatccaaagagacctttgagctggaagatttacctgacgacatgctggagatggctagccgcataaattcgtattacctcacgtgtatccttaactatgccgtatcttggggactggttattatcggcttgctaatcggtctcctgttcaagaagtaccaacaccgatttctgaatgtgtatgcgatgtactgcgaagagtgtgatatgtaccacgacaaatccgggcttaagggacatggcgatttcaccaacaaatgcagacagtgtacatgcggccagtatgaagacgccgcagggctgatggctcacaggaagacttacaattgcttggtccagtataaagccaagtggatgatgaacttcctcattatatacatctttctgattttaatcaaggattcagctattgtggtccaagccgcaggaaccgacttcacaacttgtctggagaccgagagtatcaactggaattgcacaggtccatttctaaacctcggcaattgtcagaaacagcaaaagaaagaaccgtataccaacatagccactcagctgaaggggcttaaagctatcagcgtgttggatgttcccattatcacgggcattcctgacgatatcgcgggagcactgcggtacatagaggaaaaggaggacttccatgtgcagctcacaattgaatatgccatgctgtccaagtactgcgattactatacccagttttctgacaatagcggttactcacaaactacctggcgtgtatatcttcgcagtcacgacttcgaggcttgtatcctgtacccaaaccagcatttttgcagatgtgtcaaaaatggggagaagtgctccagctctaactgggatttcgccaatgaaatgaaagactattactcaggcaagcagacaaaatttgataaggacttgaacctcgcactgaccgccttacaccacgctttcaggggaacttcaagcgcctatattgcaacaatgctgtccaagaaatctaatgatgacctaatcgcgtacacgaacaagataaaaaccaagtttcccggcgatgctctcctgaaagccatcattgactacatcgcatatatgaagtcgcttcctgggatggccaatttcaaatacgatgagttttgggacgaattgctgtataagccaaaccccgctaaggccagcaatctcgcacggggaaaagagtcctcatacaacttcaagctggctattagttctaaaagcatcaagacttgtaaaaacgtgaaggatgttgcctgcttatccccgcgatcaggtgcgatatatgccagcattatcgcttgtggcgaacctaatgggccctctgtgtaccgcaagccatccggaggcgtcttccagagtagcacagaccaatctatctattgcctgcttgattcccattgcttggaggagtttgaagcaattggtcaggaggaactcgacgccgtgaaaaagtcaaaatgttgggagatcgagtaccctgacgtaaagctgattcaggaaggggatggcaccaaaagttgcagaatgaaggacagcggaaactgtaatgtggctacaaacaggtggcccgttatacagtgcgagaatgataagttctactattcggaactacaaaaagactacgataagactcaggacatcggccactattgtctgtccccagggtgcaccacggtccggtaccccattaaccctaaacatatctctaattgtaactggcaagtgagccgctcaagtattgccaagatcgatgtgcacaatatagaggacatcgaacagtataaaaaggcaattacccagaagctccagacatccctgtctctttttaaatacgcgaagactaaaaacttgccacacatcaagccgatttataaatacatcaccatagagggaacagagactgccgaaggtattgagagcgcttacatcgaatccgaggtccccgccctggcaggcacctcaatcgggttcaagattaatagcaaagaaggaaagcatttactcgatgttatagcttatgtgaagagtgcctcttactccagcgtgtatacgaaactgtactcgacaggccctacctcaggtatcaacactaagcacgacgagctttgcacagggccatgtcccgcaaatattaaccatcaggtaggctggctgacctttgccagagagaggacttctagttggggatgcgaagagttcggctgtttggctgtctccgatgggtgcgtgtttggaagctgccaagacatcattaaagaggaactctctgtttatcgtaaggaaaccgaggaggtgacagatgtcgaactgtgtctaacgttcagcgacaaaacctactgcactaatctgaaccctgtgacaccaatcataaccgacctctttgaggttcagttcaagacagtggaaacttattccctgccccggatcgtagcggtccagaaccacgagattaagatcggccagattaatgatcttggtgtgtactcaaaagggtgtggaaacgtgcaaaaggtcaatggcaccatctacggtaacggcgttccgcgatttgactatttgtgccatctggccagtagaaaagaggtgatagtaaggaagtgtttcgataatgactaccaggcatgcaaatttttacagagccctgcttcttatcgcctcgaagaggattccgggacggtgacaattatcgactacaagaagatcctgggaaccattaaaatgaaggccatccttggcgatgtcaaatataagactttcgccgactcagtggatataaccgctgaagggagttgtacaggatgcattaactgtttcgagaatatccactgcgaactgactctacacaccacaattgaggcaagctgtccaatcaaatcctcttgcacggtttttcatgaccggatactcgtgacccccaacgagcacaagtacgccctgaagatggtctgcactgaaaaacctggcaatacattgaccattaaggtgtgtaacactaaaatcgaggcgtcgatggctctggttgatgccaagcccatcattgaattagcaccagtggaccagacagcctatatcagagagaaagacgaaaggtgcaagacctggatgtgtcgcgtccgagatgagggtctccaagtaattctggagcctttcaagaatctttttgggagctacataggaatcttctacacgtttattatctcaatcgtggctctgttggttattatatatgtgctcctgcccatctgcttcaaactacgggacactctgcgtaagcatgaagatgcatacaaaagagagatgaagattaggtga

SEQ ID NO: 11041 - RNA, 4326 nt, synthetic construct
  misc_feature 1..4326: note = derived and/or modified CDS sequence (opt3) from LACV(LACV/mosquito/1978)__EF485037.1__GP
  source 1..4326: mol_type = other RNA
atgatcaggattctggtgctcatagccgtcaccgctgcaagccccgtttaccagagatgcttccaagacggcgccatcgtgaagcagaacccttccaaagaggcggtaacagaagtgtgtcttaaggatgacgtctctatgattaaaactgaggctcggtatgtgcgcaatgccacgggggttttctcaaacaatgtggcaatccgaaagtggctggtcagtgattggcacgactgccgtccgaaaaagattatcggaggtcatataaacgtgatcgaagtaagcgatgacttgtccttacacaccgagtcttacgtttgttcggccgattgcacaattggcgtggacaaggaaactgctcaggtcagactgcagaccgatacaaccaatcatttcgagatcgcagggactacagtgaaatcaggatggtttaagagcaccacgtatattactctagaccaaacctgtgagcacctcaaagtgagttgcggcccaaagtccgtccagttccatgcctgttttaaccagcacatgtcttgcgttaggttcctgcaccggacaatccttcccggtagcatagctaattccatttgtcagaacatcgaaattatcatcctggtgactttgaccctcctgatttttatactgctctcaatcttaagtaaaacatacatttgctatctgcttatgcctatcttcataccaattgcctacatgtatgggatcatctacaataagagctgtaagaaatgcaagttgtgcggactggtataccatccctttaccgagtgtggcacgcactgcgtgtgtggcgcgcgctatgatacttctgacagaatgaaactacatagggcatccgggctctgccctggatacaagtcactgcgggccgctcgcgtcatgtgtaaaagcaagggtccagccagtattctttctatcattacagcagtgctggttttgaccttcgtgactcccataaactccatggtcctcggcgaaagcaaagagacatttgagctggaagagttacctgatgacatgctggaaatggcttcgcgaatcaattcttattactttacctgcattctcaactatgccgtgtcctgggggcttgtaatcatcggactgttgacgggcctactgtttaagaagtaccaacacagattcctcaatatttatgcgatgtactgtgaggaatgcgacatgtaccacgataaatcaggtctgaagaggcatggggacttcaccaacaaatgtcggcagtgcacatgtggacagtatgaggatgccgcaggccttatggctcaccgtaagacttacaattgcctggttcagtataaagccaagtggatgatgaactttttgataatctacattttcctcatcctgattaaggacagtgctatcgtggtccaagccgcaggcaccgattttacaacttgcttagagaccgaaagcatagactggaactgtacagggccattcctgaatctaggaaactgccagaaacagcaaaagaaagagccgtataccaatatcgccactcagctcaagggtctgaaagctatttccgtgcttgatatccccattatcacgcgcatacctgacgatattgcgggcgcattgagatacatcgaagagagggaagactttcatgtccagctgacaaccgagtatgccatgctctctaagtactgtgattactatactcagttcagcgacaactcagggtacagtcaaaccacatggcgggtgtatctgcgatcccacgactttgaggcttgcattctttacccaaatcagaacttctgtcgctgcgttaagaatggagaaaaatgtagttcttcaaactgggattttgccaatgagatgaaggactattaccccggcaaacaggcaaagttcgataaagacctgaacttggccctcaccgctctgcatcacgcctttagaggtactagcagcgcatatatcgcgacaatgttatccaagaagtctaatgatgacctgatagcttacacgaacaaaatcaagaccaaattccctgggaatgccctactcaaggcaattatcgattacattgcctatatgaaatcgctgccaggcatggctaactttaagtacgacgagttctgggatgaacttttgtataaacccaatccggccaaggcaagcaacctggctaggggaaaggaatcctcatacaacttcaaactcgccatcagttctaagagcataaaaacttgcaagaatgtgaaagacgtagcgtgtctgtcccctcggtcaggcgccatttatgctagcatcatcgcatgcggggagcccaacggaccatctgtctaccgcaagccttccggtggcgtgtttcagagtagcacagatagatctatttattgtttactggactcccactgccttgaggagttcgaagccatctcacaagaagagttggatgctgttaagaaaagtaagtgctgggagattgaatacagcgacgtgaaacccctccaggaggggaatggaaccaagtcgtgtaggatgaaagactccggcaactgcaatgtcgccacaaaccgttggccagtgatacagtgtgaaaatgataagttttactattctgagctgcagaaggactacgataaaactcaagacatcggtcattattgcctaagccccgggtgtaccacggtacggtaccctattaacccaaagcacatctcaaattgcaactggcaagtgagtcgatcctctattgcaaaaatcgatgttcataatatagaagacatcgagcagtataagaaagcgattacccagaagctgcagacaagcctctccctgttcaagtacgccaaaactaagaaccttccgcacatcaaacccatttataagtacatcaccatagagggcacagaaactgctgagggaattgaatcagcctacatcgagagcgaagtccctgcattggctggcaccagtatcgggtttaaaattaattctaaggagggaaaacacctgttagatgtgatagcctatgtgaagtccgcaagctactcgtcagtctatgccaagctctactctacgggtccaacaagtggcatcaacaccaaacatgacgagctgtgtactgggccctgccctgctaatattaaccaccaggttggatggcttacattcgcgaaggaaagaacctccagctggggctgtgaggaatttggttgcctggccgtgtctgatgggtgtgtgttcggcagctgccaggacatcattaaagaggaattgtccgtatataggaaggagactgaggaagtcaccgatgtggagctctgcctgacattttcagacaaaacgtactgtaccaacctaaatccagttactcccatcataacagatctgttcgaagtgcaatttaagaccgtcgagacatatagtctcccgcgcatcgtggcagttcagaaccatgagattaagatcggacagattaatgacctgggcgtgtacagcaaagggtgcggaaacgtacagaaggtcaatggcactgtgtacggtaacggggtgcctcggttcgactatctttgtcacttggcttctagaaaagaagtcatcgttaggaagtgctttgataatgactaccaagcctgtaaattcctgcagtccccagcctcatatcgcttagaggaagatagtggaaccgtgacgataattgactacaagaagatcctcggcacaatcaaaatgaaggctattctgggtgatgtaaaatataagaccttcgcagacagcgtggatatcactgccgagggctcctgcaccgggtgtataaactgctttgaaaatattcattgtgagcttacactgcacactaccatcgaggcgtcttgccccattaaatcgagctgtacagtcttccacgaccgaatcctagtgacgcctaacgaacataagtacgctctcaagatggtttgcaccgagaaacccggaaatactctgacaataaaggtgtgcaacaccaaaattgaagcctcaatggcattggtcgatgccaagccaatcatcgagctggctcctgtggaccagactgcatatattcgggaaaaagatgagcgttgtaagacatggatgtgcagagttagggacgagggcttacaggtgatcctcgaaccctttaagaatctgttcgggtcctacattggaatattttacaccttcatcattagtatcgtcgcccttctggcgatcatttatgtattgctcccaatatgttttaaactgcgcgacacgctacggaagcacgaggatgcttacaaaagagaaatgaagatcaggtga

SEQ ID NO: 11042 - RNA, 4326 nt, synthetic construct; identical to SEQ ID NO: 11011
  misc_feature 1..4326: note = derived and/or modified CDS sequence (opt3) from LACV__KP271111.1__GP
  source 1..4326: mol_type = other RNA

SEQ ID NO: 11043 - RNA, 4263 nt, synthetic construct
  misc_feature 1..4263: note = derived and/or modified CDS sequence (opt3) from OROV(BeAn19992)__NC_005775.1__GP
  source 1..4263: mol_type = other RNA
atggccaacctgatcattataagcatggtgctcggcgtcgcttacgggcaccccctttccacctctcagatcggagacagatgcttcgccggtggcaatctgtttaaggagatgaacttgtcagttgggttaggagaaatttgtgtgaaagatgacatcagtattgtaaagagcacaactgtgttctccaaaaataagcctgcactggaggcgacgaccaaattttataggtctttcatcgtcaaggattggtcggaatgcaacccagtgctagacaagtttggcaatttcatggttctctcagtggatgacaacggtcatataatcccgaaaatgtacacatgtcgggctgcctgcgatattcgcctgaataaggacaacgcagagatcattcttagcagtactaaactgaatcactttgaaatcgtcgggaccacatccacctctggatggttcaagaacactataacaaataacttggagcatacctgtgagcacgtgacggtaaattgcggccaaaaatccgttaagtttcatgcctgtttccgacagcaccgtggctgcattagatttttcaaggggacttatatgccctactccatgatcgaagctatgtgtgtgaacattgagctcatcatcctgaccctgtatatttttgcagccataatcttcgctctcattatcacaaaatcatacgtcgcctatttactgcttcctttgttctacccagtgacttggttttacggaaaggtgtataaaaagataaatagttgccccaactgtctgctagcgagccaccctttcacctcttgcccaaaattttgcatttgtggttccaggttctcatgcacagaagcactcaaggtccatcggatgggcaaagattgtctggggtacaagagccttagtaaggcccgccagatgtgcaaatctaagtcctggagctttaccgctgccatcctgacgggattgatcctcatggagttcatttcgcccatcgcaggcgagagaatgtataaactggaagagttagctgacgaatttattaagctgactgagcaggttaacatactcgaaagggagatggaggtgcttaaacaatctatcattgtaatgttcgccatcatcctggtgttgctactgtttgaaaatatgattttcaaccggctctttcgcatattctaccgatcctgttcaatgtgcggtctgatccactatagacctgggcttaagattgatctgacaaagaccaataggtgtggaagttgcatctgtggctttgacgagcagcagagctccggcttcgaatacgagattttcttgaaagatatgcatgtccagaaggaatcttgcaaatttagcccacgggtgaaccacttccgtaatatcaaggcgctcctgtttgccttagttatatgtgcaactatctatacagtgtacgctgacgaggactgcctgtcaaaagatattaagatcacctaccaagagctacacaactgcattgggccgaagatcatgggagacacgtgtgtcagtaaatccgaactctatagcgatctgttctctaagaatcttgtgaccgagtacgacaaaaagtattttgaacccgatacagtaaacgaccagttcaataaaatagagtttgcccaggatgctcatcgcatgattttgctggaaagaatcctctacaagactgagtgcgagatgctgtcacttaagaaaaacagtggtccttataatgttgcctggaggacctacctgaagaaccacaatattgacttgtgtagccggcataactataaaatgatctgccagtgtataaatacacactccatgtgcaacaacactgatatcgactacaataaggaaattgagacctactataaatctaacgcagccgcttaccgagcggatctcaatacaatcatggacaccctgaagactgcattccgcggcttaacgaaagtgctgattgaaaactatatcgagaaggacgattcggacgccctaaaggctctctttagcaatataacagattccgtccaagacaactaccagatgattgggatcctgaaattcgcctcaaaacttttggatatcaatctgggaagaagtaccaggtctgcacatcacagcattatgactaacgagatcccaaaatccaatccctttaccgactattcatacagcaacctcaatattaaggaatgtatgtctcctgagtccctgaaatgcttcaagaagcggggcagtacaccacacaccaaccatttactgtgtaaaatagataataagtataaagcctttgactggcccgaaatcgagactattcagaagggtcaaaaactttgcttgggggatagccactgtaacctcgaatttacagctatcacggccgacaagattatgtctctgaccaattgctacaaggagtccttcactgcacagccggcggatatgcaggctggcatcaaaaagtgctcagccgacgagataggagaatgtacaaccctagaggataaaacatggcctatcattttctgcggcgggaagtactattacagtgacagcaaagaacatgcaaaggacggatcgatcaacaactattgtctgactaataagtgctccgagcagcgcttccccattcacgaaaactggtttaaaaagtgtaattgggataaaacccacaaggagttctctacgatgagacaaatcaactacaatgacataaccagctataggaaagccattgagtcagaaatcggtacagatctcatgactcatcactacaagccaaccaaaaacctgcctcatgtggtcccccgttatcacagtatcgacgtgcagggcacagagtccactgaagggattataaatggatttatccagaacaccattccagctatctctggccttggtgttgggtaccatttgaatttccagagcaaccaactgtttgatattgtgatcttcgtaaagaaggccgtctacaaagcacagtatcagaaggcttacacgacaggcccctccatatcaatcaatattgagcacaacgaacggtgcaccggacactgtcctgagaaaatcccagccaaggagggctggttaacttttagcaaagaacatacaagttcttgggggtgcgaggaatatggatgtctcgcgattgacaccggttgcctgtacggctcctgtcaggatgtgatccgaccggagcttgacgtttataagaagatagggagcgaggtgtcgctgattgaaatctgcatcactttgccccacgagacctactgcaatgatatggacattctcgaacctatcataggagataaactgtcagcctctttccaaaacacacagacgaatcagctaccaaccctgattgcttataagaaaggcaagatctacactggtcagattaacgacatcgggaacacagcactccaatgtggcagtatacaggtcattaatggatccaccatcggcacagggagccccaaatttgattacatctgccatgccatgagaaggaaggacgtgattgtacgcaagtgtttcaacgacaattatcagtcttgcactcggctggagaaaagaaacgatcttatcccttacaggaagggagacgtgattgaagttagcaaaaccggctccaatatgggtcaaatgacgttcaagatagagttgggggatatcaactataaaatttttacaaagtcaatcgacctgcagatgagtggaatctgtgctggctgcattgattgtgccgagggtataagctgctctatcaatgcagaagtcccagcggagaccgtgtgtcactgcaagactaactgtgaagacttcattaataacatcgtgtttagcccccagattaaaaattacaacatcaaggtccattgcaaatcaaaggttgagaaaataaccgcccacatctgcggccgcgatattgacttacagctcacaatcaagccgtataatcaaaagattgatctgagtcagcttgacgaaagcaactacatccgagaggaggatctgcagtgtgggacttggctatgcaaagtgcagaaggaaggaatagacattatcttcaaaggcctcttttccgggctgggacggtattggaccattttgatctactctataatcggcgtggtaattatcgtcattctggtgtacatcttactccctataggtcgtctgcttaaggctttcctgattagacacgagatcgaatatgccatggagcaaaagatcaagtga

SEQ ID NO: 11044 - RNA, 4263 nt, synthetic construct
  misc_feature 1..4263: note = derived and/or modified CDS sequence (opt3) from OROV(BeH759021)__KP691607.1__GP
  source 1..4263: mol_type = other RNA
atggccaacctgatcattataagcatggtgctctccgtcgcttacggccaccccctttctacctcacagatcggggacagatgcttcgcaggaggtaatctgtttaaggagatgaacttgagtgttggcttaggggaaatttgtgtgaaagatgacatcagcattgtaaagtccacaactgtgttctctaaaaataggcctgccctggaggcgacgaccaagttttatcggtcgttcatcgtcaaagattggtcagaatgcaacccagtgctagacaagtttggaaatttcatggttctcagcgtggatgacaacggccatataatgccgaagatgtacacatgtcgcgctgcctgcgatatccgactgaataaagacaacgcagagattatccttagttccactaagctgaatcactttgaaattgtcggtaccacatctaccagcgggtggttcaaaaacactatcacaaataacttggagcatacctgtgagcacgtgacggtaaattgcggacaaaagtccgttaaatttcatgcctgtttccgtcagcacagaggctgcataaggtttttcaagggcacttatatgccctactcaatgattgaagctatgtgtgtgaacatcgagctcattatcctgaccctgtatatctttgcagccattatattcgctctcatcattacaaagagttacgtcgcctatttactgcttcctttgttctacccagtgacttggttttacgggaaagtgtataagaaaatcaatagctgccccaactgtctgctagcgtctcaccctttcacctcctgcccaaagatatgcatttgtggatcacggtttagctgcacagaagcactcaaagtccatcgcatgggtaaggattgtctgggctacaaaagtctttctaaggccagacagatgtgcaagtccaaaagctggtcgttcaccgctgccatcctgacggggttgatcctcatggagtttatttctcccatcgcaggagagaggatgtataagctggaagagttagctgacgagttcattaaactgactgaacaggttaacatactcgaacgggagatggaggtgcttaagcaatccatcattgtaatgtttgccatcatcctggtgttgctactgttcgaaaatatgatttttaaccgcctcttctcaatattttaccgaagttgtagcatgtgcggcctgatccactatagacctggtcttaaaattgatctgacaaagaccaataagtgtgggtcctgcatctgtggattcaacgagcagcagtctagcggctttgaatacgagattttcttgaaagacatgcatatccagaaggaatcatgcaaattcagtccaagggtcaatcactttcggaacataaaggcgctcctgttcgccttagtgatctgtgcaactatttatacagtttacgctgatgaggactgcctgtccaaagacatcaagattacctaccaagagctacacaattgcatcggcccgaagataatggggaacacgtgtgtgagcaaaaatgaactctattctgatctgttttcaaagaaccttgtcaccgagtacgacaaaaagtatttcgaacccgatacagtgaatgaccagtttaacaaaattgagttcgcccaggatgctcatcgtatgatcttgctggaacgcattctctacaagactgagtgcgagatgctgagtcttaagaaaaatagcggaccttataacgtagcctggagaacctacctgaagaatcacaacatcgacttgtgttccaggcataactataaaatgatatgccagtgtatcaatacacactctatgtgcaagaacactgatattgactacaataaagaaatcgagacctactataagtcgaacgcagccgcttaccgggcggatctcaatacaattatggacaccctgaaaactgcatttcgaggtttaacgaaggttctgatcgaaaactatatagagaaggatgacagcgacgccctaaaagctctcttctccaatattacagattcagtgcaagacaactaccagatgatcggcatcctgaagtttgccagtaaacttttggatattaatctggggcgctctaccagaagcgcacatcactccatcatgactaacgagattccaaagtcaaatcccttcaccgactatagctactctaacgtcaatataaaagaatgtatgtcccctgagagtctcaagtgctttaagaaaagggatagcacaccacacaccaaccatctgttatgtaagatcgactctaaatataaggccttcgattggcccgaaattgagactatccagaaaggacaaaagctgtgccttggcgactcccactgtaatttggaatttacagctattacggccgataagatcatgtcactcaccaactgctacaaagagagtttcactgcacagccggcggacatgcagacaggtataaagaaatgcagcgctgatgagatcggggaatgtaccacactggaggacaagacttggcctattgtgttctgcggcggaaaatactattactcggattccaaggaacatgccaaggacggctctatcaacaattattgtctaaccaacaaatgcagcgagcagcggtttcccattcacgaaaattggttcaagaaatgtaactgggacaagacgcacaaagagttttcaaccatgcgccaaatcaattacaacgatataacaagttatagaaaggcaattgagtccgaaatcgggtctgacctgatgactcatcactacaaaccaaccaagaatctccctcatgtcgtgcccaggtatcacagcatcgatgttcagggaacagagtccactgaaggtattataaacggcttcatccagaataccattccagccatctcagggctgggagtgggctaccatcttaactttaagggtaatcagttgttcgacattgtaatctttgtcaaaaaggctgtgtacaaagcccaatatcagaaggcatacacgacagggcccagcataagtatcaacattgagcacaatgaacgttgcaccggccactgtcctgagaaaatcccagctaaggagggatggctgactttctctaaggaacatacatccagctggggctgcgaggaatatgggtgtttagccattgataccggatgcctctacggttcgtgtcaggacgttatccggccggagctggatgtgtataaaaagataggctcagaggtctctcttattgaaatctgcatcactctgccccacgagacctactgcaacgacatggatattttggaacctatcataggggacaaactcagtgcgtcctttcagaatacacaaacgaaccagctgccaaccctaattgcctataagaaaggaaagatctacactggccagattaacgatatcggtaatacagctctgcagtgtgggagcatacaagtgattaacggctctaccatcggaacaggcagccccaagttcgactacatctgccatgcaatgcgaagaaaagatgtaattgtgaggaagtgttttaatgacaactatcagtcctgcactcgcctcgagaaacggaatgacctgatcccttacagaaagggggatgttattgaagtctcaaaaaccggaagtaacatgggccagatgacgttcaagatagagcttggtgacgtgaattataagatcttcacaaaaagcattgatttgcaaatgtctgggatctgtgccggatgcatcgactgtgctgagggcatttcctgctcaataaacgccgaagtgccagcagagaccgtctgtcactgcaagactaattgtgaagattttatcaacaatattgttttcagtccccagatcaaaaactacaatattaaggtgcattgcaaaagcaaggtggagaagatcatagcgcacatctgcggtagggacattgatctgcagttaaccgtaaaaccgtataaccagaagatcgacctctcccaactggatgaatctaattacattcgcgaggaggaccttcagtgtggcacatggctgtgcaaagtccagaaggaaggggtggatatcatatttaaaggactattctcgggcctcgggcgatattggactattctgatctacagcattatcggagttgtgataatcgtcattttggtgtacatcctgttacctattggccggctcctgaaggcctttcttatccgtcacgagatagaatatgctatggagcagaaaattaagtga

SEQ ID NO: 11045 - RNA, 4263 nt, synthetic construct
  misc_feature 1..4263: note = derived and/or modified CDS sequence (opt3) from OROV(BeH759022)__KP691610.1__GP
  source 1..4263: mol_type = other RNA
atggccaacctgatcattataagcatggctctctccgtggcatacggccaccccctttctacctcacagatcggggacagatgcttcgccggaggtaatctgtttaaggagatgaacttgagtgtcggcttaggggaaatttgtgttaaagatgacatcagcattgtgaagtccacaactgtattctctaaaaataggcctgcgctggaggctacgaccaagttttatcggtcgttcatcgtgaaagattggtcagaatgcaacccagtcctagacaagtttggaaatttcatggtgctcagcgttgatgacaacggccatataatgccgaagatgtacacatgtcgcgccgcatgcgatatccgactgaataaagacaacgccgagattatccttagttccactaagctgaatcactttgaaattgtgggtaccacatctaccagcgggtggttcaaaaacactatcacaaataacttggagcatacctgtgagcacgtcacggtgaattgcggacaaaagtccgtaaaatttcatgcttgtttccgtcagcacagaggctgcataaggtttttcaagggcacttatatgccctactcaatgattgaagcaatgtgtgttaacatcgagctcattatcctgaccctgtatatctttgccgctattatattcgccctcatcattacaaagagttacgtggcgtatttactgcttcctttgttctacccagtcacttggttttacgggaaagtgtataagaaaatcaatagctgccccaactgtctgctagcatctcaccctttcacctcctgcccaaagatatgcatttgtggatcacggtttagctgcacagaagccctcaaagtgcatcgcatgggtaaggattgtctgggctacaaaagtctttctaaggctagacagatgtgcaagtccaaaagctggtcgttcaccgccgcaatcctgacggggttgatcctcatggagtttatttctcccatcgctggagagaggatgtataagctggaagagttagccgacgagttcattaaactgactgaacaggtcaacatactcgaacgggagatggaggttcttaagcaatccatcattgtgatgtttgcgatcatcctggtattgctactgttcgaaaatatgatttttaaccgcctcttctcaatattttaccgaagttgtagcatgtgcggcctgatccactatagacctggtcttaaaattgatctgacaaagaccaataagtgtgggtcctgcatctgtggattcaacgagcagcagtctagcggctttgaatacgagattttcttgaaagacatgcatatccagaaggaatcatgcaaattcagtccaagggtgaatcactttcggaacataaaggccctcctgttcgcattagtcatctgtgctactatttatacagtgtacgccgatgaggactgcctgtccaaagacatcaagattacctaccaagagctacacaattgcatcggcccgaagataatggggaacacgtgtgttagcaaaaatgaactctattctgatctgttttcaaagaaccttgtgaccgagtacgacaaaaagtatttcgaacccgatacagtcaatgaccagtttaacaaaattgagttcgctcaggatgcccatcgtatgatcttgctggaacgcattctctacaagactgagtgcgagatgctgagtcttaagaaaaatagcggaccttataacgtggcatggagaacctacctgaagaatcacaacatcgacttgtgttccaggcataactataaaatgatatgccagtgtatcaatacacactctatgtgcaagaacactgatattgactacaataaagaaatcgagacctactataagtcgaacgccgctgcgtaccgggcagatctcaatacaattatggacaccctgaaaactgcctttcgaggtttaacgaaggtactgatcgaaaactatatagagaaggatgacagcgacgctctaaaagccctcttctccaatattacagattcagttcaagacaactaccagatgatcggcatcctgaagtttgcaagtaaacttttggatattaatctggggcgctctaccagaagcgcccatcactccatcatgactaacgagattccaaagtcaaatcccttcaccgactatagctactctaacgtgaatataaaagaatgtatgtcccctgagagtctcaagtgctttaagaaaagggatagcacaccacacaccaaccatctgttatgtaagatcgactctaaatataaggctttcgattggcccgaaattgagactatccagaaaggacaaaagctgtgccttggcgactcccactgtaatttggaatttacagccattacggcagataagatcatgtcactcaccaactgctacaaagagagtttcactgcgcagccggctgacatgcagacaggtataaagaaatgcagcgccgatgagatcggggaatgtaccacactggaggacaagacttggcctattgtcttctgcggcggaaaatactattactcggattccaaggaacatgcaaaggacggctctatcaacaattattgtctaaccaacaaatgcagcgagcagcggtttcccattcacgaaaattggttcaagaaatgtaactgggacaagacgcacaaagagttttcaaccatgcgccaaatcaattacaacgatataacaagttatagaaaggccattgagtccgaaatcgggtctgacctgatgactcatcactacaaaccaaccaagaatctccctcatgtggtccccaggtatcacagcatcgatgtgcagggaacagagtccactgaaggtattataaacggcttcatccagaataccattccagctatctcagggctgggagttggctaccatcttaactttaagggtaatcagttgttcgacattgtgatctttgtcaaaaaggccgtatacaaagcacaatatcagaaggcttacacgacagggcccagcataagtatcaacattgagcacaatgaacgttgcaccggccactgtcctgagaaaatcccagccaaggagggatggctgactttctctaaggaacatacatccagctggggctgcgaggaatatgggtgtttagcgattgataccggatgcctctacggttcgtgtcaggacgtgatccggccggagctggatgtttataaaaagataggctcagaggtgtctcttattgaaatctgcatcactctgccccacgagacctactgcaacgacatggatattttggaacctatcataggggacaaactcagtgcctcctttcagaatacacaaacgaaccagctgccaaccctaattgcttataagaaaggaaagatctacactggccagattaacgatatcggtaatacagcactgcagtgtgggagcatacaagtcattaacggctctaccatcggaacaggcagccccaagttcgactacatctgccatgccatgcgaagaaaagatgtgattgtaaggaagtgttttaatgacaactatcagtcctgcactcgcctcgagaaacggaatgacctgatcccttacagaaagggggatgtgattgaagtttcaaaaaccggaagtaacatgggccagatgacgttcaagatagagcttggtgacgtcaattataagatcttcacaaaaagcattgatttgcaaatgtctgggatctgtgctggatgcatcgactgtgccgagggcatttcctgctcaataaacgcagaagtgccagcggagaccgtgtgtcactgcaagactaattgtgaagattttatcaacaatattgtcttcagtccccagatcaaaaactacaatattaaggttcattgcaaaagcaaggtggagaagatcatagcccacatctgcggtagggacattgatctgcagttaaccgtgaaaccgtataaccagaagatcgacctctcccaactggatgaatctaattacattcgcgaggaggaccttcagtgtggcacatggctgtgcaaagtacagaaggaaggggtcgatatcatatttaaaggactattctcgggcctcgggcgatattggactattctgatctacagcattatcggagtggttataatcgtgattttggtctacatcctgttacctattggccggctcctgaaggcttttcttatccgtcacgagatagaatatgccatggagcagaaaattaagtga

SEQ ID NO: 11046 - RNA, 4263 nt, synthetic construct
  misc_feature 1..4263: note = derived and/or modified CDS sequence (opt3) from OROV(BeH759040)__KP691616.1__GP
  source 1..4263: mol_type = other RNA
atggccaacctgatcattataagcatgatcctctccgtggcttacggccaccccctttctacctcacagattggggacagatgcttcgcaggaggtaatctgtttaaggagatgaacttgagtgtcggcttaggggaaatctgtgttaaagatgacattagcatcgtgaagtccacaactgtattctctaaaaataggcctgccctggaggcgacgaccaagttttatcggtcgttcatagtgaaagattggtcagaatgcaacccagtcctagacaagtttggaaatttcatggtgctcagcgttgatgacaacggccatatcatgccgaagatgtacacatgtcgcgctgcctgcgatattcgactgaataaagacaacgcagagatcattcttagttccactaagctgaatcactttgaaatcgtgggtaccacatctaccagcgggtggttcaaaaacactataacaaataacttggagcatacctgtgagcacgtcacggtgaattgcggacaaaagtccgtaaaatttcatgcctgtttccgtcagcacagaggctgcattaggtttttcaagggcacttatatgccctactcaatgatcgaagctatgtgtgttaacattgagctcatcatcctgaccctgtatatttttgcagccataatcttcgctctcattatcacaaagagttacgtggcctatttactgcttcctttgttctacccagtcacttggttttacgggaaagtgtataagaaaataaatagctgccccaactgtctgctagcgtctcaccctttcacctcctgcccaaagatttgcatctgtggatcacggtttagctgcacagaagcactcaaagtgcatcgcatgggtaaggattgtctgggctacaaaagtctttctaaggccagacagatgtgcaagtccaaaagctggtcgttcaccgctgccatcctgacggggttgattctcatggagtttatctctcccattgcaggagagaggatgtataagctggaagagttagctgacgagttcataaaactgactgaacaggtcaacatcctcgaacgggagatggaggttcttaagcaatccattatcgtgatgtttgccatcattctggtattgctactgttcgaaaatatgatatttaaccgcctcttctcaatcttttaccgaagttgtagcatgtgcggcctgattcactatagacctggtcttaaaatcgatctgacaaagaccaataagtgtgggtcctgcatttgtggattcaacgagcagcagtctagcggctttgaatacgagatcttcttgaaagacatgcatatacagaaggaatcatgcaaattcagtccaagggtgaatcactttcggaacatcaaggcgctcctgttcgccttagtcatttgtgcaactatctatacagtgtacgctgatgaggactgcctgtccaaagacattaagatcacctaccaagagctacacaattgcataggcccgaagattatggggaacacgtgtgttagcaaaaatgaactctattctgatctgttttcaaagaaccttgtgaccgagtacgacaaaaagtatttcgaacccgatacagtcaatgaccagtttaacaaaatcgagttcgcccaggatgctcatcgtatgattttgctggaacgcatcctctacaagactgagtgcgagatgctgagtcttaagaaaaatagcggaccttataacgtggcctggagaacctacctgaagaatcacaacatagacttgtgttccaggcataactataaaatgatctgccagtgtattaatacacactctatgtgcaagaacactgatatcgactacaataaagaaattgagacctactataagtcgaacgcagccgcttaccgggcggatctcaatacaatcatggacaccctgaaaactgcatttcgaggtttaacgaaggtactgatagaaaactatattgagaaggatgacagcgacgccctaaaagctctcttctccaatatcacagattcagttcaagacaactaccagatgatcggcattctgaagtttgccagtaaacttttggatatcaatctggggcgctctaccagaagcgcacatcactccattatgactaacgagataccaaagtcaaatcccttcaccgactatagctactctaacgtgaatatcaaagaatgtatgtcccctgagagtctcaagtgctttaagaaaagggatagcacaccacacaccaaccatctgttatgtaagattgactctaaatataaggccttcgattggcccgaaatcgagactattcagaaaggacaaaagctgtgccttggcgactcccactgtaatttggaatttacagctatcacggccgataagataatgtcactcaccaactgctacaaagagagtttcactgcacagccggcggacatgcagacaggtatcaagaaatgcagcgctgatgagattggggaatgtaccacactggaggacaagacttggcctatcgtcttctgcggcggaaaatactattactcggattccaaggaacatgccaaggacggctctattaacaattattgtctaaccaacaaatgcagcgagcagcggtttcccatccacgaaaattggttcaagaaatgtaactgggacaagacgcacaaagagttttcaaccatgcgccaaataaattacaacgatattacaagttatagaaaggcaatcgagtccgaaatcgggtctgacctgatgactcatcactacaaaccaaccaagaatctccctcatgtggtccccaggtatcacagcattgatgtgcagggaacagagtccactgaaggtataatcaacggcttcattcagaataccatcccagccatttcagggctgggagttggctaccatcttaactttaagggtaatcagttgttcgacatcgtgatatttgtcaaaaaggctgtatacaaagcccaatatcagaaggcatacacgacagggcccagcatcagtattaacatcgagcacaatgaacgttgcaccggccactgtcctgagaaaattccagctaaggagggatggctgactttctctaaggaacatacatccagctggggctgcgaggaatatgggtgtttagccatcgataccggatgcctctacggttcgtgtcaggacgtgatacggccggagctggatgtttataaaaagattggctcagaggtgtctcttatcgaaatctgcattactctgccccacgagacctactgcaacgacatggatatcttggaacctataattggggacaaactcagtgcgtcctttcagaatacacaaacgaaccagctgccaaccctaatcgcctataagaaaggaaagatttacactggccagatcaacgatataggtaatacagctctgcagtgtgggagcattcaagtcatcaacggctctaccatcggaacaggcagccccaagttcgactacatttgccatgcaatgcgaagaaaagatgtgatcgtaaggaagtgttttaatgacaactatcagtcctgcactcgcctcgagaaacggaatgacctgattccttacagaaagggggatgtgatagaagtttcaaaaaccggaagtaacatgggccagatgacgttcaagatcgagcttggtgacgtcaattataagattttcacaaaaagcatcgatttgcaaatgtctgggatctgtgccggatgcattgactgtgctgagggcatatcctgctcaatcaacgccgaagtgccagcagagaccgtgtgtcactgcaagactaattgtgaagattttattaacaatatcgtcttcagtccccagattaaaaactacaatatcaaggttcattgcaaaagcaaggtggagaagataatcgcgcacatttgcggtagggacatcgatctgcagttaaccgtgaaaccgtataaccagaagattgacctctcccaactggatgaatctaattacatccgcgaggaggaccttcagtgtggcacatggctgtgcaaagtacagaaggaaggggtcgatataatttttaaaggactattctcgggcctcgggcgatattggactatcctgatttacagcatcataggagtggttatcattgtgatcttggtctacattctgttacctatcggccggctcctgaaggcctttcttatacgtcacgagattgaatatgctatggagcagaaaatcaagtga

SEQ ID NO: 11047 - RNA, 4263 nt, synthetic construct
  misc_feature 1..4263: note = derived and/or modified CDS sequence (opt3) from OROV(BeH759146)__KP691631.1__GP
  source 1..4263: mol_type = other RNA
atggccaacctgatcattataagcatggtgctctccgtcgcttacggccaccccctttctacctcacagatcggggacagatgcttcgcaggaggtaatctgtttaaggagatgaacttgagtgttggcttaggggaaatttgtgtgaaagatgacatcagcattgtaaagtccacaactgtgttctctaaaaataggcctgccctggaggcgacgaccaagttttatcggtcgttcatcgtcaaagattggtcagaatgcaacccagtgctagacaagtttggaaatttcatggttctcagcgtggatgacaacggccatataatgccgaagatgtacacatgtcgcgctgcctgcgatatccgactgaataaagacaacgcagagattatccttagttccactaagctgaatcactttgaaattgtcggtaccacatctaccagcgggtggttcaaaaacactatcacaaataacttggagcatacctgtgagcacgtgacggtaaattgctgtcaaaagtccgttaaatttcatgcctgcttccgtcagcacagaggatgtataaggtttttcaagggcacttatatgccctactcaatgattgaagctatgtgcgtgaacatcgagctcattatcctgaccctgtatatctttgcagccattatattcgctctcatcattacaaagagttacgtcgcctatttactgcttcctttgttctacccagtgacttggttttacggcaaagtgtataagaaaatcaatagctgtcccaactgcctgctagcgtctcaccctttcacctcctgcccaaagatatgtatttgcgggtcacggtttagctgtacagaagcactcaaagtccatcgcatgggaaaggattgcctgggttacaaaagtctttctaaggccagacagatgtgtaagtccaaaagctggtcgttcaccgctgccatcctgacgggcttgatcctcatggagtttatttctcccatcgcaggggagaggatgtataagctggaagagttagctgacgagttcattaaactgactgaacaggttaacatactcgaacgggagatggaggtgcttaagcaatccatcattgtaatgtttgccatcatcctggtgttgctactgttcgaaaatatgatttttaaccgcctcttctcaatattttaccgaagttgcagcatgtgtggactgatccactatagacctggccttaaaattgatctgacaaagaccaataagtgcggttcctgtatctgcgggttcaacgagcagcagtctagcggatttgaatacgagattttcttgaaagacatgcatatccagaaggaatcatgtaaattcagtccaagggtcaatcactttcggaacataaaggcgctcctgttcgccttagtgatctgcgcaactatttatacagtttacgctgatgaggactgcctgtccaaagacatcaagattacctaccaagagctacacaattgtatcggcccgaagataatgggcaacacgtgcgtgagcaaaaatgaactctattctgatctgttttcaaagaaccttgtcaccgagtacgacaaaaagtatttcgaacccgatacagtgaatgaccagtttaacaaaattgagttcgcccaggatgctcatcgtatgatcttgctggaacgcattctctacaagactgagtgtgagatgctgagtcttaagaaaaatagcgggccttataacgtagcctggagaacctacctgaagaatcacaacatcgacttgtgctccaggcataactataaaatgatatgtcagtgcatcaatacacactctatgtgtaagaacactgatattgactacaataaagaaatcgagacctactataagtcgaacgcagccgcttaccgggcggatctcaatattatcatggacacactgaaaaccgcatttcgaggattaactaaggttctgatagaaaactatattgagaaggatgacagcgacgccctaaaagctctcttctccaatatcacggattcagtgcaagacaactaccagatgatcggtattctgaagtttgccagtaaacttttggatatcaatctgggccgctctacaagaagcgcacatcactccattatgaccaacgagataccaaagtcaaatcccttcactgactatagctactctaacgtcaatatcaaagaatgcatgtcccctgagagtctcaagtgttttaagaaaagggatagcaccccacacacaaaccatctgttatgcaagattgactctaaatataaggccttcgattggcccgaaatcgagaccattcagaaagggcaaaagctgtgtcttggagactcccactgcaatttggaatttactgctatcacagccgataagataatgtcactcacgaactgctacaaagagagtttcaccgcacagccggcggacatgcagactggcatcaagaaatgtagcgctgatgagattggtgaatgcacaaccctggaggacaagacatggcctatcgtgttctgtgggggcaaatactattactcggattccaaggaacatgccaaggacggatctattaacaattattgcctaactaacaaatgtagcgagcagcggtttcccatccacgaaaattggttcaagaaatgcaactgggacaagacccacaaagagttttcaacgatgcgccaaataaattacaacgatattaccagttatagaaaggcaatcgagtccgaaatcggctctgacctgatgacacatcactacaaaccaactaagaatctccctcatgtcgtgcccaggtatcacagcattgatgttcaggggaccgagtccacagaaggaataatcaacggtttcattcagaatactatcccagccatttcaggcctgggggtgggataccatcttaactttaagggcaatcagttgttcgacatcgtaatatttgtcaaaaaggctgtgtacaaagcccaatatcagaaggcatacaccacgggtcccagcatcagtattaacatcgagcacaatgaacgttgtacagggcactgccctgagaaaattccagctaaggagggctggctgaccttctctaaggaacatacttccagctggggatgtgaggaatatgtttgcttagccatcgatacaggctgtctctacgggtcgtgccaggacgtgatacggccggagctggatgtctataaaaagattggatcagaggtgtctcttatcgaaatctgcattaccctgccccacgagacttactgtaacgacatggatatcttggaacctataattggtgacaaactcagtgcgtcctttcagaatacccaaacaaaccagctgccaacgctaatcgcctataagaaaggcaagatttacaccgggcagatcaacgatataggaaatactgctctgcagtgcggcagcattcaagtaatcaacggttctacaatcgggaccggcagccccaagttcgactacatttgtcatgcaatgcgaagaaaagatgtgatcgttaggaagtgctttaatgacaactatcagtcctgtacacgcctcgagaaacggaatgacctgattccttacagaaagggagatgtcatagaagtgtcaaaaactggcagtaacatggggcagatgaccttcaagatcgagcttggagacgtgaattataagattttcacgaaaagcatcgatttgcaaatgtctggcatctgcgccggttgtattgactgcgctgaggggatatcctgttcaatcaacgccgaagtcccagcagagacagtttgccactgtaagaccaattgcgaagattttattaacaatatcgtgttcagtccccagattaaaaactacaatatcaaggtgcattgcaaaagcaaggtagagaagataatcgcgcacatttgtggaagggacatcgatctgcagttaactgtcaaaccgtataaccagaagattgacctctcccaactggatgaatctaattacatccgcgaggaggaccttcagtgcggcacctggctgtgtaaagtgcagaaggaaggtgttgatataatttttaaaggcctattctcggggctcggacgatattggacaatcctgatttacagcatcataggcgtggtcatcattgtgatcttggtttacattctgttacctatcgggcggctcctgaaggcctttcttatacgtcacgagattgaatatgctatggagcagaaaatcaagtga

SEQ ID NO: 11048 - RNA, 4263 nt, synthetic construct
  misc_feature 1..4263: note = derived and/or modified CDS sequence (opt3) from OROV(BeH759620)__KP691622.1__GP
  source 1..4263: mol_type = other RNA
atggccaacctgatcattataagcatggtgctctccgtcgcttacggccaccccctttctacctcacagatcggggacagatgcttcgcaggaggtaatctgtttaaggagatgaacttgagtgttggcttaggggaaatttgtgtgaaagatgacatcagcattgtaaagtccacaactgtgttctctaaaaataggcctgccctggaggcgacgaccaagttttatcggtcgttcatcgtcaaagattggtcagaatgcaacccagtgctagacaagtttggaaatttcatggttctcagcgtggatgacaacggccatataatgccgaagatgtacacatgtcgcgctgcctgcgatatccgactgaataaagacaacgcagagattatccttagttccactaagctgaatcactttgaaattgtcggtaccacatctaccagcgggtggttcaaaaacactatcacaaataacttggagcatacctgtgagcacgtgacggtaaattgcggacaaaagtccataaaatttcatgcctgtttccgtcagcacagaggctgcattaggtttttcaagggcacttatatgccctactcaatgatcgaagctatgtgtgttaacattgagctcatcatcctgaccctgtatatttttgcagccataatcttcgctctcattatcacaaagagttacgtggcctatttactgcttcctttgttctacccagtcacttggttttacgggaaagtgtataagaaaataaatagctgccccaactgtctgctagcgtctcaccctttcacctcctgcccaaagatttgcatctgtggatcacggtttagctgcacagaagcactcaaagtgcatcgcatgggtaaggattgtctgggctacaaaagtctttctaaggccagacagatgtgcaagtccaaaagctggtcgttcaccgctgccatcctgacggggttgattctcatggagtttatctctcccattgcaggagagaggatgtataagctggaagagttagctgacgagttcataaaactgactgaacaggtcaacatcctcgaacgggagatggaggttcttaagcaatccattatcgtgatgtttgccatcattctggtattgctactgttcgaaaatatgatatttaaccgcctcttctcaatcttttaccgaagttgtagcatgtgcggcctgattcactatagacctggtcttaaaatcgatctgacaaagaccaataagtgtgggtcctgcatttgtggattcaacgagcagcagtctagcggctttgaatacgagatcttcttgaaagacatgcatatacagaaggaatcatgcaaattcagtccaagggtgaatcactttcggaacatcaaggcgctcctgttcgccttagtcatttgtgcaactatctatacagtgtacgctgatgaggactgcctgtccaaagacattaagatcacctaccaagagctacacaattgcataggcccgaagattatggggaacacgtgtgttagcaaaaatgaactctattctgatctgttttcaaagaaccttgtgaccgagtacgacaaaaagtatttcgaacccgatacagtcaatgaccagtttaacaaaatcgagttcgcccaggatagtcatcgtatgattttgctggaacgcatcctctacaagactgagtgcgagatgctgagccttaagaaaaattccggaccttataacgtggcttggagaacctacctgaagaatcacaacatagacttgtgttctaggcataactataaaatgatctgccagtgtattaatacacactcgatgtgcaagaacactgatatcgactacaataaagaaattgagacctactataagagcaacgccgcagcctaccgggctgatctcaatacaatcatggacaccctgaaaactgcgtttcgaggtttaacgaaggtactgatagaaaactatattgagaaggatgactccgacgcactaaaagccctcttctcaaatatcacagatagtgttcaagacaactaccagatgatcggcattctgaagtttgcttctaaacttttggatatcaatctggggcgcagcaccagatccgcccatcactcaattatgactaacgagataccaaagagcaatcccttcaccgactattcttactccaacgtgaatatcaaagaatgtatgagtcctgagagcctcaagtgctttaagaaaagggattctacaccacacaccaaccatctgttatgtaagattgactccaaatataaggcattcgattggcccgaaatcgagactattcagaaaggacaaaagctgtgccttggcgactcacactgtaatttggaatttacagccatcacggctgataagataatgagtctcaccaactgctacaaagagagcttcactgcccagccggcagacatgcagacaggtatcaagaaatgctcggcggatgagattggggaatgtaccacactggaggacaagacttggcctatcgtcttctgcggcggaaaatactattactccgattctaaggaacatgctaaggacggcagcattaacaattattgtctaaccaacaaatgctcagagcagcggtttcccatccacgaaaattggttcaagaaatgtaactgggacaagacgcacaaagagtttagtaccatgcgccaaataaattacaacgatattacatcctatagaaaggccatcgagtctgaaatcgggagcgacctgatgactcatcactacaaaccaaccaagaatctccctcatgtggtccccaggtatcactccattgatgtgcagggaacagagtcaactgaaggtataatcaacggcttcattcagaataccatcccagcaattagcgggctgggagttggctaccatcttaactttaagggtaatcagttgttcgacatcgtgatatttgtcaaaaaggccgtatacaaagctcaatatcagaaggcctacacgacagggcccagtatctctattaacatcgagcacaatgaacgttgcaccggccactgtcctgagaaaattccagcaaaggagggatggctgactttctccaaggaacatacaagctcgtggggctgcgaggaatatgggtgtttagctatcgataccggatgcctctacggttcatgtcaggacgtgatacggccggagctggatgtttataaaaagattggctctgaggtgagtcttatcgaaatctgcattactctgccccacgagacctactgcaacgacatggatatcttggaacctataattggggacaaactctccgccagctttcagaatacacaaacgaaccagctgccaaccctaatcgcgtataagaaaggaaagatttacactggccagatcaacgatataggtaatacagccctgcagtgtgggtctattcaagtcatcaacggcagcaccatcggaacaggctcccccaagttcgactacatttgccatgctatgcgaagaaaagatgtgatcgtaaggaagtgttttaatgacaactatcagtcatgcactcgcctcgagaaacggaatgacctgattccttacagaaagggggatgtgatagaagttagtaaaaccggaagcaacatgggccagatgacgttcaagatcgagcttggtgacgtcaattataagattttcacaaaatctatcgatttgcaaatgtccgggatctgtgcaggatgcattgactgtgccgagggcatatcatgcagtatcaacgctgaagtgccagccgagaccgtgtgtcactgcaagactaattgtgaagattttattaacaatatcgtcttcagcccccagattaaaaactacaatatcaaggttcattgcaaatccaaggtggagaagataatcgcacacatttgcggtagggacatcgatctgcagttaaccgtgaaaccgtataaccagaagattgacctctctcaactggatgaatcgaattacatccgcgaggaggaccttcagtgtggcacatggctgtgcaaagtacagaaggaaggggtcgatataatttttaaaggactattcagcggcctcgggcgatattggactatcctgatttactcaatcataggagtggttatcattgtgatcttggtctacattctgttacctatcggccggctcctgaaggcgtttcttatacgtcacgagattgaatatgccatggagcagaaaatcaagtga

SEQ ID NO: 11049 - RNA, 4263 nt, synthetic construct
  misc_feature 1..4263: note = derived and/or modified CDS sequence (opt3) from OROV(BeAn19991)__KP052851.1__GP
  source 1..4263: mol_type = other RNA
atggccaacctgatcattataagcatggtgctcggcgtcgcttacgggcaccccctttccacctctcagatcggagacagatgcttcgccggtggcaatctgtttaaggagatgaacttgtcagttgggttaggagaaatttgtgtgaaagatgacatcagtattgtaaagagcacaactgtgttctccaaaaataagcctgcactggaggcgacgaccaaattttataggtctttcatcgtcaaggattggtcggaatgcaacccagtgctagacaagtttggcaatttcatggttctctcagtggatgacaacggtcatataatcccgaaaatgtacacatgtcgggctgcctgcgatattcgcctgaataaggacaacgcagagatcattcttagcagtactaaactgaatcactttgaaatcgtcgggaccacatccacctctggatggttcaagaacactataacaaataacttggagcatacctgtgagcacgtgacggtaaattgcggccagaaaagcgttaagtttcatgcctgtttccgacaacaccgtggctgcattagatttttcaaggggacttatatgccctactccatgatcgaagctatgtgtgtgaacattgagctcatcatcctgaccctgtatatttttgcagccataatcttcgctctcattatcacaaaatcatacgtcgcctatttactgcttcctttgttctacccagtgacttggttttacggaaaggtgtataaaaagataaatagttgccccaactgtctgctagcgagccaccctttcacctcttgcccaaaaatttgcatctgtggttccaggttttcatgcacagaagcactcaaggtccatcggatgggcaaagattgtctggggtacaagagccttagtaaggcccgccagatgtgcaaatctaagtcctggagcttcaccgctgccatcctgacgggattgattctcatggagtttatctcgcccattgcaggcgagagaatgtataaactggaagagttagctgacgagttcataaagctgactgaacaggttaacatcctcgaaagggagatggaggtgcttaaacaatctattatcgtaatgtttgccatcattctggtgttgctactgttcgaaaatatgatatttaacagactcttccgcatcttttaccgatcctgttcaatgtgcggtctgattcactatagacctgggcttaagatcgatctgacaaagaccaataggtgtggaagttgcatttgtggcttcgacgagcagcagagctccggctttgaatacgagatcttcttgaaagatatgcatgtccagaaggaatcttgcaaattcagcccacgggtgaaccactttcgtaatataaaggcgctcctgttcgccttagttatctgtgcaactatttatacagtgtacgctgacgaggactgcctgtcaaaagatatcaagattacctaccaagagctacacaactgcatcgggccgaagataatgggagacacgtgtgtcagtaaatccgaactctatagcgatctgttttctaagaatcttgtgaccgagtacgacaaaaagtatttcgaacccgatacagtaaacgaccagtttaataaaattgagttcgcccaggatgctcatcgcatgatcttgctggaacggattctctacaagactgagtgcgagatgctgtcacttaagaaaaacagtggtccttataatgttgcctggaggacctactttaagaaccacaatatcgacctgtgtagccggcataactataaaatgatatgccagtgtatcaatacacactccatgtgcaagaacactgatattgactacaacaaagaaatcgagacctactataagtctaatgcagccgcttaccgagcggatttgaacacaattatggacaccctcaaaactgcattccgcggcctgacgaaggtgttaatcgaaaattatatagagaaggacgattcggacgccctgaaagctctatttagcaacattacagattccgtccaagacaattaccagatgatcgggatcctcaagttcgcctcaaaactgcttgatattaacttgggaagaagtaccaggtctgcacatcacagcatcatgactaatgagattccaaagtccaacccctttaccgactattcatacagcaatctgaacataaaagaatgtatgtctcctgagtccctcaagtgcttcaagaaacgggatagtacaccacacaccaatcatctgttatgtaagatcgacaacaaatataaggcctttgattggcccgaaattgagactatccagaaaggccaaaagctgtgccttggtgacagccactgtaatttggagttcacagctattacggccgataagatcatgtctctcaccaactgctacaaagaatccttcactgcacagccggcggacatgcaggctgggataaagaaatgctcagccgatgagatcggcgaatgtacaaccctggaggacaagacatggcctattatcttttgcggaggcaaatactattacagtgacagcaaggaacatgcaaaggatgggtcgattaataactattgtctaactaacaaatgctccgagcagcgcttccccatccacgaaaattggtttaagaaatgtaactgggacaagacccacaaagagttctctacgatgagacaaataaattacaacgatattaccagctataggaaggccatcgagtcagaaatcggaacagacctgatgactcatcactacaaaccaaccaagaatctccctcatgtggtcccccgttatcacagtattgatgtgcagggtacagagtccactgaaggcataatcaacgggtttattcagaataccatcccagctatttctggactgggcgttggttaccatcttaacttcaaggggaatcagttgtttgacatcgtgatattcgtcaaaaaggccgtatacaaagcacaatatcagaaggcttacacgacaggccccagcatctccattaacatcgagcacaatgaacggtgcaccggacactgtcctgagaaaattccagccaaggagggctggctgactttttcaaaggaacatacaagcagttgggggtgcgaggaatatggatgtttagcgatcgataccggttgcctctacggctcttgtcaggacgtgatacgaccggagctggatgtttataaaaagattgggtccgaggtgagccttatcgaaatctgcattactctgccccacgagacctactgcaacgacatggatatcttggaacctataattggagacaaactctcggcctcattccagaatacacaaacgaaccagctgccaaccctaatcgcttataagaaaggcaagatttacactggtcagatcaatgatatagggaacacagcactgcagtgtggctctattcaagtcatcaacggaagtaccatcggcacagggtcccccaagtttgactacatttgccatgccatgagaaggaaagacgtgatcgtacgcaagtgtttcaatgataactatcagagctgcactcggctcgagaaaagaaatgacctgattccttacaggaagggagatgtgatagaagtttctaaaaccggcagcaacatgggtcagatgacgttcaagatcgagcttggggacattaattataagatctttacaaaatccatcgatttgcaaatgtcaggaatttgtgctggctgcatagactgtgccgagggtatcagttgcagcattaacgcagaagtcccagcggagaccgtgtgtcactgcaagactaattgtgaagatttcatcaacaatattgtgttttctccccagatcaaaaactacaatataaaggtccattgcaaatccaaggttgagaagatcaccgcccacatttgcggccgcgacatcgatctgcagttaacaattaaaccgtataaccagaagatcgacctctcacaactggatgaaagtaattacatacgagaggaggaccttcagtgtgggacttggctgtgcaaagtgcagaaggaaggaattgacatcattttcaaaggcctatttagcgggctcggacggtattggaccatcctgatatactccatcattggcgtggtaatcattgtcatcttggtgtacatactgttacctattggtcgtctcctgaaggctttccttatcagacacgagatcgaatatgccatggagcagaaaattaagtga

SEQ ID NO: 11050 - RNA, 4263 nt, synthetic construct
  misc_feature 1..4263: note = derived and/or modified CDS sequence (opt3) from OROV(Tr9760)__AF312381.2__GP
  source 1..4263: mol_type = other RNA
atggccaacctgatcattataagcatggtgctctccatcgcttacggccaccccctttctacctcacagattggggacagatgcttcgcaggaggtaatctgtttaaggagatgaacttgagtgtcggcttaggggaaatctgtgttaaagatgacattagcatcgtgaagtccacaactgtattctctaaaaataagctggccctagaggcgacgaccaaattttataggtcgttcatagtgaaggattggtcagaatgcaaccctgtcctcgacaagtttggaaatttcatggtgctgagcgttgatgacaacggccatacaatcccaaaaatgtacacttgtcgggctgcctgcgatattcgccttaataaggacaacgcagagatcattctgagttccaccaaattgaatcactttgaaatcgtgggtacaacctctactagcgggtggttcaagaacacaataaccaataacctcgagcatacgtgtgagcacgtcactgtgaattgcggacaaaaatccgtaaagtttcatgcctgtttccgacagcaccgtggctgcgttagatttttcaagggcacctatatgccgcactcaatgattgaagctatgtgtgtgaacatcgagctgattatcctgacactctacatctttgcagccattatattcgctttaatcattactaaaagttatgtcgcctacctgcttttgcccctgttctatcctgcgacctggttttacgggaaggtgtacaaaaagatcaatagctgcccaaactgtctactcgcatctcatcccttcacatcctgccctaaaatatgcatttgtggatcaaggtttagctgcaccgaagccctgaaggtgcaccggatgggtaaagattgtcttggctataagagtctgtctaaggctcgccagatgtgcaaatccaagagctggtcgttcacggccgcaatcttgactgggctcatcctgatggagtttatttctccaatcgctggagagagaatgtacaaattagaggaactggccgacgagttcattaagctcacagaacaggtcaacatacttgaaagggagatggaggttctgaaacaatccatcattgtgatgtttgcgatcatcttggtactactcctgttcgaaaatatgatttttaaccggctgttccgcatattttatcgatcatgtagtatgtgcggccttatccattacagacccggtctgaagattgatttgaccaagactaataggtgtgggagctgcatctgtggattcgacgagcagcagtcctctggctttgaatatgagattttcctcacagatatgcacgtgcagaaagaaagctgcaagttctcacctcgggtcaaccactttcgtaataccaaagccctgttattcgcactggtgatctgtgctacgatatacaccgtttatgccgacgaggactgcctaagtaaggatatcaaaattacataccaagagctccataactgcatcggcccaaagattatgggggacacttgtgtgtccaagagcgaactgtactctgatctttttagtaaaaatttggtcaccgagtatgacaagaaatacttcgaaccggatacagtgaacgaccagtttaataagatcgagttcgctcaggatgcccaccgcatgatactgctcgaaaggattctgtataaaactgagtgcgagatgcttagtctgaagaagaacagcggaccctacaatgtagcatggagaacccatttgaaaaaccacaatatcgacctctgttcccggcataactataagatgatttgccagtgtatcaatgcccactctatgtgcaaaaacacagatatagactacaacaaggaaatcgagacctattacaaatcgaatgctgcggcataccgagccggtctgaacactattatggatacgttaaagacagcttttcgcggcctgaccaaagttctaatcgaaaattatattgagaaggacgacagcgatgccctcaaggcactgttctccaacatcactgactcagtgcaagataattaccagatgatagggattcttaaatttgccagtaagttgctggacatcaacctcggaagatctaccaggagcgctcaccattccatcatgacaaatgagattcctaaatcaaacccattcaccgattatagctactctaatgtcaacatcaaggaatgtatgtcccccgagagtctgaaatgctttaagaagcgggacagcactcctcacacaaatcatttactgtgtaaaattgataacaagtataaagccttcgactggccagaaatagagacgatccagaagggccaaaaactttgcttgggtgattctcactgtaatctcgaatttaccgcaattactgcggaccgcatcatgtccctgacaaactgctacaaggagtcattcaccgctcagcccgccgatatgcaggcagggattaagaaatgcagtgccgacgagatcggcgaatgtacaactctagaggataagacctggccgatagtgttctgcagcggaaaatattactactcggactccaaggaacacgctaaagacggctctatcaataactattgtctgacgaacaagtgcagcgagcagagatttcctattcatgaaaattggttcaagaaatgtaactgggataagacccacaaagagtttaggccctacgagacaaataactataatgacatcacttcataccgtaaggccattgaaagtgagatcgggaccgatctcatgacacatcactataaaccaactaagaacctgcctcatgtcgtgccccggtaccactccatagacgttcaaggaaccgaatctacggagggtattatcaatggcttcatccagaacacaattccagcaataagcgggcttgatgtgggatatcacttgaattttaaaggcaaccagctgttcgacatcgtaatttttgtcaagaaggctgtgtacaaagcccagtaccaaaaggcgtataccactggtccctccatctcaattaatatcgaacataacgagcgatgcacagggcactgtcctgagaaaataccagccaaggaaggctggttaaccttcagcaaagagcatacttcatcttggggatgcgaagagtacggctgtctcgctatcgataccgggtgcctgtatggatcctgtcaggacgttattagaccggagcttgatgtgtacaagaagatcggtagcgaagcatcgctgattgagatctgcataacattgccccacgaaacgtattgcaatgacatggatattctcgagcctatcatcggcgacaaactgtcagcctcttttcagaacacccagactaatcaactaccaacactgattgcttacaagaaagggaagatctataccggacagataaacgatattggcaacacagccctccagtgtggtagtatccaggtcattaatgggtccactatcggcaccggaagccccaaattcgactacatatgccatgcaatgaggcgcaaggacgtgattgtacggaagtgttttaacgataattaccaatcttgcacgagactggagaaaaggaacgaccttatcccttatcgcaagggcgatgtgatcgaagttagcaaaacagggtccaatatgggacagatgaccttcaagattgagttgggcgacatcaactacaaaattttcactaagtcagtcgatctgcagatgagtggtatatgtgcggggtgcatcgactgtgccgaaggaattagctgctctatcaatgctgaggtgccagccgaaaccgtgtgtcactgcaagacaaactgtgaggattttatcaataacattgtcttctcaccccaaatcaaaaattataacataaaggttcactgcaaatccaaggtggagaaaattactgcacatatctgcggccgagacattgatttacagctcaccgtgaagccgtacaatcagaagatcgacctgagtcagcttgatgaaagcaactatatacgggaggaagacctgcaatgtggtacatggctatgcaaagtacagaaggagggcatcgacattatgtttaaaggactcttctccgggctgggccgttactggacgatcttgatttattctatcataggggtcgtgattatcgttattctggtgtacatcttactccctataggaagactgcttaaggcttttctgatcaggcacgaaattgagtacgccatggaacagaaaatcaagtga

SEQ ID NO: 11051 - RNA, 4263 nt, synthetic construct
  misc_feature 1..4263: note = derived and/or modified CDS sequence (opt3) from OROV(TRVL-9760)__KC759123.1__GP
  source 1..4263: mol_type = other RNA
atggccaacctgatcattataagcatggtgctctccatcgcttacggccaccccctttctacctcacagattggggacagatgcttcgcaggaggtaatctgtttaaggagatgaacttgagtgtcggcttaggggaaatctgtgttaaagatgacattagcatcgtgaagtccacaactgtattctctaaaaataagctggccctagaggcgacgaccaaattttataggtcgttcatagtgaaggattggtcagaatgcaaccctgtcctcgacaagtttggaaatttcatggtgctgagcgttgatgacaacggccatatcattccaaaaatgtacacatgtcgggctgcctgcgatatccgccttaataaggacaacgcagagattatcctgagttccactaaattgaatcactttgaaatagtgggtaccacatctaccagcgggtggttcaagaacactattacaaataacctcgagcatacctgtgagcacgtcacggtgaattgcggacaaaaatccgtaaagtttcatgcctgtttccgacagcaccgtggctgcatcagatttttcaagggcacttatatgccgtactcaatgattgaagctatgtgtgttaacatcgagctgatcattctgaccctctatatatttgcagccatcattttcgctttaatcataacaaaaagttacgtggcctatctgcttttgcccctgttctaccctgcgacttggttttacgggaaggtctataaaaagattaatagctgcccaaactgtctactcgcatctcaccccttcacctcctgccctaaaatctgcatctgtggatcaaggtttagctgcacagaagccctgaaggtgcatcggatgggtaaagattgtcttggctacaagagtctgtctaaggctcgccagatgtgcaaatccaagagctggtcgttcaccgccgcaattttgacggggctcatcctgatggagtttatttctccaatagctggagagagaatgtataaattagaggagctggccgcggaatttatcaagctcactgaacaggtgaacattcttgaaagggagatggaggtcctgaaacaatccatcatcgttatgtttgccattatattggtgctacttctcttcgaaaatatgatctttaaccggctgttccgcattttctaccgatcatgtagtatgtgcggccttatccactatagacccggtctgaagattgacttgacaaagaccaataggtgtgggagctgcatctgtggattcgatgagcagcagtcctctggctttgaatacgagatattcctcaaagacatgcatgtacagaaggaaagctgcaaattctcacctcgggtgaaccactttcgtaatactaaggcactgttattcgctctggtcatctgtgccacaatttataccgtgtacgctgatgaggactgcctaagtaaagacatcaagattacgtaccaagagctccacaactgcatcggcccaaagataatgggggatacctgtgtttccaaaagcgaactgtattctgacctgttttcaaagaatttggtgacagagtacgataaaaagtatttcgaaccggacactgtcaacgatcagtttaataaaattgagttcgcccaggacgcacatcgcatgatcctgctcgaaaggattctgtacaagaccgagtgcgagatgcttagtctgaagaaaaacagcggaccctataatgtggcctggagaacatacttgaagaaccacaatatcgatctctgttcccggcataactataaaatgatatgccagtgtatcaatgctcactctatgtgcaagaacactgacattgattacaacaaagaaatcgagacctactataagtcgaatgcggcagcctaccgagctgacctgaacacaattatggataccttaaaaactgcctttcgcggtctgacgaaggtactaatcgaaaattatatagagaaggacgacagcgatgcactcaaagccctgttctccaacattacagactcagttcaagataattaccagatgatcggcatccttaagtttgctagtaaattgctggacattaacctcgggagatctaccaggagcgcccatcactccatcatgactaatgagattcctaagtcaaacccattcaccgattatagctactctaatgtgaacataaaagaatgtatgtcccccgagagtctgaagtgctttaagaaacgggacagcacacctcacaccaatcatttactgtgtaagatcgataacaaatataaggcattcgactggccagaaattgagactatccagaaaggacaaaaactttgcttgggcgattctcactgtaatctcgaatttacagcgattacggctgaccgcatcatgtccctgaccaactgctacaaggagtcattcactgcccagcccgcagatatgcaggccggtataaagaagtgcagtgctgacgagatcggggaatgtacaaccctagaggataaaacatggccgattgtcttctgcagcggcaagtactattactcggactccaaagaacatgccaaggacggatctatcaataactattgtctgactaacaagtgcagcgagcagagatttcctattcacgaaaattggttcaaaaagtgtaactgggataaaacccacaaggagttttcaacgatgaggcaaatcaattacaacgacataaccagttatcgtaaagcaattgagtccgaaatcggcacagatctcatgactcatcactacaagcccaccaaaaatctgccacatgtggtccctcggtatcactctatcgacgtgcaggggacagagagcactgaaggaattataaacggtttcatccagaataccattcccgctatctccggccttggggttggataccatttgaactttaagggcaatcagctgttcgatattgtgatctttgtaaagaaagccgtctacaaggcgcaatatcagaaagcctacacgacaggtccatcaataagcatcaacattgagcacaatgaacgatgcaccgggcactgtcccgagaagatccctgctaaagagggctggttaactttcagtaaggaacatacatcttcctggggatgcgaggaatatggctgtctcgcaattgacaccgggtgcctgtacggaagctgtcaggatgtgatcagaccagagcttgacgtttataagaaaataggttcggaggcctcactgattgaaatctgcatcactttgccgcacgagacctactgcaacgatatggacattctcgaacccatcataggcgataagctgtctgctagttttcagaatacacaaacgaaccagctacctaccctgattgcctataaaaaggggaaaatctacactggacagattaatgacatcggcaacacagcactccagtgtggttccatacaagtgattaacgggagcaccatcggcacaggatctccaaagttcgattacatctgccatgcgatgaggcgcaaggacgtcattgtgcggaaatgttttaatgacaactatcagagctgcactagactggagaagaggaatgatcttatcccctaccgcaaaggcgacgtaattgaagtgtccaagaccgggtcaaacatgggacagatgacgttcaaaatagagttgggcgatatcaattataagattttcacaaagagtgttgacctgcaaatgagcggtatctgtgccgggtgcatcgattgtgctgagggaatttcttgctccataaacgccgaagtccctgcagagaccgtgtgtcactgcaaaactaattgtgaagactttatcaacaatattgtgttctcaccacagatcaagaactacaatattaaagtccattgcaagagtaaagttgagaagatcaccgctcacatatgcggccgagatatcgacttacagctcacagtgaagccctataaccagaaaattgatctgagccaacttgacgaatccaattacatccgggaggaggatctgcagtgtggtacttggctatgcaaggtgcagaaagaaggcattgacatcatgtttaagggactcttctctgggctgggccgttattggaccatattgatttactcgatcattggggtagtcatcatagtgatcctggtttacattttactcccgatcggaagactgcttaaagcctttctgattaggcacgagatcgaatatgcaatggagcagaagataaaatga

SEQ ID NO: 11052 - RNA, 4263 nt, synthetic construct
  misc_feature 1..4263: note = derived and/or modified CDS sequence (opt3) from OROV(TVP-19244/DEI-216)__KP795073.1__GP
  source 1..4263: mol_type = other RNA
atggccaacctgatcattataagcatgatcctcggcattgcttacgggcaccccctttccacctctcagatcggagacagatgcttcgctggtggcattctgtttaaggagatgaatttgtcagtggggttaggagaaatctgtgtcaaagatgacataagtatcgttaagagcacaactgccttctccaaaaacgcgctggctctagaggccacgaccaagttttataggtctttcattgtgaaagattggtcggaatgcaatcctgtactcgacaagtttggcaacttcatggtgctgaatgtcgatgacaacggtcatcttgtgccaaagatgtacacatgtcgggcagcctgcgatatccgcctgaataaagacaacgctgagattatcttgtcaagcactaagctcaatcactttgaaatagttgggaccacaagtacctccggatggttcaaaaacactattacaaataacctggagcatacctgtgagcacgtgacggtcaattgcggccaaaagtctgtgaaatttcatgcatgtttccgacagcaccgtggctgcatcagatttttcaaggggacttatatgccgtacagcatgattgaagccatgtgtgtaaacatcgagctgatcattctcaccttatatatatttgctgccatcattttcgcgctgatcataacaaagtcctacattgcatatcttttgctgcccctattctaccctgttacttggctctacggaaaagtgtataagaggatcaattcatgcccaaactgtctgcttgccagtcacccctttaccagctgccctaaaatctgcatttgtggttctcggttctcctgcacagaagctctgaaggtccatcgcatgggcaaagattgtttggggtacaagtcactcagcaaagccagacagatgtgcaagagtaagtcttggtcctttaccgcagctatcctgacgggattaattctgatggagttcgtgagcccaatagccggcgagaggatgtataaactcgaagaacttgcggacgattacatcgaactgactgaacaggtgaacattttgggtaaggaaatcaaaatcctaaagcaatcgattatagtcatgctggccatcattctcatcctgcttctgtctgagaatattatctttaactatttgttctccacactctaccggtcatgtagtatgtgcgggctgatacactatcgccccggattaaaagttgacagcaccaagactaataagtgtggctcctgcatctgtggctttgatgagcagcagtctagcgggttcgaatacgaggtgtttctgaaagacatgcatgtacagcgagaatcatgcaagttcggacctagagtgaaccactttaggaatacaaaaattctactcttcaccgtcgcaatctgtacgagtttttacaccgtgtatgctgacgaggattgcctgtccaagaacattcggatcacataccaagaacttcacaattgcataggtccacatattatgggcgacacttgtatgagcaaatctgagttgtattcagatctgctcagtaagaacctgatcaccgagtacgacaagaaatatttcgaaccggatacagttaatgaccagttcaacaagattgagtttgcccaggatgctcaccgtatgatccttctggaacgcatattgtacaaaactgagtgcgaaatgctcagcctgaagaaaaattccgggccctataacgtggcctggagaacctacttaaagaatcataacatcgacctgtgttctaggcacaattacaagatgatttgccagtgtatcaacacacattcgatgtgcaaaaacaccgatattgacttcaataaggagatcgagacttattacaaagcaaacgccgctgcgtatcggagcgattttaatacgataattgacacactaaagaccgcattccgaggactcactaaagtcctgatcgaaaactacatcgagaaggacgattccgacgcccttaaagcattgttttcaaatattaccgatagtgtgcaagacaactatcagatggtaggcgttctgaagttcgcctctaagctcctgaatatcagcttaggtcgcacaaccagatccgcacagcactcaattatgactaacgaaatacctaaaagcaatccatttacagattactcttattccagtgtgaacatcaaggagtgtatgagccccgagtctctgaaatgcttcaagaaaagggactccgcccctcacatgaatcatcttttgtgtaagatggataacaagtacaaggcttttgactggccagaaattgagacggtccaaaaagggcagaaactctgcctgggcgattcacactgtaatctagagttcaccgccatcactgcagacaagattatgagtctgacaaactgctacaaagagagctttaccgcgcagcccgctgatatgcagacaggaatcaagaagtgctcggccgacgaaataggcgagtgtatcactctcgaggataaatcctggccgattgtgttctgcggggacaagtattactattctgacggaaaagaacatgcaaaggatggtagcatcaataactactgtctggccaacaaatgctcagagcaacggtttcctattcacaagaattggttcaagaaatgtaactgggacaagacccacaaagagttcacgaccatgcgccagatcaattataacgatataacaagttacagaaaggctattgagtccgaaatcggcactgaccttatgacccatcactataaacccacaaagaatttgccacatgtcgtgcctaggtaccactctatcgatgttcaggggactgagagcaccgagggaattataaacggctttatccagaatacgattcccgccatctccggtctgggggtgggctaccatttaggattcaaaggcaaccaactctttgacattgtaatcttcgtcaagaaggcagtgtataaagctcagtaccagaaggtttatacaaccgggccatcaataagcatcaatattgaacacaacgagaaatgcactggacactgtcccgaaaagatccctgccaaagagggttggctgacatttagtaaggaacatacctcttcctggggctgcgaggagtacgggtgtcttgcgattgatactggatgcctgtatggcagctgtcaggacgtgatccgtccagaattggatatatacaagaaaattggttcggaggcctcactcatcgaaatctgcattaccctgccgcacgagacatattgcaatgacatggatatcctagagcccataattggggacaagctgtctgctagtttccaaaacacgcagaccaatcagctccctaacctgatggcatacaaaaagggcaaagtctacactggacagatcaatgatgtgggcaacacagcccttcaatgtgggtccattcaggtagtgaacggaagcaccatcggctctggtaatccaaagtttgactatatatgccatgctatgcggcgaaaggacgttattgtcagaaaatgtttcaacgataattaccagagctgcacaaggttgaacccccgcaatgacctgatcccttatcggaagggggatatcattgaaatctccaaaactggatcaaacatgggccaaatgacctttaagattgagttaggtgacataaattacaaaatcttcacgaagagtgtggatctccagatgagcggcatttgtgccgggtgcatcgactgtgcagaaggaatctcttgctccattaacgcggatgtgtcagccgagacagtctgtcactgcaagaccaattgtgaagactttataagtaacatcgttattagcccacagatcaaaacttataatattaaggtgcattgcaaatccaaggtgaaaaagatcaccgctaacatatgcggcagaaatatcgatctgcagcttacagtaaagccctacaaccagaaaattgacctgtctcaactagatgagtcgaattatatcaaggaggaagacctccagtgtgggacttggctgtgcaaagtccagaaggagggaattgacatcgtgttcaaaggcttgttcagcggtctggggaagtactgggccatattaatttactcaatcattggaatcatagttgtgatcctcctgatttatgtccttctgccgatcggcaggttgctcaaagcatttctgattaagaacgaaatcgagtacaccatggaacaaaagataaaatga

SEQ ID NO: 11053 - RNA, 4263 nt, synthetic construct
  misc_feature 1..4263: note = derived and/or modified CDS sequence (opt3) from OROV(TVP-19249/GML-444672)__KP795076.1__GP
  source 1..4263: mol_type = other RNA
atggccaacctgatcattttcagcataatcctcggcattgcttacgggcaccccctttccacctctcagatcggagacagatgctttgccggtggctcactgttcaaggagatgaatttgagtgtggggttaggagaaatttgtgtcaaagatgacatcagcatagttaagtccacaactgcattttctaaaaacacgctggcgctagaggctaccacaaagttctataggtcgtttatcgtgaaagattggtcagaatgcaatcctgtactcgacaagctgggcaacttcatggtgcttaatgtcgatgacaacggtcatctggtgccacggatgtacacttgtcgcgccgcatgcgatattcgattgaataaggacaacgccgagatcattctcagcagtaccaaactgaatcactttgaaatcgttgggacaacctccacttctggatggttcaagaacacaataaccaataacctggagcatacgtgtgagcacgtgactgtcaattgcggccaaaagagcgtgaagtttcatgcttgtttccgtcagcacagaggctgcattaggtttttcaaagggacctatatgccgtactccatgatcgaagcaatgtgtattaacatcgagctcatcattttaacactgtatatatttgccgctatcattttcgcccttatcataactaagtcatacattgcgtatttgctgctacccctcttctaccctgtaacctggctgtacggaaaggtttataaacggatcaatagttgcagcaactgtcttctggcatctcacccatttacatcctgccccaagatctgcatttgtggttcacgcttcagctgcaccgaagccttgaaagtgcatagaatgggcaaggattgtctcgggtacaaaagtctgtctaaggctaggcagatgtgcaaatccaagagctggtcgtttacggccgcaatcttaactggactgattctcatggagttcgtctctcctatagctggcgagcggatgtataaacttgaggaactggccgacgattacatcgaaatggcggagcgcgtgggtatgttggaaaaagagattaaggtgctaaaacagtttacaatcgtcatgctggttatcattctcatactgcttctgttcgagaacaccatctttaattatttgttcaacactctctaccgatcctgttcaatgtgcgggctgattcactatagaccaggattaaaggtggacctgacaaaaaccaataagtgtggcagttgcatctgtggctttgatgaacaacagagctccgggttcgagtacgaagtatttctaaaggacatgcatattcagagggagtcttgcaaattcggaccccgggtgaaccactttcgtaatacgaagatcctcctgttcaccatagccatctgtacatcattctacactgtctatgcagacgaagattgccttagcaaaaacattaagatcacctaccaggagttgcacaattgcattggtccttatatcatgggcgacacatgtgtgagtaaatccgagctgtacagcgatctcctgtctaagaaccttataactgaatatgacaagaaatactttgagccagataccgttaatgaccaattcaacaagattgaatttgctcaggatgcccatcgcatgatcctgttggagaggattctctataaaacagaatgcgagatgctgtcattaaagaaaaatagtgggccgtacaacgtggcttggagaacctacctgaagaatcacaacatcgacctatgtagccggcataattataagatgatatgccagtgtatcaacatgcactccatgtgcaaaaacactgatattgacttcaataacgagatcgaaacgtactataaggccaatgcagccgcttaccgatctgatttttatacaattatcgacaccctcaaaactgcgttccgcggactgaccaaggtccttatagagaactacattgaaaaagacgattcggacgcattgaaggccctgtttagcaatatcacaaactccgtgcaggataattatcaaatggtaggcgttctcaaattcgcttcaaagctgttaaacatcagtctgggtagatctaccaggagcgcccagcattccattatgactaatgagatccccaagtcaaacccttttacagactacagctactcttccgtgaatattaaagagtgtatgagtccagaaagccttaagtgcttcaaaaagcgggattctgtcccccacacgaaccacttgctctgtaaaatggacaataagtataaggcatttgattggcctgagatagaaaccgtgcagaaagggcaaaagctgtgcctaggcgactcccattgtaacctggagttcactgccatcacagctgataaaattatgtcactcaccaattgctacaaggaaagttttacagcccagccagcagacatgcagactggaatcaaaaagtgcagcgcggatgagattggcgagtgtatcaccctggaagacaaggcttggcccatagtcgtgtgcggggataaatattactattcggacggaaaggagcacgccaaagacggttccatcaacaactactgtcttgcaaataagtgctctgaacagcgcttcccgattcataaaaactggttcaagaagtgtaattgggataaaacgcacaaggagtttaccacaatgagacaaatcaactataatgacattactagctacaggaaagccatcgaatcagagataggcaccgatttgatgacacaccattacaagcctactaaaaacctgccccacgttgtgccacgttatcatagtattgacgtacaggggaccgagtccacggaaggaatcatcaatggcttcattcagaacacaatacctgctatctctggtttaggggtcggctaccacctcggatttcggggcaatcagctgttcgatattgtgatctttgttaagaaagccgtgtataaggcacaataccagaaggtctataccactgggcccagcatttccatcaacatagagcataatgaaaaatgcacaggacactgtccagagaagatccccgctaaagaaggttggcttaccttctcaaaggagcacactagcagttggggctgcgaggaatacgggtgtctggccattgacaccggatgcttgtatggctcttgtcaggatgtgatccgacctgagctcgacatttacaaaaagatcggttccgaagcgagcctgatagagatttgcatcacactaccacatgagacgtactgcaacgatatggacatcctggaaccgattatcggggataagctctcggcctcatttcagaatacccaaactaaccagctgcccgtacttatggcttataaaaagggcaaagtgtacacaggacagataaatgacgttggcaacaccgcattgcagtgtgggtctattcaagtcgtgaacggaagtacaatcggctccggtaatcctaagttcgattatatttgccacgccatgagaaggaaagacgtgatcgtccgcaagtgttttaacgacaattaccagagctgcactcggctggatgctagaaacgacttaataccatataggaagggggatattatcgagatctctaaaaccggaagcaatatgggccagatgacgttcaagattgaactcggtgacatcaactacaaaatttttacaaagtccgttgatctgcaaatgtcaggcatatgtgccgggtgcatcgactgtgcagagggaattagttgcagcatcaatgcggatgtgtctgccgaaaccgtgtgtcattgcaaaactaactgtgaggacttcatctccaatattgtaatatcaccccagatcaagacctataacattaaggtccactgcaaaagtaaggtggagaaaatcacagctaatatttgcggccgcaacatcgatcttcagctgactgttaagccttacaatcagaaaatagacctaagccaactcgatgaatccaactacatcaaggaggaagacctgcagtgtgggacctggttgtgcaaggtgcagaaagagggaattgacatcgtcttcaagggcctgttttctggtttagggaaatattggacaattctcatctactcgataattggaatcattgtgatcgttctgcttatatatgtgctgttgccaatcggccgactcctgaaggccttcctaattaaaaatgaaatcgagtacacgatggagcagaagattaaatga

SEQ ID NO: 11054 - RNA, 4263 nt, synthetic construct
  misc_feature 1..4263: note = derived and/or modified CDS sequence (opt3) from OROV(TVP-19254/GML-480914)__KP795082.1__GP
  source 1..4263: mol_type = other RNA
atggccaacctgatcattataagcatggtgctctccgtcgcttacggccaccccctttctacctcacagatcggggacagatgcttcgcaggaggtaatctgtttaaggagatgaacttgagtgttggcttaggggaaatttgtgtgaaagatgacatcagcattgtaaagtccacaactgccttctctaaaaataagcctgcgctggaggctacgaccaaattttataggtcgttcatcgtgaaggattggtcagaatgcaacccagtcctagacaagtttggaaatttcatggtgctcagcgttgatgacaacggccatataatcccgaaaatgtacacatgtcgggccgcatgcgatattcgcctgaataaggacaacgccgagatcattcttagttccactaaactgaatcactttgaaatcgtgggtaccacatctaccagcgggtggttcaagaacactataacaaataacttggagcatacctgtgagcacgtcacggtgaattgcggacaaaaatccgtaaagtttcatgcttgtttccgacagcaccgtggctgcattagatttttcaagggcacttatatgccctactcaatgatcgaagcaatgtgtgttaacattgagctcatcatcctgaccctgtatatttttgccgctataatcttcgccctcattatcacaaaaagttacgtggcgtatttactgcttcctttgttctacccagtcacttggttttacgggaaggtgtataaaaagataaatagctgccccaactgtctgctagcatctcaccctttcacctcctgcccaaaaatttgcatctgtggatcaaggtttagctgcacagaagccctcaaggtgcatcggatgggtaaagattgtctgggctacaagagtctttctaaggctcgccagatgtgcaaatccaagagctggtcgttcaccgccgcaatcctgacggggttgattctcatggagtttatctctcccattgctggagagagaatgtataaactggaagagttagccgacgagttcataaagctgactgaacaggtcaacatcctcgaaagggagatggaggttcttaaacaatccgtgattgtaatgctggcgatcatcttggtgctactgctctttgaaaatatgattttcaaccggctgtttcgcatattctaccgatcatgtagtatgtgcggccttatccactatagacctggtctgaagattgatttgacaaagaccaataggtgtgggagctgcatctgtggatttgacgagcagcagtcctctggcttcgaatacgagatttttctcaaagatatgcatatccagaaggaaagctgcaaattctcaccacgggtcaaccacttccgtaatataaaggccctgttatttgcactggtgatctgtgctactatttatacagtttacgccgacgaggactgcctaagtaaaaacatcaagattacctaccaagagctccacaattgcatcggcccgaagataatgggggatacgtgtgtgtccaaaagcgaactgtattctgaccttttctcaaagaacttggtcaccgagtacgataaaaagtattttgaacccgacacaattaatgatcagttcaacaaaatcgagtttgctcaggacgcccatcgcatgattctgctcgaaagaatcctgtacaagactgagtgcgagatgcttagtctgaagaaaaatagcggaccttataacgtggcatggaggacctacttgaagaatcacaacatagatctctgttcccggcataattataaaatgatctgccagtgtattaacacacactctatgtgcaagaacactgacatcgattacaataaagaaattgagacctactataagtcgaacgccgctgcgtaccgagcagacctgaatacaatcatagataccttaaaaactgccttccgcggtctgacgaaggtactaattgaaaactatatcgagaaggacgacagcgatgctctcaaagccctgttttccaatatcacagactcagttcaagataactaccagatgattggcatccttaagttcgcaagtaaattgctggacattaatctcgggagatctaccaggagcgcccatcactccataatgactaacgagatcccaaagtcaaatccctttaccgattatagctactctaacgtgaatattaaagaatgtatgtcccctgagagtctgaagtgcttcaagaaacgggacagcacaccacacaccaaccatttactgtgtaagatcgataataaatataaggcttttgactggcccgaaattgagactatccagaaaggacaaaaactttgcttgggcgattctcactgtaacctcgagttcacagccataacggcagacaagatcatgtccctgaccaattgctacaaggaatcatttactgcgcagccggctgatatgcaggccggtattaagaaatgcagtgcagacgagatcggggaatgtacaaccctagaggataagacatggcctattgtcttctgcggcggaaaatactattacagcgactcgaaggaacatgccaaggacggctccatcaacaactattgtctgactaataaatgctctgagcagcgcttccccatacacgaaaactggtttaagaaatgtaattgggataagacccacaaagagttcagcacgatgaagcaaattaactacaatgacatcacctcatatagaaaagctatcgagagtgaaattgggacagatctcatgactcatcactacaagccaaccaagaacctgcctcatgtggtccccaggtatcactccatagacgtgcagggaacagagtctactgaaggtcttatcaatggctttattcagaacaccatcccagccattagcgggttgggagttggctaccatctgaatttcaaaggtaaccagttatttgatatcgtgatattcgtaaagaaagcagtctacaaggctcaatatcagaaagcctacacgacagggccctccatctcaattaatatcgagcacaacgaacgttgcaccggccactgtcctgagaagattccagcgaaggagggatggctcacttttagcaaagaacatacaagttcttggggctgcgaggaatatgggtgtctggccatcgacaccggatgcctttacggttcctgtcaggatgtgatacggccggagctggacgtttataagaaaattggcagcgaggtgtcgttgatcgaaatctgcattactctcccccacgagacctactgcaatgatatggacatcctggaacctataattggggataagctatcagcttctttccagaacacacaaacgaatcagctgccaaccctcatcgcatataaaaagggaaagatttacactggccagatcaacgacataggtaacacagccctgcagtgtgggagtattcaagtcatcaatggctccaccatcggaacaggcagccccaaatttgattacatttgccatgctatgcgaagaaaggacgtgatcgtaaggaaatgtttcaacgacaattatcagtcttgcactcgccttgagaagcggaacgatttgattccttacagaaaaggggacgtgatagaagttagcaagaccggatccaatatgggccagatgacgtttaagatcgagctgggtgatattaactataaaatcttcacaaagtcaatcgacttacaaatgagtgggatttgtgccggatgcatagattgtgcagagggcatcagctgctctattaatgcggaagtctccgccgagaccgtgtgtcactgcaaaactaactgtgaagacttcatcaataacattgtgttttcaccacagatcaagaattacaacataaaagtccattgcaagagtaaggttgagaaaatcattgctcacatctgcggtaaggatattgacctccagctgaccgtgaaaccctataatcagaagatcgatcttagccaactggacgaatccaactacataagggaggaggatctacagtgtggcacatggctctgcaaagtgcagaaggaagggattgacatcattttcaaaggactgttttctggcttggggcgctattggactatcctgatatactcgatcattggagtagtcatcattgtgatcttagtttacatactcctgccgattggccgacttctgaaggccttcttgatccggcacgagatcgaatatgcaatggagcagaagattaaatga

SEQ ID NO: 11055 - RNA, 4263 nt, synthetic construct
  misc_feature 1..4263: note = derived and/or modified CDS sequence (opt3) from OROV(TVP-19256/IQE-7894)__KP795085.1__GP
  source 1..4263: mol_type = other RNA
atggccaacctgatcattataagcatgatcctcggcattgcttacgggcaccccctttccacctctcagatcggagacagatgcttcgctggtggctcactgtttaaggagatgaatttgagtgtggggttaggagaaatttgtgtcaaagatgacatcagcatagttaagtccacaactgccttctctaaaaacgcgctggctctagaggccacgaccaagttttataggtcgttcatcgtgaaagattggtcagaatgcaatcctgtactcgacaagtttggcaacttcatggtgctgaatgtcgatgacaacggtcatcttgtgccaaagatgtacacatgtcgggcagcctgcgatattcgcctgaataaagacaacgctgaggttatcttgagcagtactaagctcaatcactttgaaattgtggggaccacatccacctctggatggttcaaaaacactatcacaaataacctggagcatacctgtgagcacgtcacggtgaattgcggccaaaagagcgtaaaatttcatgcatgtttccgacagcaccgtggctgcataagatttttcaagggggcctatatgccgtactccatgattgaagctatgtgtgttaacatcgagctgattatcctcactttatatatctttgccgcgattatattcgcactgatcattaccaagtcatacatcgcctatcttttgctgcccctattctaccctgtgacatggctctacggaaaagtctataagaggataaatagttgcccaaactgtctgcttgctagccacccctttacttcttgccctaaaatttgcatctgtggttcccggttctcatgcaccgaagccctgaaggtgcatcgcatgggcaaagattgtttggggtacaagagcctcagtaaagcaagacagatgtgcaagtctaagtcctggagctttacagctgccatcctgaccggattaattctgatggagttcgtgtcgccaatcgcgggcgagaggatgtataaactcgaagaacttgccgacgattacattgaactggcagagcaggtcaacatattgggtaaggaaatcaaaattctaaagcaatctatcatcgttatgctggctattatactcatcctgcttctgtccgagaatattatctttaactatttgttcaaaacgctctaccggtcatgtagtatgtgcgggctgattcactatcgccccggattaaaggtggacctgactaagacaaataaatgtggcagctgcatctgtggctttgatgagcagcagtcctctgggttcgaatacgaggtatttctaaaggacatgcatgtgcagcgagaaagctgcaaattcggacctagagtcaaccactttaggaataccaagatactcctgttcactatcgccatttgtacatcattttacaccgtgtatgctgacgaggattgccttagtaaaaacatccggattacgtaccaagaattgcacaattgcatcggtccacatataatgggcgacacctgtatgtccaagagcgagctgtattctgatctcctgtcaaagaaccttattacagagtacgacaaaaagtatttcgaaccggatactgttaatgaccagttcaacaaaatcgagtttgcccaggatgcacaccgtatgattctgttggaacgcatcctctacaagaccgagtgcgaaatgctgagtctgaaaaagaatagcgggccctataacgtggcctggagaacatacttaaagaatcataacatagacctatgttccaggcacaattacaaaatgatctgccagtgtattaacactcattctatgtgcaagaacaccgatatcgacttcaataaagagattgagacatattacaaggctaacgcggcagcctatcggtcggattttaataccatcatagacactctcaaaacggctttccgaggactgacaaaggtccttattgaaaactacatcgagaaagacgatagcgacgccttgaaggcactgttttccaatatcaccgattcagtgcaagacaactatcagatggtaggcgttctcaagttcgccagtaaactgttaaatatttctctgggtcgcactaccagaagcgctcagcactccatcatgacaaacgaaattcctaagtcaaatccatttaccgattacagctattcttccgtgaacataaaagagtgtatgagtcccgagagccttaagtgcttcaaaaagagggactctgtccctcacactaatcatttgctctgtaagatggataacaaatacaaggtgtttgactggccagaaatcgagacagtccaaaaagggcagaagctgtgcctaggcgattcccactgtaatctggagttcacggccattaccgcagacaaaatcatgtcactcactaactgctacaaggagagttttacagcgcagcccgctgatatgcagaccggaattaagaaatgcagcgccgacgaaatcggcgagtgtataacactggaggataagtcgtggccgatcgtgttctgcggggacaaatattactattccgaaggaaaggagcatgcaaaagacggttctattaataactactgtcttgccaacaagtgcagcgaacaacggtttcctatccacaagaattggttgaaaaagtgtaactgggataaaactcacaaggagttcaccacgatgcgcagaattaattataacgacatcacctcatacaggaaagctatagaaagtgagattggcacagatctgatgactcatcactataagcccaccaaaaatttaccacatgttgtgcctcgttaccactccatcgacgtacaggggacagagtctactgaaggaatcattaacggcttcatacagaataccatccccgccattagcggtctcggggtcggctaccatctgggatttaagggcaaccagcttttcgatatcgtgatttttgttaagaaagcagtgtataaggctcaataccagaaagtctatacgacagggccatccatctcaataaatatcgagcacaacgaaaagtgcaccggacactgtcccgagaaaattcctgccaaggaaggttggctgactttcagcaaggagcatacaagttcttggggctgcgaggaatacgggtgtttggcgatcgacaccggatgcctctatggctcctgtcaggatgtgattcggccagagctggacatctacaaaaagataggtagcgaagcctcgctaattgagatctgcatcactctgccgcacgagacctattgcaatgatatggacattctcgaacccatcataggggataaactgtcagcttcttttcagaacacacaaacgaatcagcttcctaacttgatggcatacaagaaaggcaaggtatacaccggacagattaatgacgtgggcaacactgccctgcagtgtgggagtatccaagttgtcaacggatccacaattggcagcggtaatccaaagttcgattatatctgccatgctatgcgaagaaaagacgtgatagtgaggaagtgttttaacgacaattaccagtcttgcacccgcttagatccccggaacgacctcattccttatagaaaaggggatatcgtcgagatcagcaagacaggatccaatatgggccagatgactttcaaaattgaactgggtgacatcaactacaagatttttaccaagtcagttgatcttcaaatgagtggcatatgtgccgggtgcatcgactgtgcagagggaattagctgctctatcaatgcggatgcctccgctgaaacggtgtgtcactgcaaaacaaactgtgaggacttcatctcaaatattgtgataagtccacagatcaagacctataacattaaagtacattgcaagagcaaagtcgagaagatcactgccaatatttgcggcaggaacatcgatctgcagctaaccgtgaagccctacaatcagaaaatagacctctcccaactggatgaatctaactatatcaaggaggaagacttgcagtgtgggacatggctgtgcaaagttcagaaggagggaattgacatcgtgtttaaaggcttattctcgggtctcgggaagtactgggcaattctgatctacagcataattggagtcatcgtggttattcttctgatctatgtgttgctcccgataggccgcctgctaaaagcattcctgatcaagaatgaaattgagtacactatggagcagaagatcaaatga

SEQ ID NO: 11056 - RNA, 4263 nt, synthetic construct
  misc_feature 1..4263: note = derived and/or modified CDS sequence (opt3) from OROV(TVP-19257/IQT-1690)__KP795088.1__GP
  source 1..4263: mol_type = other RNA
atggccaacctgatcattatacccatgatcctcggcattgcttacgggcaccctcttagcacctcccaaatcggagacagatgcttcgctggtggctctctgtttaaggagatgaatttgtcagtggggttaggagaaatttgtgtcaaagatgacatcagtatagttaagagcacaactgccttctccaaaaacgcgctggctctagaggccacgaccaagttttataggtctttcatcgtgaaagattggtcggaatgcaatccagtactcgacaagtttggcaacttcatggtgctgaatgtcgatgacaacggtcatcttgtgccgaagatgtacacatgtcgggcagcctgcgatattcgcctgaataaagacaacgctgagatcattttgtcaagcactaagctcaatcactttgaaatcgttgggaccacaagtacctccggatggttcaaaaacactataacaaataacctggagcatacctgtgagcacgtgacggtcaattgcggccaacgatctgtgaagtttcatgcatgtttccgtcagcacagaggctgcattaggtttttcaaagggacttatatgccctacagcatgatcgaagccatgtgtgtaaacattgagctgatcatcctcaccttatatatttttgctgccataatcttcgcgctgattatcacaaagtcctacatagcatatcttttgctgcctctattctacccagttacttggctctacggaaaggtgtataaacggattaattcatgccccaactgtctgcttgccagtcacccttttaccagctgcccaaagatctgcatctgtggttctcgcttctcctgcacagaagctctgaaagtccatagaatgggcaaggattgtttggggtacaaatcactcagcaaggccaggcagatgtgcaaaagtaagtcttggtcctttaccgcagctattctgacgggattaatcctgatggagttcgtgagccccattgccggcgagcggatgtataagctcgaagaacttgcggacgattacatagaactggccgaacaggtgaacatcttgggtaaagaaattaagatcctaaaacaatcgatcattgtcatgctggcaataatcctcattctgcttctgtctgagaatatcatttttaactatttgttcaatactctctaccgctcctgttcaatgtgcgggctgatccactatcgacctggattaaaggttgacctgacaaaaaccaacaagtgtggcagttgcatatgtggctttgatgagcagcagagctccgggttcgaatacgaggtgtttctaaaggacatgcatgtacagagagaatcttgcaaattcggaccaagggtgaatcactttcggaacactaagatcctcctgttcattatcgctatttgtacatcattttacaccgtctatgccgacgaggattgccttagcaaaaatatccgtataacgtaccaagaattgcacaactgcattggtccgcatatcatgggcgacacctgtatgagtaagtccgagctgtatagcgatctcctgtctaaaaatcttattacagagtacgacaagaagtatttcgaacccgatactgtgaacgaccagttcaataaaatcgagtttgctcaggatgcccaccgcatgatactgttggaaagaatcctctacaagaccgagtgcgaaatgctgtcattaaagaaaaacagtgggccttataatgttgcatggaggacatacctgaaaaaccataatattgacctatgtagccggcacaactacaagatgatctgccagtgtattaacactcattccatgtgcaagaataccgatatcgacttcaacaaagagatagagacatattacaaggccaatgctgcggcatatcgatctgattttaacaccattatcgacactctcaaaacggccttccgcggactgacaaaggtgcttatcgaaaattacattgagaaagacgattcggacgctttgaaggccctgtttagcaacatcaccgattccgtccaagacaattatcagatggtgggcgtactcaaattcgcatcaaagctgttaaacattagtctgggtagaactaccaggtctgcccagcacagcataatgacaaatgaaatcccaaagtccaacccctttaccgattactcatatagctctgttaatattaaagagtgtatgtcccctgagagtcttaagtgcttcaaaaagcgggacagcgctccacacactaaccatttgctctgtaaaatggataataagtacaaggcctttgactggcccgaaatcgagacagtgcaaaaagggcagaagctgtgcctaggcgattctcactgtaacctggagttcacggcaattaccgcggacaaaatcatgtccctcactaattgctacaaggagtcatttacagctcagccggccgatatgcagaccggagtcaaaaagtgcagtgcagacgaaataggcgagtgtatcacactggaggataagagctggcctattgtgttctgcggggacaaatattactattcggacggaaaggaacatgccaaagatggttccatcaacaactactgtcttgctaataagtgctctgagcaacgctttcccattcacaaaaactggttcaagaagtgtaattgggacaaaactcacaaggagttcaccacgatgagacagatcaactataatgatataaccagctacaggaaagccattgagtcagaaatcggcacagacttgatgactcatcactataagccaaccaaaaacctgcctcatgtcgtgccccgttaccacagtatcgatgttcaggggacagagtccactgagggaattataaatggctttatccagaacaccattccagcaatctctggtttaggggtgggctaccatctcggattcaagggcaatcaactgtttgacattgtaatcttcgtcaaaaaggctgtgtataaggcccagtaccagaaagtttatacgacagggcccagcatatccatcaacattgaacacaatgagaagtgcaccggacactgtcctgagaaaatcccagcgaaggaaggttggcttactttttcaaaagaacatacaagcagttggggctgcgaggagtacgggtgtctggccattgataccggatgcttgtatggctcttgtcaggacgtgatccggccggaactcgatatatacaagaagattggttccgaggctagcctgctagaaatctgcatcactctgccccacgagacctattgcaacgacatggatattctcgagcctatcataggggacaaactgtcggcatcattccaaaatacacagacgaaccagcttccaaatttgatggcctacaagaaaggcaaggtctacaccggacagattaacgatgtgggcaacactgctctgcaatgtgggtctatccaggtagtgaatggaagtacaattggctccggtaaccccaaatttgactatatctgccatgccatgcgaagaaaggacgttatagtcaggaagtgtttcaatgataactaccagagctgcacccgcttagaccctcggaatgatctcattccatatagaaaaggggacatcatcgaaatttctaagacaggaagcaacatgggccaaatgacttttaaaatcgagctgggtgatattaattacaagatattcaccaaatccgtggaccttcagatgtcaggcatctgtgcagggtgcattgattgtgcggaaggaatcagttgcagcatcaacgccgacgtgtctgctgagacggtctgtcactgcaagacaaattgtgaagattttatttccaacatagttatctcaccccagattaagacctataatatcaaagtgcattgcaagagtaaagtggagaagattactgccaacatctgcggcaggaatatagacctgcagctaaccgtaaaaccgtacaaccaaaagatcgatctcagccagctggacgagtccaattatattaaggaagaggacttgcagtgtgggacatggctgtgcaaagtccagaaggaaggaatcgatattgtgttcaaaggcttattctctggtctcgggaagtactgggcaatcctgatatactcgattatcggaattatcgttgtgatacttctgatctatgtcttgctccctattggccgcctgctaaaagcatttctgatcaagaacgagattgaatacactatggagcagaaaatcaagtga

SEQ ID NO: 11057 - RNA, 4263 nt, synthetic construct
  misc_feature 1..4263: note = derived and/or modified CDS sequence (opt3) from OROV(TVP-19258/IQT-4083)__KP795091.1__GP
  source 1..4263: mol_type = other RNA
atggccaacctgatcattataagcatgatcctcggcattgcttacgggcaccccctttccacctctcaaatcggagacagatgcttcgccggtggctcactgtttaaggagatgaatttgagtgtggggttaggagaaatttgtgtcaaagatgacatcagcatagttaagtccacaactgcattctctaaaaacgcgctggctctagaggccacgaccaagttttataggtcgttcatcgtgaaagattggtcagaatgcaatcctgtactcgacaagtttggcaacttcatggtgctgaatgtcgataacaatggtcatcttgtgccaaagatgtacacatgtcgggcagcctgcgacattcgcctgaacaaagataatgctgagatcattttgagcagtactaagctcaaccactttgaaatcgttgggaccacatccacctctggatggttcaaaaatactataacaaacaatctggagcatacctgtgagcacgtgacggtcaactgcggccaaaagagcgtgaaatttcatgcatgtttccgacagcaccgtgcctgcattagatttttcaagggcacttatatgccgtactccatgatcgaagctatgtgtgtaaatattgagctgatcatcctcaccttatatatttttgccgcgataatcttcgcactgattatcacaaagtcatacatagcctatcttttgctgcccctattctaccctgctacttggctctacgggaaagtttataagaggattaacagttgcccaaactgtctgcttgccagccacccctttacctcttgccctaaaatctgcatctgtggatcccggttctcatgcacagaagcactgaaggtgcatcgcatgggtaaagactgtttgggctacaagagcctcagtaaagctagacagatgtgcaagtctaagtcctggagctttaccgccgcgattctgacggggttaatcctgatggagttcgtctcgccaattgccggagagaggatgtataaactcgaagaacttgcagatgactacatagaactgactgaacaggtgaatatcttgggcaaggaaattaaaatcctaaagcaatctatcattgtgatgctggctataatcctcattctgcttctgtccgagaacatcatttttaattatttgttcaacacactctaccggtcatgtagtatgtgcggtctgatccactatcgccccgggttaaaagtcgatctgaccaagactaataagtgtggaagctgcatatgtggctttgacgagcagcagtcctctggcttcgaatacgaggtttttctaaaagatatgcatgtgcagcgagaaagctgcaagttcgggcctagagtaaaccactttaggaatacaaaaatcctcctgttcaccattgccatctgtacgtcattttacaccgtgtatgctgacgaggactgccttagtaagaacattcggatcacataccaagaattgcacaattgcataggaccacatattatgggtgatacttgtatgccgaaatccgagctgtatagcgacctcctgtctaagaaccttatcaccgagtacgataagaaatatttcgaacccgacacagtcaatgatcagttcaacaagattgagtttgcccaggacgcacaccgtatgatcctgttggaacgcatactctacaaaactgagtgcgaaatgctgtcattaaagaaaaatagtggcccttataacgtggcctggagaacctacctgaagaatcataacatcgatctatgtagcaggcacaactacaagatgatttgccagtgtatcaatacacattccatgtgcaaaaacaccgacattgatttcaataaggagatcgagacttattacaaagctaacgcggcagcctatcggtctgactttaatacgataattgatacactcaagaccgctttccgagggctgactaaagttcttatcgaaaactacatcgagaaggacgactcggatgccttgaaagcactgtttagcaatattaccgactccgtgcaagataactatcagatggtcggagtgctcaagttcgcctcaaagctgttaaatatcagtctgggccgcacaaccagatctgctcagcacagcattatgactaacgaaataccaaaatccaatccctttacagactactcatatagctctatcaacattaaggagtgtatgtcccctgagagtcttaaatgcttcaagaaaagggatagcgccccacacacgaatcatttgctctgtaagatcgacaacaagtacaaagcatttgattggcccgaaattgagaccgtacaaaagggtcagaaactgtgcctaggggactctcactgtaatctggagttcactgcgatcacagctgataagataatgtccctcaccaactgctacaaagagtcatttacagcccagccggcagacatgcagactggcatcaagaagtgcagtgccgatgaaattggagagtgtatcaccctggaggacaaaagctggcctattatcttctgcggcgataagtattactattcggacgggaaagaacatgctaaggacggatccataaacaattactgtcttgccaacaaatgctctgagcaacggtttcccattcacaagaattggttcaagaaatgtaactgggataagacgcacaaagagttcaccacaatgcgccagatcaattataacgacatcactagctacagaaaggcaattgagtcagaaataggtaccgatttgatgacacatcactataaaccaactaagaatctgcctcatgttgtgcccaggtaccacagtatcgacgtccagggcaccgagtccacggaggggattatcaacggatttattcagaatacaatcccagctatatctggcttaggtgtggggtaccatctcggcttcaaaggaaaccaactgtttgatatcgtcattttcgtgaagaaggccgtttataaagcgcagtaccagaaggtgtataccactggccccagcatctccattaatatcgaacacaacgagaaatgcacagggcactgtcctgaaaagataccagccaaagagggatggcttaccttttcaaaggaacatactagcagttggggttgcgaggagtacggctgtctggctattgacaccgggtgcttgtatggatcttgtcaggatgtaatccgtccggaactcgacatctacaagaaaattggctccgaggcaagcctgatcgaaatatgcattacactaccccacgagacgtattgcaatgatatggacatcctggagcctattatcggtgataagctctcggcctcattccaaaacacccagactaatcagctgccaaaccttatggcttacaaaaaggggaaagtctacacaggccagataaacgacgtgggaaataccgccttgcaatgtggctctattcaggttgtgaacgggagtacaatcggatccggcaatcccaagtttgattatatctgccatgcaatgcggcgaaaggacgtcattgtgagaaaatgtttcaacgacaattaccagagctgcactaggctggatcctcgcaacgacttaatcccatatcggaagggtgatattatagaaatctctaaaaccgggagcaatatgggacaaatgacgtttaagattgagctcggcgacatcaactacaaaatcttcacaaagtccgtagatctgcagatgtcaggtatttgtgcgggctgcatagactgtgccgaagggatcagttgcagcattaatgctgatgtgtctgccgagaccgtttgtcactgcaagactaactgtgaagactttatctccaatattgtcatctcaccccagataaaaacctataacatcaaggtgcattgcaaaagtaaggtggagaaaattacagcaaatatctgcgagagaaacattgatcttcagctgactgtcaagccgtacaatcaaaagatcgacctaagccagctcgatgaatccaactatataaaagaggaagacctgcagtgtggaacctggttgtgcaaggttcagaaagagggcattgacatcgtgttcaaggggctgttctctggattaggcaaatactgggctattctcatctactcgataatcggtattatcgtggtaattctgcttatctatgtcctgttgcctatagggaggctcctgcgcgcctttctaattaagaatgaaatcgagtacacaatggagcagaaaatcaagtga

SEQ ID NO: 11058 - RNA, 4263 nt, synthetic construct
  misc_feature 1..4263: note = derived and/or modified CDS sequence (opt3) from OROV(TVP-19259/IQT-7085)__KP795094.1__GP
  source 1..4263: mol_type = other RNA
atggccaacctgatcattataagcatgatcctcggcattgcttacgggcaccccctttccatctctcagattggagacagatgcttcgccggtggctcactgtttaaggagatgaatttgagtgtggggttaggagaaatctgtgtcaaagatgacataagcatcgttaagtccaccacagcattctctaaaaacgcgctggctctagaggccactacgaagttttataggtcgttcattgtgaaagattggtcagaatgcaatcctgtactcgacaagtttggcaacttcatggtgctgaatgtcgatgacaacggtcatcttgtgccaaagatgtacacctgtcgggcagcctgcgatatccgcctgaataaagacaacgctgagattatcttgagcagtacaaagctcaatcactttgaaatagttgggactacctccacatctggatggttcaaaaacaccattactaataacctggagcatacatgtgagcacgtgaccgtcaattgcggccaaaagagcgtgaaatttcatgcatgtttccgacagcaccgtggctgcatcagatttttcaaggggacgtatatgccgtactccatgattgaagccatgtgtgtaaacatcgagctgatcattctcactttatatatatttgctgccatcattttcgcgctgatcataaccaagtcatacattgcatatcttttgctgcccctattctaccctgttacatggctctacggaaaagtgtataagaggatcaatagttgcccaaactgtctgcttgccagccacccctttacttcttgccctaaaatctgcatttgtggttcccggttctcatgcaccgaagctctgaaggtccatcgcatgggcaaagattgtttggggtacaagagcctcagtaaagccagacagatgtgcaagtctaagtcctggagctttacagcagctatcctgaccggattaattctgatggagttcgtgtcgccaatagccggcgagaggatgtataaactcgaagaacttgcggacgattacatcgaactggccgaacaggtgaacattttgggtaaggaaatcaaaatcctaaagcaatctattgtcgttatgctggcaataatcctcattctgcttctgtccgagaatatcatttttaactatttgttcaatacgctctaccggtcatgtagtatgtgcgggctgatccactatcgccccggattaaaagtggacctgactaagacaaacaagtgtggcagctgcatatgtggctttgatgagcagcagtcctctgggttcgaatacgaggtatttctaaaagacatgcatgtgcagcgagaaagctgcaagttcggacctagagtcaatcactttaggaacaccaaaatcctcctgttcactattgctatctgtacatcattttacaccgtgtatgccgacgaggattgccttagtaagaatattcggatcacgtaccaagaattgcacaactgcataggtccacatattatgggcgacacctgtatgtccaaaagcgagctgtattctgatctcctgtcaaagaatcttatcacagagtacgacaagaaatatttcgaaccggatactgttaacgaccagttcaataagattgagtttgctcaggatgcccaccgtatgatcctgttggaacgcatactctacaaaaccgagtgcgaaatgctgagtttaaagaaaaacagcgggccctataatgtggcatggagaacatacctgaagaaccataatatcgacctatgttccaggcacaactacaagatgatttgccagtgtatcaacactcattctatgtgcaaaaataccgatattgacttcaacaaggagatcgagacatattacaaagccaatgctgcggcatatcggtcggattttaacaccataattgacactctcaagacggccttccgaggactgacaaaagtccttatcgaaaattacatcgagaaggacgatagcgacgctttgaaagccctgttttccaacattaccgattcagtgcaagacaattatcagatggtaggcgttctcaagttcgcaagtaagctgttaaacatctctctgggtcgcactaccagaagcgcccagcactccattatgacaaatgaaatacctaaatcaaacccatttaccgattacagctattcttccgtgaatatcaaggagtgtatgagtcccgagagccttaaatgcttcaagaaaagggactctgctcctcacactaaccatttgctctgtaagatggataataagtacaaagcctttgactggccagaaattgagacagtccaaaaggggcagaaactgtgcctaggcgattcccactgtaacctggagttcacggcaatcaccgcggacaagattatgtcactcactaattgctacaaagagagttttacagctcagcccgccgatatgcagaccggaatcaagaagtgcagcgcagacgaaataggcgagtgtatcacactggaggataaatcgtggccgattgtgttctgcggggacaagtattactattccgacggaaaagaacatgccaaggatggttctatcaacaactactgtcttgctaataaatgcagcgagcaacggtttcctattcacaagaactggttcaagaaatgtaattgggacaagactcacaaagagttcaccacgatgcgccagatcaactataatgatataacctcatacagaaaggccattgagagtgaaatcggcacagacttgatgactcatcactataaacccaccaagaacctgccacatgtcgtgcctaggtaccactccatcgatgttcaggggacagagtctactgagggaattataaatggctttatccagaacaccattcccgcaatcagcggtttaggggtgggctaccatctcggattcaaaggcaatcaactgtttgacattgtaatcttcgtcaagaaggctgtgtataaagcccagtaccagaaggtttatacgacagggccatccatatcaatcaacattgaacacaatgagaaatgcaccggacactgtcccgaaaagatccctgcgaaagagggttggcttacttttagcaaggaacatacaagttcttggggctgcgaggagtacgggtgtctggccattgataccggatgcttgtatggctcctgtcaggacgtgatccgtccagaactcgatatatacaagaaaattggtagcgaggcttcgctgatcgaaatctgcattactctaccgcacgagacctattgcaacgacatggatatcctggagcccataattggggacaagctctcagcatctttccaaaatacacagacgaaccagctgcctaatcttatggcctacaaaaagggcaaagtctacaccggacagatcaacgatgtgggcaacactgctttgcaatgtgggagtattcaggtagtgaatggatccacaatcggcagcggtaacccaaagtttgactatatatgccatgccatgcggcgaaaggacgttattgtcagaaaatgtttcaatgataactaccagtcttgcaccaggctggacccccgcaatgatttaatcccttatcggaagggggacatcattgaaatcagcaaaacaggatccaacatgggccaaatgacttttaagattgagctcggtgatataaattacaaaatcttcaccaagtcagtggacctgcagatgagtggcatttgtgcagggtgcatcgattgtgcggaaggaatcagctgctctattaacgccgacgtgtccgctgagacggtctgtcactgcaagacaaattgtgaagattttatatcaaacatcgttattagtccacagatcaaaacctataatattaaggtgcattgcaaaagcaaggtggagaaaatcactgccaacatatgcggcagaaatatcgaccttcagctgaccgtaaagccctacaaccaaaagattgatctatcccagctcgacgagtctaattatatcaaagaagaggacctgcagtgtgggacatggttgtgcaaggtccagaaagaaggaattgatatcgtgttcaagggcctgttctcgggtttagggaaatactgggcaatactcatttacagcatcattggagttatcgtggtcatactgcttatctatgtgctgttgccgattggcaggctcctgaaggcttttctaatcaaaaacgagattgaatacactatggagcaaaagatcaagtga

SEQ ID NO: 11059 - RNA, 4263 nt, synthetic construct
  misc_feature 1..4263: note = derived and/or modified CDS sequence (opt3) from OROV(TVP-19262/OBS-9478)__KP795100.1__GP
  source 1..4263: mol_type = other RNA
atggccaacctgatcattataagcatgatcctcggcattgcttacgggcaccccctttccacctctcagatcggagacagatgcttcgccggtggctcactgtttaaggagatgaatttgagtgtggggttaggagaaatttgtgtcaaagatgacatcagcatagttaagtccacaactgcattctctaaaaacgcgctggctctagaggccacgaccaagttttataggtcgttcatcgtgaaagattggtcagaatgcaatcctgtactcgacaagtttggcaacttcatggtgctgaatgtcgataacaatggtcatcttattccaaagatgtacacatgtcgggcagcctgcgacatccgcctgaacaaagataatgctgagattatcttgagcagtactaagctcaaccactttgaaataattgggaccacatccacctctggatggttcaaaaatactatcacaaacaatctggagcatacctgtgagcacgtgacggttaactgcggccaaaagagcgtgaaatttcatgcatgtttccgacagcaccgtggctgcattagatttttcaaggggacttatatgccgtactccatgatcgaagccatgtgtgtcaatatcgagctgattatactcaccttatatatctttgctgccattatcttcgcgctgataattacaaagtcatacatcgcatatcttttgctgcccctattctaccctgccacttggctctacggaaaagtgtataagaggatcaacagttgcccaaactgtctgcttgctagccacccctttacctcttgccctaaaatttgcatctgtggttcccggttctcatgcacagaagccctgaaggtacatcgcatgggcaaagactgtttggggtacaagagcctcagtaaagcaagacagatgtgcaagtctaagtcctggagctttaccgctgccattctgacgggattaatactgatggagttcgtttcgccaatcgcgggcgagaggatgtataaactcgaagaacttgccgatgactacattgaactgactgaacaggtgaatatcttgggtaaggaaatcaaaattctaaagcaatctataatcgtcatgctggcaattatcctcattctgcttctgtccgagaacatcatatttaattatttgttcaacacactctaccggtcatgtagtatgtgcgggctgatccactatcgccccggattaaaagtggatctgaccaagactaataagtgtggcagctgcatttgtggctttgacgagcagcagtcctctgggttcgaatacgaggtgtttctaaaagatatgcatgtccagcgagaaagctgcaagttcggacctagagttaaccactttaggaatacaaaaatcctcctgttcaccattgctatctgtacgtcattttacaccgtgtatgccgacgaggactgccttagtaagaacatacggattacataccaagaattgcacaattgcatcggtccacatattatgggcgatacttgtatgccgaaatccgagctgtatagcgacctcctgtctaagaaccttatcaccgagtacgataagaaatatttcgaacccgggacagtaaatgaccagttcaacaagatagagtttgctcaggatgcccaccgtatgatcctgttggaacgcattctctacaaaactgagtgcgaaatgctgtcattaaagaaaaatagtggaccttataacgtggcatggagaacctacctgaagaatcataacatcgacctatgtagcaggcacaactacaagatgatttgccagtgtatcaatacacattccatgtgcaaaaacaccgatatagacttcaataaggagattgagacttattacaaagccaacgctgcggcatatcggtctgattttaatacgatcatcgacacactcaagaccgccttccgaggcctgactaaagtccttattgaaaactacatcgagaaggatgactcggacgctttgaaagccctgtttagcaatattaccgattccgtgcaagacaactatcagatggttggtgtgctcaagttcgcatcaaagctgttaaatataagtctggggcgcacaaccagatctgcccagcacagcatcatgactaacgaaattccaaaatccaatccctttacagattactcatatagctctatcaacattaaggagtgtatgtcccctgagagtcttaaatgcttcaagaaaagggacagcgctccacacacgaatcatttgctctgtaagatcgataacaagtacaaagcctttgactggcccgaaatagagaccgtccaaaagggccagaaactgtgcctaggagattctcactgtaatctggagttcactgcaatcacagcggacaagattatgtccctcaccaactgctacaaagagtcatttacagctcagccggccgatatgcagactggcatcaagaagtgcagtgcagacgaaattggggagtgtatcaccctggaggataaaagctggcctataattttctgcggagacaagtattactattcggatggtaaagaacatgccaaggacggctccatcaacaattactgtcttgctaacaaatgctctgagcaacggtttcccatccacaagaattggttcaagaaatgtaactgggacaagacgcacaaagagttcaccattatgcgccagataaattataacgatatcacaagctacagaaaggccattgagtcagaaatcgggactgacttgatgacccatcactataaaccaacaaagaatctgcctcatgtggtacccaggtaccacagtattgatgttcagggaactgagtccaccgagggcatcataaacggttttatccagaatacgattccagcaatctctgggttaggcgtgggataccatctcggcttcaaagggaaccaactgtttgacattgtcatcttcgtgaagaaggctgtctataaagcccagtaccagcgtgtgtatacaaccggacccagcatatccattaatatcgaacacaacgagaagtgcactggtcactgtcctgagaaaatcccagcgaaggaaggctggcttacattttcaaaagaacataccagcagttgggggtgcgaggagtacggatgtctggccattgatactggctgcttgtatggttcttgtcaggacgttatccggccggaactcgatatatacaagaagattgggtccgaggctagcctgatcgaaatttgcatcaccctaccccacgagacatattgcaatgacatggatatactggagcctattatcggcgacaaactctcggcatcattccaaaacacgcagaccaatcagctgccaaaccttatggcctacaagaaaggaaaggtgtacactggccagatcaacgatgtagggaatacagctttgcaatgtggatctattcaggtcgtgaacggcagtatcattggttccgggaatcccaaatttgactatatatgccatgccatgcgaagaaaggatgttatcgtgaggaagtgtttcaacgacaattaccagagctgcacccgcctggaccctcggaacgatttaattccatatagaaaaggagacatcatcgaaatttctaagacaggcagcaatatgggtcaaatgacttttaaaatagagctcggcgatatcaactacaagattttcaccaaatccgtcgacctgcagatgtcagggatctgtgcaggatgcattgattgtgcggaaggcatcagttgcagcataaatgccgacgtgtctgctgagacggtatgtcactgcaagacaaactgtgaagattttatctccaatattgtgatctcaccccagattaagacctataacatcaaagttcattgcaagagtaaagtcgagaagataactgccaatatttgcgagaggaacatcgaccttcagctgaccgtgaaaccgtacaatcaaaagattgatctaagccagctcgacgaatccaactatatcaaggaggaagatctgcagtgtgggacatggttgtgcaaagtgcagaaggagggaatagacatcgtcttcaaaggcctgttctctggtttagggaagtactgggcaattctcatctactcgattatcggaataattgttgtgatcctgcttatctatgtgctgttgcctattggccgcctcctgcgagcttttctaatcaaaaatgaaatagagtacactatggagcaaaagattaaatga

SEQ ID NO: 11060 - RNA, 4299 nt, synthetic construct
  misc_feature 1..4299: note = derived and/or modified CDS sequence (opt3) from OROV/FPV(Aus Ch 16129)__KF697137.1__GP
  source 1..4299: mol_type = other RNA
atgaagttcgtgagcatcctgctctttgtctcctggcttggcgccacctaccagaaccccgtttctcacagacaaattggggagaggtgcttcgctggaggttcactgataaaaacagtgaatcagacgagtggcgtaagcgaagtgtgtgtccgggacgatatctccatgattaagtctatcgtgcatactaccaaagcatcggacacagccgttaacaattatattcgcttttaccgagtgttcatcgtcaaggagtggcacgattgcaacccttttccagacccgaaagggactttcatggtgttggatgtatcaagcaccaatcatttagaacccataacatatacctgtcgtactccttgcgagatcacactggacaaggatagtgcggaagttaccctatcctctcagaagatgaaccactacgagattagcggatccacgatcaataacggctggtttaaaaattcaattagtgtgagcctcgagcatacttgtgaacacatcaccgtctcttgcggtcagaagacagtgagattccacgcttgttttaggcaacatcggtcctgcactcgcttctttaaaaactcaatgatgccagccagaatgaccgagagcatatgtcagaatctggaaattatccttctgacatgcttcagttttgtgtgtttcattttcttgtgcatcatcaccaagacgtatgtcgcatacgttctcattcccgtgttttatcctttcacttacatatacgggaggctgtatgacaaatactttaagctgtgcgagaactgtctcttagccgtacacccattcacaccctgcgagaccgtgtgtgtctgcggatctcagtatgctaatactgaacagctgcggacacatcgcatgaccaacaattgtaagggctacaaatcccttagcaagtcgcgagcaatgtgcaaatctaagggctgttcctttgtggttgccatcttctgctcaattatctttttcagttttataacgcctattaacagccaagagtataaattgtccgatctgccagacgagttcaccagactagaggaagagaacacaatgctcaagatcaggctgcttgtgatcaaaattactatctctgtcattagcgtgaccataacagtaacttcactgaccgagcggaaggtttttcaggaattgttcaatgctatctaccgtcactgtccgttttgcgggatgattcaccgcagaaggggactccgggtggtcaacagtacaaccaataagtgtggtacttgcatctgcggctataaagaggaaacggagcatggggtggaatacgagatcttcctgaagacaatgcaccaggagaacgtcaattgtatgttcaaaccctcccagcgacattttcgcaacttcaagattttaatagcctttctggcgatgtgcatgatcattaccagcgtgtctgcagatgaaaaacactgtctcaagtacaaggagcctgttaaactttcaaatctgactgaatgccatagtttgtggctaaacatcaccgagtgtcaaattaatcagagcacactgttcgaaaccctcaagggagagcagctggtgactgactttgataaaccagacttcacaatcatgggccaaaagtatgacatagccatggagagaatcgaaaacgctcagaatcttcaccacatgattctgttggagtacctccatgccaaatccaactgcctgaagtataagcagttaaaatctaattcgggtccctacaacatcccttggaggacgtatattcacgggcatggactggatgtatgtggccagtacagctataagctaatctgcaaatgtatatccaccggcatgcactgcgaaaatactgcactcgacatttacaacgagatgcggcaattttacacaaacaatcaggagaactataatctggatcttaacaccgtcatcaaggctattgggttggccatgcgcggaatcggtcagatgataatcgaagagttctttggcgaatcacagattgaggaactgagtaatttcctcaacatgacatctaaaaatctggggactaacaagcaacttatcggactgattaattttggcttgatgctcctggacatcaaccagaccaagacgccacagatagatcccaaaccgagaaccttacaggcgaggagctccattcctacaggtactgagatcaccgactggacaaaggggcaatcaaaaatcaagacttgtgccgagtacagcaccctgacgtgccagtcttggcgtaaaacagtgaataccaagtccttcctaatgtgcaaagttagtagcaagtggcacgtgtataactggcccgaaattccaactgtcgtgagaaattctaagctctgtctgggcgattaccattgcaacatggagtttacacctatcgacgcagatgaagctcttaaacagttgcgatgttataagaccgagttcgtaccctccccagacggaatggatgaatcaattaaaaagtgcactctggagaaattcggcgggtgtaccacagccaatggacacagttggacgataatggtgtgcaacggtagatactatcagaccaacactagggagcatgctaaggacggcctcctgaatagctactgttttgaacccaagtgccaatcggggcgccaccctatccataaatccttcttaaacaattgtatttggaaggagtctagccggcagatcattgaaacaagaaccatcgagtacaacaatatagaagactataaaaagtcagttgagagtgatatcaaatccgacctgacaattcaccactttaagccaactaagaaccttccgttggtcacccccacgtacatctctgtggtggccgatggaacaatggtcagcgacggcattcagaatgcatatgttaaaggtaccatccctgggatatccggcgtggccactggactccatgtgaagaccccagatggcattctgctaatggacatcatcgtatacgtcaggaaagctctgtataaggcgaactacgagaaaatttattcaacagggcccactataggaatcaatgtgaagcacaacgaaaagtgcaccggtacatgtcctgagcatattccaaaagatgaaggctggctcacgttcagcaaggagcacaccagtaattgggggtgcgaggaatacggatgctttgcaatcaactctggctgtctgtacggttcctgccaagacattatccgccccgagcttgatatatataaacagcagggggaagaacagactttgctggaattatgtatcacactcccgcatgagaccttctgcaatgacctggatgttcttgagcctgtgattactgacaagctgcaattggattttcagacaacccagagcgaccacctcccagaactggtcgccctgaaaaagggcctaatcctcacgggacagctgaacgaccttggcaatactgctgccatgtgtgggtcggtgcaattggttaacaaaaccatttacggacagggcaaccccaagttcgattttatctgccacgcaatgcgacggaaggacgtgatagtacgtagatgttatgataatcattactcaacatgcgccctgttaaaacagaggaacgacctcctgcacaaggaggtcaatgatcagatgtctattaccgtgaacggtaaaaatcttgggctgatcaacttccgcctaaatctcggagacctgaactataagttgtttgtgaatgaacctaacttcgagctgactggccaatgtgctggttgcatcagttgtgccgatgaaatttcctgccagttaaatatcatagcagaccatgagttcacatgcaaagtcagctctagctgtaacctctacatttccaatatgatgatcacccccgcgaaccacatttataatctgaaggtttcatgccgggagcacgtgagtaacatcgatcttgctgtatgtggccggagcttttctctgcatgccacattgaagcagcactcccaaaaactcgacctgtcagcactagatgaaactaatttcgtgaaggaggaagacctgaggtgcgggacctggctttgtaaagtcaaggatgagggactcagttttctgacgcgaagcatattcggctccttggggacatactggtcttactttatttatggactgatcttcatgatcttactctttattgccatctacttcctgtatccactttgcaaacgcctgaagggcttgctcgaagagaacgagcgggaatacctgattgagtcgaagatgaaatga

SEQ ID NO: 11061 - RNA, 4257 nt, synthetic construct
  misc_feature 1..4257: note = derived and/or modified CDS sequence (opt3) from OROV/IQTV(IQT9924)__KF697143.1__GP
  source 1..4257: mol_type = other RNA
atggactgcatcattttctacctgagctttttcgccgtggtcaccgctcaccccgtttcccatcaccaggtgggcgatagatgttttgcagggggaaacctcataaaggaccttaataaaacagtaaacatcggtgaggtgtgcgtcagggatgacatttctatcattaagtcaactacggccatccagaaaagtctggatcatttgagcacccggacaaagttctatcgcgtgtacatagttaaagaatgggcggagtgtaatcctatcattgactatgctggcaactttatcgtgatgaatattgatgacaacgggcacttagtcccacgaatgcatacttgccgtgcctcctgtgatatcagactgaataagaacgacgcagaaataattctatcttcgcagaagaccaatcactacgagatcattggaacaaccactgtgtcaggctggttcaaaaacacaatcaatctcccgctggaacatacctgcgagcacatcacggtaaactgtggtcaaaagagccttaggtttcacgcctgcttccggatgcatcgcgggtgtactagatttttcaaaaatacctatatgcccagtacaatgattgagcacatgtgcgttaacctggaattgataatctttactctctacattttcaccgctctggtgtttgcatatatcataacaaagtcctacattgcctacatcctgctccctttattctatccactgacctacgtcttcggaatcatttattctaaacttaagcagtgtaagacgtgcatgttggctgcccacccctttactaattgccctaaaaggtgtgtgtgcggcagccggttcaactgtacagaggcgctgcgcgtgcatcgactaggcagagattgccaagggtacaagtccctctcaaaagcaaggcagatgtgtaagagtaaaagctggtcttttatcattgccatattcaccggactgatccttatggaatttattactccaatccacggtgagcggacatataagctgtccgagttggctgacgagttcatcgccatgaaaaccgaagtcacggttatgcagcgttcaatttacaaccagaagatactcaatatcgcactgttaaccctggtggtactcattatccttctggaaacatatatttttaagatcttgttcagcctactgtaccgcagttgctctatgtgtggcctcatacattacaaagtggggctgaagatcaaccttctgactaccaataaatgcggaacatgtatttgcggcttttccgagcaacagagctcgggtttcgaatatgaggtctttttgaaggatatgcacaaacagagagagtcttgtaagtacttccccatgctcaaccattttaggaatctgaagatcttaactaccattctgctactcatcctgcttgctacatccgtgtcaagtgaatgcttgcagaaacctctgaagataaaactcgaggacctgcacgaatgcattggggttaacttccttgacaagcaatgttataatcggaaaaacctgtacgagagcttgcgatccaagaatctcatctctgaagtggataagaaatatttcgagaacgccgacctggagggacagtttaagcgcattgaatacgcgcaggatgcccacagaatgatcttactggagaggatactatatagcaccgaatgcgagatgcatactatcctcacgaatggcggcgcatacaacattccatggcggacatacctgaaaaatcacaaccttaatttgtgtgggaagcatgtccacaaaatggtgtgccaatgtgtaaacacccacactcagtgcctgtcaaccggaatcgactatcaggatgaaattacaaagttctaccaggctgacggtgatagttatcgctccgacctcagcatcatactggagaccatttctactgcctttagaggcttaacaaaggttctgatcgagacgtacatcgaacaagataactcagagagtatgattaaacttttgaataccatccaggggaaggtgccgaacaattatcagatgctcggcattctgaaattcgctataaagatcatgaacattaatcagactaggggagtccgtagcgcccggcatacaatcgtgtccaacgacattcccatgtctgaacctttttcgaatttcgaggtcagcaacatcaatataaaacaatgtctagagccactgaccctcaagtgctttacaaaacgaggtgattcaccccactccaaccatctgctttgtaaggaacagagtaagtacaaagtgttcgagtggcctgaagttgagactgtgaccaagaataacaaattgtgcctgggggacacgcactgtaatttaaagtttaccgcaacaacttctgacgaaatcattaaactcctgaactgcttcagcgatacctataagccaaatcccggcgagatggagatcggacttaagaaatgcaacgccgaaaagattggcgagtgtgtaacactggaaaactccccgtggcctatcgtctactgcgagaataaatactattactcagaagctaaggagcatgcgaaagacgggagcgtgaactcttattgtttgactaataagtgcaccgaggatagactccccataaacccagcatggtttaagtcctgtaattgggaaaagaacattaaggagacggccacaatcaaagagttcgtttacaatgacatcaagagttataggaaaagcctggaatctgaaattaacaccgatctaatgatacaccactaccgccctactaagaatctgccccatatcaagccaatttataaatccctctcaatccagggaagtgagacagtggacggtctgcagaacagctttattgagggcgaaatgcccgctatctcggggcttgccaatggataccacttgatgtacaagggcacccaactgttcgatatagtcatcttcattcggaaagcagtgtataaggccaactactataaaatctacactaccggtccttccattgctatcaatatggagcataacgaacagtgcacagggcactgtccatctaagataccgagcaaagagaattggttaacgttttcaagagagcataccagttcctggggctgcgaagagtatggatgtctcgccattgacactggctgcctgtacgggtcttgtcaggatgtaatcaggcccgaaatcgacgtgtataaaaagagcggaacagagcagtcccttattgaactgtgcatcacctcagcacacgagacattctgcaacgatctagacatactcgagcctattatcggtgagaaaattagcgcgagttttcaatctactcagtccaaccagctgccaaatatcatagctttccgcaagggccaaattttgaccggggccatcaacgatctgggaaatacgggcagccagtgtggttcgatccagttagttaacaatacactcctgggggaaggcaacgtcaaatttgactacatttgccacgcaatgcgacggaaggacgtgatcattcgtagatgttacaatgatcatttcacctcatgcaaccttctgcagaaaaggtctgacttgataggaaatatcaacggcaaggaactccaaattagtatgtccgggcgcagcatgggatctatgaagtttaaaatcgagctgggcgatatcaattataagctatacactgaaaacgccgacattaccatacggggtgagtgtgggggatgcatcggctgtgctgaggccgtgagctgctccctggaagtcgagtcagcaagtgaaattctttgtaaagttgagtgcaattgtcagccctatatcgaaaacattctcatcaagcctcagacaaaaacttacagcttcaaggctacctgcctggagaagtctaatacattggatataaaaatctgcggtaagcagattatcgccccactgacgattaaatcctataaccaaaagatcgacttatcaaaactcgatgagagtaattacgtgaaggaagaggacctggcgtgtaacacctggctttgcaaggtgcagactgaaggctttaacttcgtatttagcgggctgttcgccggattcggcagatattggacaatagctatttacatcttgattgcagtcgtgatcatactcatcctgatttacatcctaatgcccatttttaggctgatccgaaccttccttattaaaaatgagatagagtatactacagaacagaagatgcgctga

SEQ ID NO: 11062 - RNA, 4257 nt, synthetic construct
  misc_feature 1..4257: note = derived and/or modified CDS sequence (opt3) from OROV/IQTV(MIS-0397)__KJ866387.1__GP
  source 1..4257: mol_type = other RNA
atggactgcatcattttctacctgagctttttcgccgtggtcaccgctcaccccgtttcccatcaccaggtgggcgatagatgttttgcagggggaaacctcataaaggaccttaataaaacagtaaacatcggtgaggtgtgcgtcagggatgacatttctatcattaagtcaactacggccatccagaaaagtctggatcatttgagcacccggacaaagttctatcgcgtgtacatagttaaagaatgggcggagtgtaatcctatcattgactatgctggcaactttatcgtgatgaatattgatgacaacgggcacttagtcccacgaatgcatacttgccgtgcctcctgtgatatcagactgaataagaacgacgcagaaataattctatcttcgcagaagaccaatcactacgagatcattggaacaaccactgtgtcaggctggttcaaaaacacaatcaatctcccgctggaacatacctgcgagcacatcacggtaaactgtggtcaaaagagccttaggtttcacgcctgcttccggatgcatcgcgggtgtactagatttttcaaaaatacctatatgcccagtacaatgattgagcacatgtgcgctaacctggaattgataatctttactctctacattttcaccgcactggtttttgcctatatcataacaaagtcctacattgcttacatcctgctccctttattctatccactgacctacgtgttcggaatcatttattctaaacttaagcagtgtaagacgtgcatgttggccgcgcacccctttactaattgccctaaaaggtgtgtctgcggcagccggttcaactgtacagaggcactgcgcgtgcatcgactaggcagagattgccaagggtacaagtccctctcaaaagccaggcagatgtgtaagagtaaaagctggtcttttatcattgctatattcaccggactgatccttatggaatttattactccaatccacggtgagcggacatataagctgtccgagttggccgacgagttcatcgcaatgaaaaccgaagtgacggtcatgcagcgttcaatttacaaccagaagatactcaatatcgctctgttaaccctggttgtgctcattatccttctggaaacatatatttttaagatcttgttcagcctactgtaccgcagttgctctatgtgtggcctcatacattacaaactggggcttaagatcaacctgttgactaccaataaatgcggaacatgtatttgcggcttttccgagcaacagagctcgggtttcgaatatgaggtatttctcaaggatatgcacaaacagagagagtcttgtaagtacttccccatgctgaaccattttaggaatttaaagatcctgactaccattctactcctgatccttttggccacatccgtgtcaagtgaatgcctgcagaaacctctcaagataaaactggaggaccttcacgaatgcattggggtcaacttcctggaccggcaatgttataatcgaaaggatttgtacgagagcctccgctccaaaaacctgatctctgaagtggacaagaagtatttcgagagcgcggatttaggaggccagtttaaaagaattgagtacgcccaggacgcacacaggatgatcctgctagaacggatactctattcaaccgagtgcgaaatgcatactatcctgacgaatggcggggcttacaacattccatggcgcacataccttaagaatcacaacttgaatctgtgtggaaaacatgttcacaagatggtgtgccaatgtgtcaacacccacactcagtgcctcagtaccggtatcgattatcaggacgagattacaaaattctaccaggccgatggcgactcctatagaagcgatctgtctatcatattagaaaccatttcaactgcttttagggggctgacaaaggtgcttatcgagacgtacatcgagcaagacaatagtgaaagcatgattaagttgctcaacaccatccagggaaaagtaccgaacaattatcagatgctgggcattctaaagttcgccataaaaatcatgaacattaatcagactcgtggtgttcggtccgcacgacatacaatcgtgtctaacgatattcccatgtcggagccttttagcaatttcgaagcctccaacatcaatataaagcaatgttcagagccactgaccctcaaatgctttacaaagagaggggacagtccccactctaaccatctgctttgtaaagagcagagcaagtacaaggtcttcgaatggcctgagatcgaaactgtgaccaaaaataacaagttgtgcctgggcgacacgcactgtaatttaaaatttaccgctacaacttccgatgagattatcaagctcctgaactgcttctcagacacctataaaccaaatcccggagaaatggagattggccttaagaagtgcaacgcggagaaaatcggggaatgtgtcacactggagaatagcccgtggcctatagtgtactgcgaaaacaagtactattactctgaggcaaaagaacatgccaaggatggatccgttaacagttattgtttgactaataaatgcaccgaggacaggctccccattaacccagcttggtttaagagctgtaattgggagaagaacatcaaagaaacggccacaatcaaggagttcgtgtacaatgatattaaatcttatcgcaagtccctggaatcagagataaacaccgacctaatgatccaccactaccggcctactaaaaatctgccccatattaagccaatctataagagtctcagcattcagggttcggaaacagtagatggcctgcagaactcctttatcgagggggagatgcccgcaatatctggacttgccaatggctaccacttgacctacaaaggtactcaactgttcgacatcgtcattttcatcagaaaggctgtgtataaagccaactactataagatttacaccacagggcctagcatcgcaataaatatggaacataacgagcagtgcacgggccactgtccatcaaaaattccgagtaaggaaaattggttaaccttttccagggagcatacttctagctggggatgcgaggaatatggctgtctcgcgatcgatacagggtgcctgtacggatcctgtcaggacgttatccgccccgagattgatgtgtataaaaagtcaggtaacgaacagagccttatcgagctgtgcataaccagtgctcacgaaacattctgcaatgacctagatattctcgagcctatcattggcgagaagatctctgcctcctttcaaagcactcagtcgaaccagctgccaaacataattgcattccgaaaagggcaaatcttgaccggagccatcaatgacctgggcaacacgggttcacagtgtgggtctattcagttagtcaataacacactcctgggcgaaggaaatgtgaagtttgactacatctgccacgctatgcggcgtaaagatgtaattataagaaggtgttacaacgaccatttcaccagttgcaatcttctgcagaagcgctccgatttgatcggcaacattaatgggaaagagctccaaatcagcatgtctggacggagcatgggctccatgaagtttaagatcgaactgggtgacattaactataaactatacactgagaatgccgatataaccatcagaggggaatgtggaggctgcattggttgtgcagaggctgtgtcatgcagtctggaggttgaatctagctccgagatcctttgtaaggtcgaatgcaactgtcagccctatattgagaatatcctcataaaacctcagacaaagacttactcattcaaagcgacctgcctggaaaggagtaacacattggacatcaagatttgcggcaagcagatcattgccccactgacgatcaaaagctataatcaaaagatagatttatccaaactcgacgagtctaactacgtgaaggaggaagatctggcctgtaatacctggctttgcaaagtgcagactgaggggtttaacttcgtcttttcgggactgttcgctggcttcgggcgatattggacaattgcaatctacattttgatcgccgttgtgataatcctcattctgatctacattctaatgcccatctttcgcctgatacggaccttccttattaagaacgaaatcgagtatactacagagcagaagatgagatga

SEQ ID NO: 11063 - RNA, 4257 nt, synthetic construct
  misc_feature 1..4257: note = derived and/or modified CDS sequence (opt3) from OROV/MDDV(FMD 1303)__KF697145.1__GP
  source 1..4257: mol_type = other RNA
atggccttcctgctcatctacgtggtccttgctgcagccgttgcgagccaccccctgtccaaccatcagattggcgacagatgctttgctgggggaaatttgataagggagttaaacaagaccgtgaatatcggtgaactgtgtgtacgggatgacatttctatgatcaaatcaacaactgccattcaaaagagtgtgggccacctaagcacgcgcaccaaattctatcgagtctacatcgtgaaggagtgggcagaatgcaaccctataatcgattttgccgggaatttcattatcatgaacattgacgagaatggacatctcgttccaaaaatgcacacatgtcgtgcttcctgcgatatcagactgaacaaggacgatgcagaaataattctttcttcgcagaagactaatcattatgagatcattggcaccacatcaatcagcggttggtttaaaaacaccatcaatctgccgttggagcacacttgtgaacacattacagtgaactgcgggcagaagagtctcaggttccatgcctgttttcggatgcaccgcggatgcaccagattctttaaaaatacgtacatgccctccactatgatagagaccatgtgtgtcaacctggaactgatcattttcacactctatatcttttctgctgccgtgttcgcgtacgtaataactaagagctatattgcatacatcttactgcctgttttctacccaatcacctatattcttggctccatctactcaaggttcaaacagtgcaagacatgtatgttggccgctcatcccttcaccagttgccctaagaaatgcgtgtgtggcagccggtttaattgcacggaggccctgcgcgtccaccgactagggaaggactgtcaaggatataaatctctctccaaggcaagacagatgtgcaaatcaaagagctggagtttcattatagctgtgtttactggtctgatccttatggagttcattacaccaatctctggcgaaaggatgtacaaactgtccgagttggccgaagagtttatcgaaatgaaggaggaggcgagcgccctcaagaaagcaattaacaacctgaagttactgaatgtgctcctttcggctatagccaccctggtcgttgtgatggaaacttatatcttcaaatctttgtttaacctactgtaccggtcctgttcaatgtgcgggctcattcactataagatcggactgcgtgtaaatcttctgacaaccaaccgctgtggcacgtgcatttgtggtttcaatgagcagcagagtagcgggtttgaatacgagatcttcttgaaagatatgcataagcaaagagaatcctgcaagtactttcccatgctcaaccacttcaggaatgtgaaaatactgaccgtctttttactgctaacaatgctcactgcttctgccagctcagagtgtctgcagaagcctcttaaaatcaagttggaggacctgcatgaatgcattggagtgaacttcctcaatcggcagtgctataacagtcaggagctgtaccaatcccttaaaagcaagaatctggtttctgaagtggataagaaatatttcgacaacaagaatttggaggatctctttaaacgaatcgaatacgcacaggacgcccaccgcatgattctgttagagagaatcctgtattcaaccgagtgtgaaatgcatacaatactaactaacggcggcgcttacaatattccatggaggacctatctcaagaaccacaacctgaatctttgcgggaaacacgtccataagatggtgtgtcagtgcatcaacacacacacccaatgtttgagtactggaattgactaccaggatgagatcacgaagttctaccaggcggacggtgatagctatcgggcagacctgtccgtaatactccagacaatcgccaccgcttttcgcggcatgactaaagttctgattgaaacctacatcgagcaagataattctgagtcgatgattaagttactgaacacaatcaaagaaaaggtgccgaataactatcagatgcttgggatattgaatttcgccattaaaatcatgagcgtcaaccagaccagaggagtgaggtccgcacgtcatactatcatttcaaatgacatccccatgagtgagacattttctaacttcgaagtcagcaatattgatgtgaagcagtgcacggaccctctcaccctgaaatgttttactaagcggggcgatgccccacactccaaccacctactgtgcaaggagcaaaataaatacaaggttttcgaatggcccgagatagagacagtgatgaaaaacaataagctctgtctgggtgacacccattgcaaccttaaatttgctgccatcgcatcagatgaagtaattaagttgctgaactgtttcagcgacacatataagcctaatccaggggagatggaagtcggcgcgaaaaagtgcaacgctgacaaaatcggagagtgcattactttagaaaataacccctggccgatcgtgtactgtgagaccaagtattactactctgatgccaaagagcacgcaaaggacggcaatgttaactcctattgcctcacgaataagtgtaacgaagatcgatttcctataaatcccacctggttcaaaagttgcagctgggacagaaacgtgaaggagacaactaccatcaaagaatttgtccataatgatatttctgcctacaggaagtccctggagtcagaaatcagtacagaccttctgattcaccattatcgcccaactaaaaacttgcctcacatcatgcccgcttacaagagcctcaccatacaggggtcggagacggtggatggactgcaaaattccttcattgagggtgaaatgccagccatctctggcctagcaaacgggtatcacctgaagtacaaaggaatcgagctctttgacattgtaatatttatccggaaggctgtgtataaagccaattactacaagatttatacaaccggccccagcgttgcgatcaacatggaacataacgagcagtgtactggttcatgccctaaaaagattccagccaaagagaattggctgacattcagtaaggaacacacctcctcttgggggtgtgaggaatacggctgccttgctatcgatactggatgtttgtatggcagctgccaggacgtcataagaccggaggtggatgtgtacaagaaagcatccgccgaacagtcactgatcgagttatgtattaccagcgctcatgagacattttgcaacgacctcgatatcctggaacccattatcggggacaagataagtgccgcattccagtctacgcaggtcaatcaacttcctaacattatcgcgtttaaaaagggacagatcttcaccggtgccattaatgacctgggcaacactgggtcccagtgcggaagcatccaactaataaataacacactcctgggcgagggtaatgttaaatttgattatatttgtcacgctatgaagaggaaggacgtgatcgtgcgccgatgctacaacgatcatttcgcctcgtgtaatttgctgcagaaacggtcagacttagtagggaccctcaacggcaaggaactgcaggtctctatgagtggacgttccatgggcagcatgaaatttaaggtggagcttggggatatttcttataaactgtacacagaaaatgcagacatcagcatatccggagagtgcggcggttgtattaactgcgctgaggccatctcatgtgcattggaaatcgatagtagcactgaggttctctgcaagctggaatgttcttgccagccatacattcaaaatatcctaattaagccccaggtgaaaaagtattccttcaaagccacctgttttgagaagagaaactcactggaagtcacggtgtgcaaaaagcagcacacaatacctcttaccatcaagagttacaatcagaaaattgacctcagcaggctggatgagtccaactatgttcgcgaggaagacttgacttgcaacacctggctgtgtaaggtggagaaagaagggatcggagtaatgttctctggcttattcgctggttttggcaagtactggtcgatcgcgatttatgccctcatagcactggtcatcttccttattctgatctacattttggtgccaatctttcggctcataagaacattcctgatcaaaaatgaggtggagtatactaccgaacaaaagatgaggtga

SEQ ID NO: 11064 - RNA, 4257 nt, synthetic construct
  misc_feature 1..4257: note = derived and/or modified CDS sequence (opt3) from OROV/MDDV(INHRR 17a-10)__KJ866390.1__GP
  source 1..4257: mol_type = other RNA
atggccttcctgctcatctacgtggtccttgctgcaaccgttgccagccaccccctgtccaaccatcagattggcgacagatgctttgccgggggaaatttgataagggagttaaacaagacagtgaatatcggtgaactgtgtgtacgggatgacatttctatgatcaaatcaactacggctattcaaaagagtgtgggccacctaagcacccgcacaaaattctatcgagtctacatcgtgaaggagtgggccgaatgcaaccctataatcgattttgcagggaatttcattatcatgaacattgacgagaatggacatctcgttccaaaaatgcacacttgtcgtgcctcctgcgatatcagactgaacaaggacgatgctgaaataattctttcttcgcagaagaccaatcattatgagatcattggcacaacctcaatcagcggttggtttaaaaacactatcaatctgccgttggagcacacatgtgaacacattaccgtgaactgcgggcagaagagtctcaggttccatgcatgttttcggatgcaccgcggatgcacgagattctttaaaaatacttacatgccctccaccatgatagagacaatgtgtgtcaacctggaactgatcattttcactctctatatcttttctgccgctgtgttcgcctacgtaataaccaagagctatattgcgtacatcttactgcctgtgttttacccaatcacatatattcttggctccatctactcaaggttcaaacagtgcaagacctgtatgttggcagcccatcccttcacgagttgccctaagaaatgcgtgtgtggcagccggtttaattgcactgaggctctgcgcgtccaccgactagggaaggactgtcaaggatataaatctctctccaaggccagacagatgtgcaaatcaaagagctggagtttcattatagcagtgtttacaggtctgatccttatggagttcattaccccaatctctggcgaaaggatgtacaaactgtccgagttggctgaagagtttatcgaaatgaaggaggaggccagcgcgctcaagaaagccattaacaacctgaagttactgaatgtgctcctttcggcaatagctactctggtcgttgtgatggaaacatgtatcttcaaatctttgtttaacctactgtatcggtcctgctcaatgtgtgggctcattcactacaagatcggactgcgtgtaaatcttctgaccacgaaccgctgcggcacctgtatttgcggtttcagtgagcagcagagctccgggtttgaatatgagatcttcttgaaagatatgcataagcaaagagaatcttgtaagtactttcccatgctcaatcacttcaggaacgtgaaaatactgacagtctttttactgctaactatgctcaccgccagcgcttcaagtgagtgcctgcagaagcctcttaaaatcaagttggaggacctgcatgaatgcattggagtgaatttcctcaaccggcagtgttacaattcccaggagctgtatcaaagccttaaatctaagaacctggtttcagaagtggataagaaatacttcgacaataagaacttggaggatctctttaaacgaatcgaatatgcccaggacgcacaccgcatgattctgttagagagaatcctgtacagtacagagtgcgaaatgcatactatactaaccaatggcggcgcctataacattccatggaggacatacctcaagaatcacaacctgaacctttgtgggaaacacgtccataagatggtgtgccagtgtatcaatacccacactcaatgcttgagcacgggaattgactatcaggatgagatcacaaagttctaccaggctgacggtgattcctaccgggcggacctgtctataatcctcgaaaccattgcaactgcctttcgcggcatgaccaaagtactgatcgagacatatattgagcaggataactcggaaagcatgatcaagttactgaataccataaaagagaaggttccgaacaattaccaaatgcttgggattttgaacttcgctatcaaaatcatgtccgtgaatcagactagaggagtcaggtcagcccgtcatacaattatcagtaacgacattcccatgtctgaaacgtttaccaatttcgaggtgagcaacatagatgtcaagcagtgtactgaccctctcacactgaaatgctttaccaagcggggcgatgcaccacactccaatcacctactgtgtaaggaacagaacaaatataaggtgttcgagtggcccgagatcgaaacagttatgaaaaataacaagctctgcctgggtgacactcattgtaatcttaaatttgccgctattgcctcagatgaggtgatcaagttgctgaactgcttcagcgacacctacaagcctaacccaggggaaatggaggtaggcacgaaaaagtgcaatgcagacaaaattggagaatgtatcaccttagagaacaatccctggccgatagtctattgcgagacaaagtactattactctgatgcgaaagaacacgctaaggacggcaacgttaattcctactgtctcactaacaagtgcaatgaggatcgatttcctatcaaccccacctggttcaaaagttgtagctgggacagaaatgttaaggaaacaactaccattaaagagtttgtgcataacgatatctctgcctataggaagtccctggaatcagagattagtacggaccttctgatccaccattaccgcccaaccaaaaatttgcctcacataatgcccgcatataagagcctcacaattcaagggtcggagactgtcgatggactgcagaactccttcatcgaaggtgacatgccagccatctctggcctagctaatgggtaccacctgaagtataaaggaattgagctgttcgatatagtgatctttattaagaaagccgtatacaaggcaaactattacaaaatctacacaaccggccccagcgtggctattaatatggaacataacgagcagtgcactggttcatgtcctaagaaaatcccagccaaggagaactggctgaccttcagtaaggaacacacatcctcttgggggtgcgaggaatatggctgtcttgcgatagacacgggatgcttgtacggcagctgtcaggatgttatccggccggagattgacgtctataaaaaggcctccgctgaacaatcactgatcgagttatgcattaccagcgcacatgagactttttgcaatgatctcgacatcctggaacccataattggggacaaaatcagtgccgctttccagtctacacaggtgaaccagcttcctaatatcattgcctttaagaaaggacaaatcttcaccggtgcaataaacgatctgggcaatacagggtcccagtgtggaagcattcagctaatcaacaatactctcctgggcgagggtaacgtgaagtttgactacatttgccacgcgatgaagagaaaagatgtcatcgttaggcgctgttataatgaccatttcgcctcgtgcaacttgctgcaaaagcgatcagatttagtggggaccctcaatggcaaagaactccaggtgtctatgagtggacggtccatgggcagcatgaagtttaaagtagagcttggggacatatcttacaagctgtatacggaaaacgctgatattagcatctccggagagtgtggcggttgcatcaattgtgccgaggcaatttcatgcgctttggaaatcgacagtagcacagaggtcctctgtaagctggaatgctcttgtcagccatacattcagaacatactaatcaaaccccaagtgaagaaatactccttcaaggcgacctgctttgagaaacgtaattcactggaagttactgtgtgcaagaagcagcacaccattcctcttacaatcaaaagttataaccagaagatcgatctcagcagactggacgagtccaattacgtcagggaggaagatttgacttgtaacacctggctgtgcaaagtggagaaggaagggattggagttatgttctctggcttattcgcaggttttggcaaatattggtcgatagccatctacgctctcattgcgctggtgatcttccttattctgatctatatattggtaccaatctttcgcctcattcggacattcctgatcaagaacgaggtcgagtacacgaccgaacagaagatgagatga

SEQ ID NO: 11065 - RNA, 4257 nt, synthetic construct
  misc_feature 1..4257: note = derived and/or modified CDS sequence (opt3) from OROV/Perdoes virus(BeAn789726)__KP691625.1__GP
  source 1..4257: mol_type = other RNA
atgttcatccagtttaacctggccttcttttgcctcagcattgtgtgtggccacccccttaccaaggaccatataggggatagatgcttcgctggaggtaatctgtttaaagagatcacacaaactacgggcttgtccgaaatttgtatcaaggacgatatttctatcataaaatcacaggtcgagatcaagaaacagagtagcgaagttacctacgcagtgaagttctatagggtatacttagtgaaggagtggtccgaatgcaaccctattcaggaccaacacgggtctatcatgattctggatgtcacaaatactggactaatcgtgccaaaaatgtatacctgtcgggccgcgtgcgacataacactcgataaggacaacgctgaggttgtgtttatttcgcagaaaaataacaattacgagctggccggcaccactgtcatgcatggttggttcaagaacgtggtatcaatcaaacttgaacacacatgtgagcatctgaccgcaacgtgcgggcagaagactgttaagtttcacgcctgtttccgccagcaccgagcttgcgcacgttttctaaaaaccacatatatgccgattgtgatggtcgaaagcctctgtagtaatctggagctggtgatcttcatcacttacatttttgtgtgcctcgccttcgctttcataatcaccagaacatatgtcgcctacttactgattcccgtgttttaccctttcacctatgcgtacggaaagatgtatcttaaatgcgttaagacgtgtccaaactgcttgctggcaatgcatccctttactaattgtacaaacctatgcatctgtggctccaggttctctaataccgagagcctcaaagtacaccggctgggcaactgctacgggtataaggccctttccggagctcgctcaatgtgtaaaagtaaggtgagctcttttactacagccatgttctttggtataattatcctgtccttcatcgcacctttgaatggcgaaagactctacaagctgtcagagttaccagatgaatatattgagatggaaagcaccatcgaggggagtaaacaaaaggagacgattgtcgacataatcaactacaccgctctggtgctcattcttatcacaatcctgttgcagggaattttggaaaactacatatttaggctgaaattccggttttgctctttctgtgatatgatccatatgaagaaaaatctcaagatcttttccaacatgactaataagtgcggcacctgtatttgcggtttcaaccaggagattcgcagcgggttcgactatgaagtttttatcaaagatatgcacgtgtcgcgagagtcttgcaagtacaattatcacaaaaactactccttctatataaagatgctgcttgtcgtgctgttggtacccctcatcggaacaactgccgcggaagacaccaaatgtctgaagtacgacttaaataagaacattgaggatctgaaagactgctatggcctaaagctcaatatcgataaacatgacacagttgagaacgcctacaagaatctggtggatcagaaacttgtctcagaattggacagactggatctcaacattatgctgggcagtaaggagagcatctttgaagcaatagagacctccatgaatattcaccaaatggtgttccttgaatacctggcttataagactgaccctaaattgtctgagatcaagcagaacacggggccatacaatattgcctggaggacatttatccatggaaacagcctcgaggtctgtggtaactatccgtacaaactgatatgctattgtatcaatcagaagacccactgcgaaaactcaactgtggattacggcattcaaatccagcccttctataatcagcatcctaacagttacaaatccgacatggaggctttaattaagaccgttcagatcgcctttcgggggataattaaagtgctgatccaatactatgtagaaaataacaagacaagcgagctatctaatctcctgaccgagcttcgtaacgtcatgggaaataacatccagatgaagggcattttgaaatacctggaaacttatctcaagaaaccactgttaatggcacgcacaatcagaattgccgctaaggtggatacgtcaggtgacccctacaataacttcagtaccagcaaagagaatataactaagtgtatcaagattcagaaactgaggtgcatcacaaagctgacccggattgaacacaactatatcttgtgtggggactccgagaaaaagctctaccagtggcctgcgaaaccaacaatagttgatgacaatgatgcatgcctgggcgacaagcactgtcatctaccctttatcccgattggaaacgatgaagccatcaagactgtgaactgctatgtcgaggtgtacgagcaaaatcctggcgacatgaactcttaccagaaaaagtgcgatgctatgaatgtagggacctgtctgacgattaaaaacgaaaattggcccatcgtgcagtgcaagaccggaaaatattactatgccgacggtcgaatacacgcaaaggatggcacaattaacacttactgtttctcggagaagtgcaatgccgaccgctatccaatccatcaggattacatcaacagctgtaattggcaagaaaccattaaagactttcagcacgttagagagttcgtccacctcgatatagaatcctataagaaagctatcgagtcagacattaagacagacctggtggtgcataaatttaggcctgtcaagaaccttccccacgttatcccaatttacaaaagtatcactgtgcaggggaccgagacgtctgatggaatacagaatgccttcatccaaggcagcatgcccgcaatttccggtttggcgaacgggtaccatctgttcacacctgactcaaagcagttatttgatgtggtactcttcctgcggaaggctagctataaagccgaataccgcaagatctattctaccggcccaactattggaatcaatgtcgagcacaacgaaaaatgcacaggctcctgtccgaagaccatagacaaaaaggataattggcttacttttagtaaggagcataccagccagtgggggtgcgaagagtacggatgtctggcaattaacacaggttgcgtgttcggctcttgtcaagacatcatcagacccgagattgatgtttataaaatgcacggggccgaaaggtccgtggtcgagttgtgcatcacgctccctcacgaaacctactgcaacgacctggatgtgctagagccaataattggagacaagatccaggctgcctttcagactgttcagtcaaatcatatgccccgtctgatggcaattaaaaacaataaggctttcacaggccaaatcaacgatctcggtagtaccgccagctattgtgggtcggtgcagaaatttaatgagacaataattggccagggagaccctaagttcgattacgtatgccaccttcttaagcggaaagacatcatcgtccgaagatgttactccaacaattatgaatcttgcaagttgctgactccaagggcggacattatcgtggataaaaagggcgagagcttacaggcctcaattgtggggctcaacctgggacaaatgaattttaaaataatgcttggcgacatcaactacaagcagtataccgaaagtaataacctggaggctacgggtcagtgtgtcgggtgcgttgattgttccgaagacattgtgtgcaatctaaagatcgagtctcagagcgagtccgtatgtaacatcaaatcagattgcaatctctacctgagcagtatgttgattcaacccacagtgggagaatataacctgaagatgtcttgtaatgcaaaattagacaaggtcaacatagagatctgcaaacagaagttcgtgctcccgctgaccattaagtcccataaccagaaaatcgatcttagcaagctggacgaatcgaattacattcgcgaggaagatttgaaatgcgacactatgatctgtaaggttaaagatgagggcctctcatttataaccaactctctgttcggtggcatcagttatttctggaagattctaatctccagcctgattgtgatctttcttataattctcttctactacgtcgggctgcctatcttgcggctgattaaagactatttaaaggagaatgaactcgagtacctggccgaaggaaagtga

SEQ ID NO: 11066 - RNA, 4257 nt, synthetic construct
  misc_feature 1..4257: note = derived and/or modified CDS sequence (opt3) from OROV/Perdoes virus(BeAn790177)__KP691628.1__GP
  source 1..4257: mol_type = other RNA
atgttcatccagtttaacctggccttcttttgcctcagcattgtgtgtggccacccccttaccaaggaccatataggggatagatgcttcgctggaggtaatctgtttaaagagatcacacaaactacgggcttgtccgaaatttgtatcaaggacgatatttctatcataaaatcacaggtcgagatcaagaaacagagtagcgaagttacctacgcagtgaagttctatagggtatacttagtgaaggagtggtccgaatgcaaccctattcaggaccaacacgggtctatcatgattctggatgtcacaaatactggactaatcgtgccaaaaatgtatacctgtcgggccgcgtgcgacataacactcgataaggacaacgctgaggttgtgtttatttcgcagaaaaataacaattacgagctggccggcaccactgtcatgcatggttggttcaagaacgtggtatcaatcaaacttgaacacacatgtgagcatctgaccgcaacgtgcgggcagaagactgttaagtttcacgcctgtttccgccagcaccgagcttgcgcacgttttctaaaaaccacatatatgccgattgtgatggtcgaaagcctctgtagtaatctggagctggtgatcttcatcacttacatttttgtgtgcctcgccttcgctttcataatcaccagaacatatgtcgcctacttactgattcccgtgttttaccctttcacctatgcgtacggaaagatgtatcttaaatgcgttaagacgtgtccaaactgcttgctggcaatgcatccctttactaattgtacaaacctatgcatctgtggctccaggttctctaataccgagagcctcaaagtacaccggctgggcaactgctacgggtataaggccctttccggagctcgctcaatgtgtaaaagtaaggtgagctcttttactacagccatgttctttggtataattatcctgtccttcatcgcacctttgaatggcgaaagactctacaagctgtcagagttaccagatgaatatattgagatggaaagcaccatcgaggggagtaaacaaaaggagacgattgtcgacataatcaactacaccgctctggtgctcattcttatcacaatcctgttgcagggaattttggaaaactacatatttaggctgaaattccggttttgctctttctgtgatatgatccatatgaagaaaaatctcaagatcttttccaacatgactaataagtgcggcacctgtatttgcggtttcaaccaggagattcgcagcgggttcgactatgaagtttttatcaaagatatgcacgtgtcgcgagagtcttgcaagtacaattatcacaaaaactactccttctatataaagatgctgcttgtcgtgctgttggtacccctcatcggaacaactgccgcggaagacaccaaatgtctgaagtacgacttaaataagaacattgaggatctgaaagactgctatggcctaaagctcaatatcgataaacatgacacagttgagaacgcctacaagaatctggtggatcagaaacttgtctcagaattggacagactggatctcaacattatgctgggcagtaaggagagcatctttgaagcaatagagacctccatgaatattcaccaaatggtgttccttgaatacctggcttataagactgaccctaaattgtctgagatcaagcagaacacggggccatacaatattgcctggaggacatttatccatggaaacagcctcgaggtctgtggtaactatccgtacaaactgatatgctattgtatcaagcagaaaacccactgcgaaaattcaactgtggattacggcattcaaatccagcccttctataaccagcatcctaatagttacaagtccgacatggaggctttaattaaaaccgttcagatcgcctttcgggggataattaaggtgctgatccaatactatgtagaaaacaataagacaagcgagctatctaacctcctgaccgagcttcgtaatgtcatgggaaacaatatccagatgaaaggcattttgaagtacctggaaacttatctcaaaaagccactgttaatggcacgcacaatcagaattgccgctaaagtggatacgtcaggtgacccctacaacaatttcagtaccagcaaggagaacataactaagtgtatcaaaattcagaagctgaggtgcatcacaaaacttacccggattgaacacaattatatcttgtgtggggactccgagaagaaactctaccagtggcctgcgaagccaacaatagttgatgacaacgatgcatgcctgggcgacaagcactgtcatctaccctttatcccgattggaaatgatgaagccatcaaaactgtgaactgctatgtcgaggtgtacgagcaaaaccctggcgacatgaactcttaccagaagaaatgcgatgctatgaatgtagggacctgtctgacgattaagaatgaaaactggcccatcgtgcagtgcaaaaccggaaagtattactatgccgacggtcgaatacacgcaaaggatggcacaattaatacttactgtttctcggagaaatgcaacgccgaccgctatccaatccatcaggattacatcaatagctgtaactggcaagaaaccattaaggactttcagcacgttagagagttcgtccacctcgatatagaatcctataaaaaggctatcgagtcagacattaaaacagacctggtggtgcataagtttaggcctgtcaaaaatcttccccacgttatcccaatttacaagagtatcactgtgcaggggaccgagacgtctgatggaatacagaacgccttcatccaaggcagcatgcccgcaatttccggtttggcgaatgggtaccatctgttcacacctgactcaaagcagttatttgatgtggtactcttcctgcggaaagctagctataaggccgaataccgcaaaatctattctaccggcccaactattggaatcaacgtcgagcacaatgaaaagtgcacaggctcctgtccgaaaaccatagacaagaaggataactggcttacttttagtaaagagcataccagccagtgggggtgcgaagagtacggatgtctggcaattaatacaggttgcgtgttcggctcttgtcaagacatcatcagacccgagattgatgtttataagatgcacggggccgaaaggtccgtggtcgagttgtgcatcacgctccctcacgaaacctactgcaacgacctggatgtgctagagccaataattggagacaaaatccaggctgcctttcagactgttcagtcaaaccatatgccccgtctgatggcaattaagaataacaaggctttcacaggccaaatcaatgatctcggtagtaccgccagctattgtgggtcggtgcagaaatttaacgagacaataattggccagggagaccctaagttcgattacgtatgccatctgcttaaacggaaggacatcatcgtccgaagatgttactccaataactatgaatcttgcaaattgctgactccaagggcggacattatcgtggataagaaaggcgagagcttacaggcctcaattgtggggctcaatctgggacaaatgaactttaagataatgcttggcgacatcaattacaagcagtataccgaaagtaacaatctggaggctacgggtcagtgtgtcgggtgcgttgattgttccgaagacattgtgtgcaacctaaaaatcgagtctcagagcgagtccgtatgtaatatcaagtcagattgcaacctctacctgagcagtatgttgattcaacccacagtgggagaatataatctgaaaatgtcttgtaacgcaaagttagacaaagtcaatatagagatctgcaagcagaagttcgtgctcccgctgaccattaaatcccacaaccagaagatcgatcttagcaaactggacgaatcgaactacattcgcgaggaagatttgaagtgcgacactatgatctgtaaagttaaggatgagggcctctcatttataaccaattctctgttcggtggcatcagttatttctggaaaattctaatctccagcctgattgtgatctttcttataattctcttctactacgtcgggctgcctatcttgcggctgattaaggactatttaaaggagaacgaactcgagtacctggccgaaggaaaatga

SEQ ID NO: 11067 - RNA, 4284 nt, synthetic construct
  misc_feature 1..4284: note = derived and/or modified CDS sequence (opt3) from OROV/UTIV(BeAn84785)__KF697155.1__GP
  source 1..4284: mol_type = other RNA
atgttcctgatctttattctcatacagatcgccgctagcacacccctttcccctcaacaggtgggcgacagatgcttcattgggggatctctgatcaaggagattaaccagtcaaccggtttgggcgaagtctgtatcaaagatgacataagtatcattaagagcatcaatattcagaaaaagatctccaacgatcaagttcagaatactgtgaaattttacaagacgtatatagcaagggagtggcacgactgcaacccaattttcgatgaacatgggtcttttatggtattcgacatctcgaataccggatcaattatcccgaagatgcacacatgtcgggcccagtgcgagatcactttaaacaaagataatgcggaagtgatttttaccagcgctaagacaaaccattacgaggtcagtggcaccactacagtgaatggttggttcaaacagaccatatccgtttctctggagcacacgtgtgaacatatcattgccagctgcgggcaaaagtccctaaaatttcacgcatgtttccgccagcaccgatcatgcgtgcgtttcttcagaaacagttatctcccctacaagatgatcgagagcctgtgtataaatattgaacttatcatcattctgtgctatgccttgctctgttttatcttcgcttacattataactaagacctatatcgcatacctgctgattcctctcttctacccaatcacatatatctacggaaaaatttataacaagtactttaaaaggtgcaagtcttgcttactggccgtccatccccttactaattgtaacaaaacctgcgtgtgtggctgccggttcaattccacagaggctttgaaggtacaccgcctgggcaaagactgtaacgggtttaaggccctatcaaaggcgagattcctctgcaaaagcaccggacctagttttacgatatgtttcctgactggtatgcttatcctgtcttttattacaccaatcaactccgagaagttgtataaactcgaagaactgcccgatgactacattaatttagaaaaccagctgagcgagtgcaataacaataagcagatcaccagggcactcgccgttgcttgtatacttggcaacatcctgttcgtgttgtttttcaaatttatttataataagctaatcaacaatatttaccggacttgcaacctgtgtaatatggtccatcaccgcaagaacctcaaaatctactcggaatttacaaataagtgcgggacctgcgtgtgtggatttaacgaggagatacgatctggcttcgattatgaagtgttcattaaagacatgcacatctttagagataattgcctgttcaagttttactccaaatattcaattatctacatatgtatcattatccttgtcattaacctgcaattgggtatgacgctcgccgaggaaaccgagacaaactgcctgaatttacctatcagtgcacagactctggacatagttaagtgttatgggctaaacctcaatattaccgaaaacaagcagaaaagcgacctgatctccgagcttaagtctcaaaagacaatcactgatcatgacattccagatttcaatatcattgacatgaagaccgagagcgcttttgagaaaatagagacagccgaaaacatccacaggatggcgttcttggagtacattctgtataagatggaatcaaagctcaataccatcaaaactaacagtggaccgtacaatgtggcctggcggacgtacattaagtatcataacctggatgcatgcggcaaatacccccacaagacaatctgtacctgcataaatgctcatctttcctgtagccagcctactgtagactctaactcagagatcaaaaccttttatagtaatcaccagagcgccttcaagaacgatattaatgtgctgatcgagacaatttccatcgcttttcgtggcataattaaagtctctatcaacttgctcctgaagaacaataagatcgacgaattaaaagagctgctaaccaacatttcgaagaaactcgatactaatatacagatgaaggggatcctgcttttcacagccgaacaattgaaaacgcaggagaccactgtaaagagcatgcagcagacacgcatggcaattatcgttaagccactggagtccatgaccggagacaaatttgataacttctcaacaactaatagaaacattaccaagtgcaaagaagccaagagtctctcttgttacatgacgaggaaaaatagcatcaacaagtatctgttatgcaatctggacggttacaagatattttcctggcccgagaaacctaccctttcaatcaacaataacatttgcatcggcgacagccactgtaatttgtatttcaagccaattctcaacgatgaagctatcaaaacaataaattgctacaagggggacttcactcccaacccgatggatatgggatctgcgattaaaaagtgtgaggcaaaggaaatcggcgactgcctggtgggtgataacaatatgtggcctatcattcaatgttccaacgagaaatactattacgccgacgggaagaatcatgctaaagagggcgatatcaacagttattgcctaagcgaaaagtgtaataccgaccggtttcccatacacaacgagtggttcaaatcttgcaagtggatttccacaatcaaagaatcaattagtgtcaaggagtttgtgcatctggatatcgaaagctacaagaaaggaatagagtcggacattcgaactgatctcatcatccacaagttccgcccagtgaaaaatctgcctcacattgcccccaagtataaatccatcaccatttctggcatacttgttgcagacgggatccagaacgcctttgtgagcggagagatgccagctatttcaggtttgggcatcgggtacaatctgtatagtcccgatggaacgaagttattcgacatcgtcctctttctgagaaaggccatttacaaatcctcttacaaacttatatataaaacaggccctaccatcggtattaacgtggaacataatgagcagtgtactgggagctgcccatccacaatcccgaagcaggaaggctggctgaccttctcaaaagagcacactagccaatggggatgtgaagagtttggctgcttggcaattgacaccgggtgcctctacggaagttgtcaggatatcataaggcccgagatgtctatctataagatgctgggtgaagagatgacatccattgaaatctgcctaacgacccctaaggagacttactgtaacgacctggatctcctggagccacttattggcgacaaaatcgaagtcagcttccagacagtgcagtcgtcacatatgcccaagataattgcggttaaaaataacaaggtgtataccgggcaaatcaatgatattggaaacacagctaatatctgcggctctgtacagataatcaacaaaactgtcattggtcaggggaaccctaagtttgactacttgtgtcacgccatgaagcggaaagatgtgatcgttcgcaagtgctatgacaatcatttcgagacctgtaaactgttagaagagagaagtgaaattctcatcaaccaacagtccgatacgatagcagccagcatgtctggcaagaatctgggaattatgaacttcaaatttgctcttggcgacatcgattacaagacattcaccgaggacgccagctttgatatcaaggggcagtgcgtgggatgtattaattgcatcgaggaaatagtctgtgagctgaacattgtgtccacttcaagtatcctatgcaccattaaaacaccatgcgaaaattaccacaacagcctcgagatcaatcccgcaactaccaagtatcacataaaaatgtcttgtccgcataacatcgacaagatgaaaattacaatctgctccaaggacctggaaatgcctttgacgctgaaacagcacgatcaaaagattgacttatcaaagctcgatgagagtaattacatcaaagaggaagacctgaggtgtagcacctggctttgcaaggtaaaagaggaaggcattggtttcatcttttccgggatattcggaaactttggcaagtattggactattttcctgatcgtgttggttatcctcgctacaggtctgctaggcatttttgtcatatacccatgttgcaaacgtctgcgggggttccttgagatcaatgatattgcctatctcgcggaacagaagatgaagtga

SEQ ID NO: 11068 - RNA, 3231 nt, synthetic construct
  misc_feature 1..3231: note = derived and/or modified CDS sequence (opt3) from HRTV(TN)__KJ740147.1__GP
  source 1..3231: mol_type = other RNA
atgatcgtgcccattgtcctgttcctcaccctttgccctagcgagctgtccgcctggggctctccaggggacccgatagtttgtggagtgagaacagaaactaacaagtcaatccagattgagtggaaagaaggtaggagtgagaagttgtgccaaatcgatcggttaggccacgtaacgagctggctgcgcaatcattcctcttttcaggggctagtgggacaggtcaaaggccgaccctcggtgtcatacttccctgaaggtgctagctatccacgttggagtgggctcctgtccccctgtgacgcagagtggcttggaatgattgccgtttctaaggcgggcgataccgacatgatcgtgcctggcccaacatacaaagggaagatatttgtcgagagacccacttataacggatacaagggttggggctgcgctgatgggaaaagcctgtcccactcaggaacctattgtgaaacagacagtagcgtgtcttccggcttgatccagggtgatagggtactctgggttggggaggtggtctgccaacggggaacccctgtgccagaagacgtgttctcagagctggtcagcctgagtcagtctgagtttccggatgtttgtaagattgacggcgtggccctcaatcagtgcgaacaggagtccatcccccaacctttagatgtagcatggattgacgtgggccgcagccataaagtcctgatgagagaacacaagactaaatgggtgcaggagtcgtctgccaaggatttcgtttgttttaaggtggggcagggaccatgctccaaacaggaagaggacgactgtatgtcaaagggtaactgccatggcgatgaggtcttctgcaggatggctgggtgtagtgcacggatgcaagacaatcaggaaggatgccgctgtgagcttttgcagaaacccggcgaaatcatagtgaactacggtggggtaagcgttcgacctacatgctatggcttttccagaatgatggccaccctggaggtgcacaagccagatagggaactaacgggatgtactggctgccacctcgagtgtattgaagggggagtcaaaatcgtgaccctgacatctgagcttcggagcgctactgtctgcgcctcacatttctgtgcgagtgcaaagggtggctccaaaaccacagacattctgtttcacaccggggccttggtgggacccaatagcatccgtatcacgggccaactcctggatggttctaagttctcatttgacgggcattgcattttcccggatggctgtatggctttagactgcactttctgcaaggagtttctgcgcaaccctcagtgttaccccgttaaaaagtggcttttcctcgtggtagtcataatgtgctgttactgcgccctgatgttgctaacaaatatcctgagagcaattggagtgtggggcacctgggtttttgctccaatcaaactcgccctggcgcttgggctgaggttggccaagctcagtaaaaagggactggtggcagtcgtgactcggggtcagatgatagtaaacgatgaattacaccagattcgagtggagcgcggcgaacaaaatgaggggagacagggatatggccctaggggtcccatccggcactggctgtacagcccagctctaatcctcattctgacaacctccatctgttctgggtgcgacgagcttgttcatgccgaaagcaagtcgattacgtgtaaatccgcttcaggcaacgagaaggaatgcagtgtcaccggacgcgccttgctgcccgcagtgaatcctggccaggaggcctgtctccacttctctatgccagggagcccggattccaaatgcctgaagataaaagtgaagtcaatcaaccttagatgtaagcaggctagctcttattacgtccccgaggcgaaagcaaggtgcacatccgttcgtcggtgccgatgggccggagactgtcaaagtggctgccctacttattttagctctaattccttctcagacgattgggctaacagaatggacagggccggtctggggatgagtggatgtagcgatggctgcggtggcgcagcctgtgggtgctttaacgctgccccatcgtgtattttctggcgcaagtgggtggaaaatccctccaaccgggtgtggaaagtatctccttgcgcaagctgggtcttggcggctaccatcgagctcacactgccatcaggagaagtgaagactttagagcccgttaccggccaggccacacagatgtttaaaggggtggcaatcacctacctgggaagttccattgaaatagtcggcatgactagactatgtgagatgaaggagatgggtacggggatcatggccctcgctccgtgcaatgaccctggacatgccattatgggcaacgtgggtgaaatccagtgttctagcattgagtccgcaaagcacatcaggtcagatggctgcatatggaatgctgacctggttgggatcgaacttcgcgtggatgacgccgtatgcttcagcaaattgacaagtgtcgaggcggtggccaacttttctaagattccagctaccatctccggagtgcgattcgatcaaggcaatcatggggaaagccggatttatggatcgcccctggacatcactcgtgtctcaggcgagttttctgttagtttcagaggtatgaggctcaaactgtccgagataagcgcatcttgtaccggggaaattacaaacgtgagcggatgctactcctgtatgaccggcgcctcagtaagtatcaagttacacagctctaaaaatactacaggtcacctgaagtgcgattccgacgagacggctttctcagtgatggaaggcacccatacttaccgccctcacatgagttttgataaagccgtcattgacgaggaatgtgtgcttaactgcgggggacatagctccaagttgctcctgaagggctctctagttttcatggacgtgccccggtttgtcgatgggtcgtatgtgcagacataccacagcaaagttccagcaggaggcagagtgcctaatcccgtcgactggctgaacgccctcttcggtgatgggatcaccaggtggatactgggaatcattggcgtacttttggcgtgtgtgatgctgtttgttgtggtcgtggctatcacacgacgcttaattaagggcctcactcagcgggccaaagtagcatga

SEQ ID NO: 11069 - RNA, 3231 nt, synthetic construct
  misc_feature 1..3231: note = derived and/or modified CDS sequence (opt3) from HRTV(Patient2)__JX005844.1__GP
  source 1..3231: mol_type = other RNA
atgatcgtgcccattgtcctgttcctcaccctttgccctagcgagctgtccgcctggggctctccaggggacccgatagtttgtggagtgagaacagaaactaacaagtcaatccagattgagtggaaagaaggtaggagtgagaagttgtgccaaatcgatcggttaggccacgtaacgagctggctgcgcaatcattcctcttttcaggggctaattggacaggtgaaaggccgaccctcggtctcatacttccctgaaggtgctagctatccacgttggagtgggctcctgtccccctgtgacgcagagtggcttggactgatcgccgtgtctaaggcgggcgataccgacatgatagttcctggcccaacatacaaagggaagatctttgtggagagacccacttataacggatacaagggttggggctgcgctgatgggaaatcgttgtcccactcaggaacctattgtgaaacagacagtagcgtctcttccggcctcattcagggtgatagggtgctgtgggtaggggaggttgtgtgccaacggggaacccctgtcccagaagacgtgttctcagagctggtgagcctcagtcagtctgagtttccggatgtctgtaagatcgacggcgttgccttaaatcagtgcgaacaggagtccattccccaacctctggatgtggcatggatcgacgtaggccgcagccataaagtgcttatgagagaacacaagactaaatgggtccaggagtcgtctgccaaggatttcgtgtgttttaaggttgggcagggaccatgctccaaacaggaagaggacgactgtatgtcaaagggtaactgccatggcgatgaggtgttctgcaggatggctgggtgtagtgcacggatgcaagacaatcaggaaggatgccgctgtgagttgctgcagaaacccggcgaaataattgtcaactacggtggggtgagcgtacgacctacatgctatggcttttccagaatgatggccaccctagaggttcacaagccagatagggaactcacgggatgtactggctgccacctggagtgtatcgaagggggagtgaaaattgtcacccttacatctgagctgcggagcgctactgtgtgcgcctcacatttctgtgcgagtgcaaagggtggctccaaaaccacagacatcttgtttcacaccggggccctcgtcggacccaatagcatccgtattacgggccaactgttagatggttctaagttctcatttgacgggcattgcatattcccggatggctgtatggctctggactgcactttctgcaaggagtttctccgcaaccctcagtgttaccccgtgaaaaagtggcttttcctggttgtggtaatcatgtgctgttactgcgccttgatgctactgacaaatattctcagagcaatcggagtctggggcacctgggtgtttgctccaataaaactggcccttgcgctggggttgaggctcgccaagctgagtaaaaagggattagttgcagtggtcactcggggtcagatgattgtgaacgatgaactgcaccaggtacgagtggagcgcggcgaacaaaatgaggggagacagggatatggccctaggggtcccatccggcactggctatacagcccagctctcatcctgattcttacaacctccatctgttctgggtgcgacgagttggttcatgccgaaagcaagagcattacgtgtaaatccgcttcaggcaacgagaaggaatgcagtgtcaccggacgcgccctgctccccgcagtgaatcctggccaggaggcctgtctgcacttctctgtgccagggagcccggattccaaatgccttaagataaaagtcaagtcaatcaacctgagatgtaagcaggctagctcttattacgttcccgaggcgaaagcaaggtgcacatccgtgcgtcggtgccgatgggccggagactgtcaaagtggctgccctacttattttagctctaattccttctcagacgattgggctaacagaatggacagggccggtttggggatgagtggatgtagcgatggctgcggtggcgcagcctgtgggtgctttaacgctgccccatcgtgtattttctggcgcaagtgggtggaaaatccctccaaccgggtatggaaagtctctccttgcgcaagctgggtgctcgcggctaccatcgagctgacattaccatcaggagaagttaagactctggagcccgtgaccggccaggccacacagatgtttaaaggggtcgcaatcacctacctaggaagttccattgaaatagtgggcatgactagactctgtgagatgaaggagatgggtacggggatcatggccctggctccgtgcaatgaccctggacatgccattatgggcaacgttggtgaaatccagtgttctagcattgagtccgcaaagcacatcaggtcagatggctgcatatggaatgctgaccttgtggggatcgaattgcgcgtagatgacgccgtctgcttcagcaaactgacaagtgtggaggcggtggccaacttttctaagattccagctaccatctccggagtccgattcgatcaaggcaatcatggggaaagccggatttatggatcgcccctcgacatcactcgtgtttcaggcgagttttctgtgagtttcagaggtatgaggctgaaattatccgagataagcgcatcttgtaccggggaaattacaaacgtaagcggatgctactcctgtatgaccggcgcctcagtgagtatcaagctgcacagctctaaaaatactacaggtcaccttaagtgcgattccgacgagacggctttctcagtcatggaaggcacccatacttaccgccctcacatgagttttgataaagccgtgattgacgaggaatgtgttttgaactgcgggggacatagctccaagctcctgctaaagggctctctggtgttcatggacgtcccccggtttgtggatgggtcgtatgttcagacataccacagcaaagtgccagcaggaggcagagtccctaatcccgtagactggctcaacgcgctgttcggtgatgggatcaccaggtggatacttggaatcattggcgtgttgctggcctgtgttatgttatttgtggtcgtggtagctatcacacgacgcctcattaagggcctgactcagcgggccaaagtggcatga

SEQ ID NO: 11070 - RNA, 3231 nt, synthetic construct
  misc_feature 1..3231: note = derived and/or modified CDS sequence (opt3) from HRTV(Patient1)__JX005845.1__GP
  source 1..3231: mol_type = other RNA
atgatcgcccccgtggtcctgttctttaccctctgccctagccagctttccgcttggggctctccaggggacccgattgtttgtggagtgagaacagagactaacaagtcaatacaaatcgaatggaaagagggtaggagtgaaaagctgtgccagattgatcggttgggccacgtaacgagctggttacgcaatcattcctctttccaggggctgatcggacaggtgaaaggccgaccctcggtctcatactttcctgagggtgcaagctatccacgttggagtgggctactctccccctgtgacgccgaatggctgggacttattgcggtgtctaaggctggcgataccgacatgatcgttcctggcccaacatacaaagggaagatattcgtggagagacccacttataacggatacaagggttggggctgcgccgatgggaaaagcctgtcccactcaggaacctattgtgagacagacagtagcgtctcttccggcttgatccaaggtgatagggtgctctgggtaggggaagttgtgtgccagcggggaacccctgtcccagaggacgtgttttcagaactgattagcctgagtcagtctgagttcccggatgtgtgtaaggtcgacggcgttgcactcaatcagtgcgagcaagaatccatcccccagcctttagatgtggcctggattgacgtaggccgcagccataaagtgctgatgagagagcacaagactaaatgggtccaggaatcgtctgctaaggattttgtgtgtttcaaggttgggcagggaccatgctccaaacaagaggaagacgactgtatgtcaaagggtaactgccatggcgatgaggtgttttgcaggatggcagggtgtagtgcccggatgcaggacaatcaggagggatgccgctgtgaacttttgcaaaaacccggcgagatcatagtcaactacggtggggtgagcgtacgacctacatgctatggcttctccagaatgatggctaccctggaagttcacaagccagatagggagctaacgggatgtactggctgccacctcgaatgtattgaagggggagtgaaaatcgtcaccctgacatctgagcttcggagcgccactgtgtgcgcgtcacatttttgtgcaagtgccaagggtggctccaaaaccacagacattctgttccacaccggggctttggtcggacccaagagcatccgtatcacgggccagctcctggatggttctaagttttcattcgacgggcattgcattttcccggatggctgtatggccttagactgcactttttgcaaagagttcctgcgcaatcctcagtgttaccccgtgaagaaatggctctttcttgttgtggtagtcatgtgctgttactgcgcactgatgttgctaacaaacatactgagagctatcggagtgtggggcacctgggttttcgccccaattaagctcgtgctggcgcttgggctgaggttggccaaactcagtaagaagggactggtcgcagtggtaactcggggtcagatgatcgtgaatgatgagttacaccaaatacgagttgaacgcggcgagcagaacgaagggagactgggacacggccctaggggtcccgtccggcattggctatatagcccagctctcattctgatccttacaacctccatctgttctgggtgcgacgagttggtgcacgccgagtcgaaaagcattacgtgtaagtccgcttcaggcaatgaaaaagagtgcagtgtgaccggacgcgccctgctccccgcagtcaaccctggccaggaagcctgtctgcatttttctatgccagggagcccggattccaagtgccttaaaatcaaggttaagtcaattaatctgagatgtaaacaggctagctcttactatgtgcccgaggcgaaggcaaggtgcacatccgtgcgtcggtgccgatgggccggagactgtcaaagtggctgccctacttacttcagctctaactccttttcagacgattgggctaatagaatggacagggccggtttggggatgagtggatgtagcgatggctgcggtggcgcagcctgtgggtgcttcaacgctgccccatcgtgtatattttggcgcaaatgggtagagaacccctccaatcgggtctggaaggtgtctccttgcgcaagctgggttctcgcggctatcattgaactgaccttaccatcaggagaggtgaaaacactggaacccgtcactggccaggccacccagatgttcaagggggtggcaatcacatatctaggaagttccatcgagattgttggcatgaccagactctgtgaaatgaaggagatgggtactgggataatggccctggctccgtgcaacgaccctggacacgccatcatgggcaatgtgggtgagattcagtgttctagcatcgaatccgcaaaacatattaggtcagatggctgcatctggaacgctgaccttgtagggatagagttgcgcgtcgatgacgccgtgtgctttagcaagctgacgagtgtggaagcggtcgccaatttctctaaaatcccagctattatctccggagttcgatttgatcaaggcaaccacggggagagccggatttacggatcgcccctcgacatcacaaaggtgtcaggcgagttctctgtaagtttccgtggtatgagactgaaattatccgaaataagcgcatcttgtaccggggagattactaatgtgagcggatgctattcctgtatgaccggcgcctcagtcagtatcaagctgcacagctctaaaaacacaaccggtcatcttaagtgcgattccgacgaaactgctttttcagtgatggagggcacacacacgtacaggcctcatatgagtttcgataaggccgttgtggacgaagagtgtgtcttgaattgcgggggacacagctccaaactcctgctaaagggctctctggtgtttatggacgttccccgcttcgtggatgggtcgtacgtccagacctatcacagcaaagtaccagcaggaggccgggtgcctaaccccgttgactggctcaatgcgctgtttggtgatgggattactagatggatccttggaataatcggcgtgttgctggcctgtgtcttactcttcgtggtagtggtcgctattacaaggcgactgatcaagggccttacccagcgcgccaaagttgcatga

SEQ ID NO: 11071 - RNA, 3942 nt, synthetic construct
  misc_feature 1..3942: note = derived and/or modified CDS sequence (opt3) from PTV(PAN472868)__NC_027201.1__GP
  source 1..3942: mol_type = other RNA
atgatcttcaccattctgaacgtgctcacaagagccatgcttgtcatgagcatgtactccctgactacgtgggactctacctcaaggaatgatatgtgctttagtaacgacagccccttggagggcttagtttattactgggaaacacactccaagaaacatgattataagaaacaggagtctcaacggtgtcgcgtgggggactcggataagaaaatgataactaatgtaaccatcatttcactgatcagcgaaattcagaagagtatctccgagctatctctcagctgcggaaacgacgataattccacaggtcaggtgctgaccttcaacggccttgaagacactatacagggggattacatcgtcgactgtgtgacaggactgtatcaatcagatattggcgttggtgtggggttgggaaagacccaccatgaccaccagcaggtcaaaaataaggctgtggtaatcgatgagaaagagcgaatgattagttttctcgaaacgcagcaaagcgagaacgacatcaagatgcaggttctgatgtctgaaatagagcagctgaaaaatcagctctccaagaagcgtaacgagagaggccaagaaaagagggacgcagagaaggtgatgtcagatttaatggcccggaatagcgacctgcgcaaacataacgatattcttactgcggaaatcagtcagatggagaataacaataccattcagagaaacaagaacgtcatgtctacaactgtggtgcctgctatcttgtccgtcgccctgctaagctcgtctatcgcaccaattatggccgcttccccggactcacccatgataaatccttggccacacgccaaaaacagggttggcaccgggatgtacaagtatgatgaaaatgacgatagtggatgccggcccatccgctacggtgtgagctgtattggcttcgactttatgctcaaaatggataagtaccctttctttaacgcattcatcgggcacaagacaccactggagtcctttgctgacaaaataattgagaaggaagaggaaacctgcgagatcggaacgaataaagaatttaagtgtttcgaggagcgagcctatatcaaaggcacttgccccacaaacattaatgcggtacattacatcgataacaagggtaaacttagatatgtgaaatgtaaggaaaatctggagatgaccgaagactgcgcattctgtaggaaaattaagaaaaaggccgggcaatctatacaggtccagaagactagcgtgcctttgcaggacgctatctgccaagagaactcagatacatacagtggaccaaaaattccgtttaagggcgtttgcaaaatcggcctcatcaagtataaagaatgtaagttcaagacctccagctacgagacggtgtctttcattaccctgaaagagaaggggaaaatatatatcgaacacttaatgctgaagaatattgaggtcgtgacaaacgtatcatttgtttgctacgaacatgccggacaggacgagcaggaggtggaacaccgggcactcaaacgtgtcagtgtgaatgattgtaagatcgtcgacaacagcaaacagaagatttgcactggtgatcacatcttctgtgagaagtacgactgctccacctcttatcccgatgtgacatgtatacatgctcctggctcggggccactttacatcaatctgatgggaagctggattaaaccccaatgcgttggctatgaacgcgtgttggtagacagagaggtcaagcagcctctactggccccagaacagaactgtgatacttgcgtgtccgagtgtctcgacgagggtgttcacatcaaatcaaccgggtttgaaattacaagtgcggtggcctgctctcatggcagctgcatctccgcacaccaggaggcttcaaccagcgtcatagtgccctacccgggactgcttgcctctgtaggcgggaggattggaatccatctgtcccacacttctgatagcgcttctgtgcacatggttgtcgtgtgtcctccccgggactcctgcgccgcacataactgtttgctctgctatcacggtattctgaattaccaatgtcattcaacgttaagtgccatcctgacgagcttcctactcatactgtttatctataccgtgttctcggtcactaccaacatgctttacgttttgcgactgattccaaagcagctcaaatcccctgtgggctggctgcgcctttttatcaattggctgttgacagctctcagaattaagaccaggaacgtgatggggcggatcaatcagcgcataggatgggtagatcaccacgacgtcgaaagacccaggcatcgtgagccaatgcggcgattcaagactacactgttactgacgctaattatgatgaccggcggtaacgcgtgctctaatactgtggttgcaaacagcaaacagacaagatgtgtgcaagaagggtcaagtaccaagtgctccatcacagccactatcaccctcagggctggcgtcattggagccgagtcttgttttatcattaaaggccccatggagaatcagcagaagacgataagcatcaaaaccatttcctcagaaacagtgtgccgcgaggggagcagtttctggacttctctgtacatcccttcctgtcttagctcgcggagatgccacttggttggagactgcgtgggtaacaagtgtcaatcatggagggatgaccagctgtctcgcgaatttagtggcgtaaaggataatcatattatgaacgagaataaatgcttcgaacagtgtggggcaatcggatgcggctgttttaacataaatccatcctgcctctatgtccacgcctacttaaagagcgctcgaaacgaggccgtgcgggtgttctcttgtagcgactgggtccatcgtgtttccttcgaggtgaaaggtccggatggggaaaccgagctggtaacactgggctcacttggaactaagtttttgaactggggcaccctcagtctgagcctagacgcagaagggatctctggaacaaattccatttcattcctggagagtagcaaaggcggttttgcgctctatgatgaggggtactccgaaatccccagagagggattcctgggcgaaattaggtgcagttcggagagcgctgccatctcagcacacaagtcctgtatacgcgcccctggtcttattaagtataaaccaatgacagaccagatcgaatgcaccgctagtttggtggatccctttgccatcttcctgaagggctctttacctcaaactcggaacgggcagacatttaccagcactaaagacaagaaaaccgtccaggcattcacaaatggagctattaaggccctcctgtccataaaccttgatgaccacgagatcgtgtttattaataaagttagatcatgtgatgcgacgttcctgaacgtgtctggctgctacagctgcgactatggggcccatgtctgtgtgaaggttaagagttccgagagcgctgactttttcgcagaatctgaggataaaaccactgtgttgtcatttccaatccagtccggaacacacgactactgccaagtcctccatttccagaagcccctggtagatgaaaggctaagttacagctgtggctcggagccgaaactgattgtgatcaagggtaccctcgtttatatgggggtgtacgacttccgaaataaaacaggagggtcttccactgtcgtgaaccctagcgaaggtgcctggtcaataagtaattggttttctggcctgcttgattggttgggcggaccaatgaaggctatcctgaagattttaggcttcatcgccattgggatcgtatgctttatactcttcatgattctgatccgcatcgcagtgaactccattaatatcaaaaagaaaaactga

SEQ ID NO: 11072 - RNA, 3942 nt, synthetic construct
  misc_feature 1..3942: note = derived and/or modified CDS sequence (opt3) from PTV(Adames)__KR912209.1__GP
  source 1..3942: mol_type = other RNA
atgatcttcaccattctgaacgtgctcacaagagccatgcttgtcatgagcatgtactccctgactacgtgggactcttcaagtaggaatgatatatgctttagcaacgactcccccttggagggcttagtttattactgggaaacccactctaagaaacatgattataagaaacaggggtcgcaaaagtgtcgggtgggagactcagataaaaagatgatcagcaatgtaacaattatcagtctgatttccgagatccagaagtctataagcgaactatccctctcatgcggtaacaatgacaacagtactggccaggtgctgaccttcaatgggcttgaggatacaatccgcggagactacattgtcgattgtgtgaccggcctgtatcagagcgacatcggtgttggggtgggattgggccgaattaaccacgatcatcaacaggtcaaaaataaggctgtggtaatcgacgaaaaagagaagatgatatctctcctggagactcagcagtccgaaaacgatattaaaacacaagttctgatgtcagagatcgaacagctcaagaatcagttaagcaagcgtagaaacgagaggggccaggagaaacgggacgcagaaaagctgatgagtgaccttatggcccgcaattctgatttgagaaaccacaatgtgattctgaccgacgagatctcccaaatcaaaaacaacattacgatacataggaatcggaacatgatgagcactaccgtcgtgcctgcgatcctatcggtggctctcctgtcttcctcagtcgggccaattacagccgcaccgcccgatagtactatgatcaatccttggccacacgccaagaaccgcgttggaaccggtatgtacaaatatgacgaaaatgatgagagcggctgccgacccataagatacggggtgtcctgtattggatttgacttcatgcttaagatggataaataccctttcttcaacgcttttatcggccacaagacaccactggaatctttcgcagacaagatcattgagaaagaggaagagacctgcgaaatcggtacgaataaggagtttaaatgtttcgaagagagggcctatattaaggggacttgccccacaaacataaatgctgtacattacatcgataacaaaggaaagttgcggtatgtgaagtgtaaagagaatctcgaaatgaccgaggactgcgccttttgtcgtaagattaaaaagaaagcgggccagagcgtccaggtgcaaaagacttcagttcctctgcaggatgcaatctgccaggaaaacagtgacatctactccggcccaaagattccgttcaaaggggtgtgcaagataggattaatcaaatataaggagtgtaaatttaagacaagctcttacgaaaccatttcattcatcacgctgaagggtaaaggcaagatttatatcgagcacctcatgcttaaaaatatagaggtcgtgaccaacgtaagtttcgtttgctacgaacatgccgggcaggacgagcaagaagtggagcaccgcgctctgaagagagtcagcgtgaatgattgtaaaatcgtcgacaactccaagcagaaaatttgcacaggagatcacatcttttgtgagaagtacgactgctctacttcgtatcccgatgtgacctgtattcatacacctggcagcggtccattgtacatcaacctaatggggtcctggataaagccccagtgcgttggctatgaaagggtgctggtagaccgggaggtcaaacagcctctcctggtgccagaacaaaattgtgatacttgcgtttcagagtgtcttgacgaaggagtgcacattaagagtaccggcttcgagatcacatctgccgtcgcatgcagccatgggtcctgcatttcagctcaccaggaggccagcacctctgtgatcataccctacccgggactgttggcgtccgtaggtggccgaatcgggattcatctcagtcacactagcgattctgcctccgtgcacatggttgtcgtgtgtcctccccgcgactcatgcgcagctcataactgtctgttatgctatcacggaatcctgaattaccagtgtcatagtacgctaagcgccattctcacatcgtttctgcttatcttgttcatatataccgctttttccgtgactaccaacgtcctgtacgttctcagactgattccaaaacagcttaagtctcctgtgggctggctgaaattgttcgtgaattggctcctgacagccttaaggatcaagacccggcgcgtaatgggtagaatcaaccaaaggattgggtgggtcgatcaccacgacgtggaacgtccccggcatcgagagccaatgagaaggtttaagactacactgctactcacgctgatcatggttaccggcggaaatgcatgcagcaacactgtggtcgccaattcaaaacagacacgctgtgtgcaggaaggcagtaacaccaagtgctccattacagctactataacccttcgggcgggggttatcggagcagagtcttgtttcattatcaaaggtcccatggaaaatcagcaaaagacgattagcatcaaaaccatatcctcagagacagtgtgcagagagggcagcagtttttggacttctttgtacatcccttcctgtctgagctcgaggcgctgccacctcgtaggggattgcgtcggaaacaagtgtcagtcatggcgagacgaccagctgtctcgggaatttagtggcgtgaaggataatcatattatgaacgagaataaatgctttgaacaatgtggtgccatcgggtgcggctgtttcaacattaacccatcctgcttatatgtgcacgcttacctgaagtctgcccgtaatgaggcagtcagagtgttttcttgtagcgactgggtgcatagggtatccttcgaagtgaaaggaccggatggcgagatggagcttgtcaccttggggtcactcggaacaaagttcctgaactggggcactctaagtctgagcctcgacgccgaaggtatctctgggaccaattccatatcatttctggagagtagcaaaggaggcttcgctctttatgatgaaggttactccgagattccccgcgagggctttttgggggaaatccggtgcagctcggagagcgccgcaatctcagcgcacaagtcctgtattagagctcctggactgataaagtataaaccaatgacggaccagatcgaatgcacagccagtttagtggatcccttcgcaatttttctcaagggctctctgcctcagaccaggaacgggcagactttcacaagcaccaaagacaagaaaactgttcaagcctttaccaatggagctatcaaggcccttctgtccattaacttggatgaccacgagatcatattcatcaataaagtgaagtcatgtgatgcaacatttctcaacgtctctggctgctacagctgcgactatggtgctcatgtgtgtgttaaggtgaaaagttccgaaagcgccgatttctttgcggagtctgaggacaagacgaccgtcctgtcattcccaattcagtccgggactcgagactactgccaggtactacactttcagaaacccctggtggatgaacgcctcagttacagctgtggatcggagccgaagctgatcgttattaaaggcacacttgtgtatatgggtgtctacgacttccgggataagaccggcgggtcttccacagtgatcaatcctagcgaaggaacttggtcaataagtaactggttctctggcttgctggactggttagggggaccaatgaaggccattctcaaaatcctgggctttatcgctattggtatcgtatgcttcatactttttatgattctgatcagaattgcagttaattccatcaacataaagaaaaagaattga

SEQ ID NO: 11073 - RNA, 3942 nt, synthetic construct
  misc_feature 1..3942: note = derived and/or modified CDS sequence (opt3) from PTV(Balliet)__KR912213.1__GP
  source 1..3942: mol_type = other RNA
atgatcttcaccattctgaacgtgctcacaagagccatgcttgtcatgagcatgtactccctgactacgtgggactctacctcaaggaatgatatgtgctttagtaacgacagccccttggagggcttagtttattactgggaaacacactccaagaaacatgattataagaaacaggagtctcaacggtgtcgcgtgggggactcggataagaaaatgataactaatgtaaccatcatttcactgatcagcgaaattcagaagagtatctccgagctatctctcagctgcggaaacgacgataattccacaggtcaggtgctgaccttcaacggccttgaagacactatacgaggggattacatcgtcgactgtgtgacaggactgtatcagtcagatattggcgttggtgtggggttgggacgtacccaccatggccaccaacagatgaagaataaagctgtcgtgatcgacgagaaggagagaatgattagtctcctggaaacgcagcagagcgagaacgatatcaaaatgcaagtactgatgtctgaaatagagcagctcaagaatcagttatccaaaaagaggaacgagcggggccaggaaaagcgcgacgcagagaaagttatgtcagacctgatggccagaaatagcgatcttaggaagcataacgacattttgactgcggaaatcagtcaaatgaaaaataagaacaccattcagcggaataaaaacacagtgtctactaccgtcgtgcctgctatcctgtccgtggccctactcagctcgtctgtcgcaccaatcattgccgctccgcccgattcccctatgataaacccatggccccacgcaaagaatcgcgttgggacaggaatgtacaaatatgacgagaacgatgactcaggttgccgacctatcagatacggcgtgagttgtattgggtttgatttcatgctgaagatggacaagtacccatttttcaatgcctttatcggacacaaaacgccccttgagagcttcgctgataagataattgaaaaagaggaagagacctgcgaaatcggcactaacaaggagtttaaatgtttcgaagagagggcctatatcaagggtacatgccctaccaatattaacgcggtacattacatcgacaataaggggaaactgcggtatgtgaagtgtaaagagaacttggaaatgactgaggattgcgcattttgtcgtaagattaaaaagaaggccggacagtccgtccaagtgcagaaaacatctgttccactccaggacgctatatgccaggaaaatagcgacacctactcaggcccgaagatccccttcaaaggcgtgtgcaagattgggctgatcaaatataaggagtgtaagtttaaaacgagttcctacgaaaccgtcagcttcatcacattaaaggagaaaggaaagatttatatagagcacctgatgctcaaaaacatcgaagtggtaactaatgtttctttcgtgtgctacgagcatgtcggtcaagatgaacaggaggtggagcaccgcgcccttaagagagtctcagtgaacgactgtaaaattgttgataatagtaagcagaagatctgcaccggcgaccacgtgttttgtgaaaaatacgattgcagcacatcctatcctgacgtaacttgtattcatgcaccagggtctggacccctgtacatcaacttgatgggctcgtggataaagcctcagtgcgtcggttatgagagggtgctagttgatcgggaagtgaaacaaccactgctcgctcccgagcagaattgtgatacctgcgtcagcgaatgtctggacgagggggtgcacatcaagtccacaggcttcgagattacctcagccgtagcgtgcagtcatggatcttgcatcagcgcccaccaggaaccgtccacttcagtgattgttccttaccccggccttctggcaagcgtcgggggacgaatcggtatacatttgtctcacacgtccgacagtgctagcgtgcacatggtggtcgtttgtccacctcgcgattcttgcgccgctcataactgtctcctgtgctatcacggcattttaaactaccagtgtcattccacactgtcagccatcctaaccagttttctcctgattcttttcatctatactgtgtttagcgtgaccacaaatatattgtacgtactgagactcatccccaaacaactgaagtcgccagtcgggtggcttaagctgttcattaactggttgctcaccgcactgaggatcaaaactcggaatgtgatgcgcagaattaaccagaggatcggatgggttgaccaccacgatgtggagcgtccccggcatcgagaacctatgagaaggtttaagacaacgttactgctaaccctcataatgatgactggcggtaatgcctgctccaacacagtcgtggctaattctaaacagacccgctgtgttcaggaggggagcaacacaaagtgctcaattactgcgaccatcacgctgcgggcaggcgtgatcggagccgaaagttgtttcattatcaaaggcccaatggagaatcaacagaagaccatttccataaagacaatctctagcgagactgtatgcagagaagggtcctcattttggaccagcctttacattccgagttgtttgtcttccaggcgctgccacctggtcggagactgcgtgggtaacaaatgtcagagctggcgagacgatcaactctcgcgggagttctcaggcgtgaaggacaatcatatcatgaacgaaaataaatgctttgagcagtgtggggctattggatgcggctgtttcaacatcaatccctcttgcctgtatgtccacgcctacttaaagagtgcacgtaacgaagccgttagagtgttttcctgtagcgattgggtacatagggtgtctttcgaggtcaaaggtcctgacggggagacagaactggtgactcttggcagcttgggaaccaagttcctcaactggggcacgctgtccctatcactggatgctgaggggataagtggaacaaatagcatctcttttctcgaatcctcaaagggcggtttcgccctgtatgacgaggggtacaacgagattccacgcgaaggatttcttggcgagatccggtgcagtagcgaatccgcagcgatttctgctcacaaatcgtgtatcagagcccccggtttgataaagtataaacctatgaccgatcagattgagtgcactgcaagcctggttgacccattcgccatctttttaaagggctcactcccccagacaaggaatgggcaaaccttcacttccaccaaagataagaaaacagtgcaggcttttacgaacggagccatcaaggcactgcttagtattaatctggacgatcacgaaatagtcttcatcaacaaggtgaaaaattgtgacgctacctttttgaacgtttctggctgctacagctgcgattatggggcccatgtgtgtgtcaaggtaaaatcctcagagtctgcggacttctttgccgagagcgaagacaagactacagtgctcagtttcccgattcagtccggaacccacgattactgccaggttctgcattttcaaaaacctctagtggacgagcgactgagctactcttgtggctcagaaccaaagctcatcgtcattaagggtacactggtgtatatgggggtatacgatttccgcaataaaactggaggctccagtaccgtggtcaaccccagcgagggtgcttggtcgatctctaattggttctccggccttttggactggttagggggacctatgaaggcaatactgaaaatcctcggctttattgccatcgggattgtttgcttcgtgctgtttatgatccttatacggattgctgtgaacagcatcaatatcaagaaaaagaactga

SEQ ID NO: 11074 - RNA, 3942 nt, synthetic construct
  misc_feature 1..3942: note = derived and/or modified CDS sequence (opt3) from PTV(PaAR2381)__KP272005.1__GP
  source 1..3942: mol_type = other RNA
atgatcttcaccattctgaacatactcacaagagccatgcttgtgatgagcatgtactccctgactacgtgggactctacctcaaggaatgatatgtgctttagtaacgacagccccttggagggcttagtctattactgggaaacacactccaagaaacatgattataagaaacaggagtctcaaaagtgtcgggttggggactcggataaaaagatgatctcaaatgtgactattatcagcctgattagtgaaatccagaagtccatatctgagctaagcctctcctgcggaaacgacgataattcaaccggtcaggtactgacattcaacggccttgaagacaccatccgcggggattacattgtggactgtgtcactggactgtatcagagtgatatcggcgtgggtgttgggttgggacgaacacaccatgaccaccatcaagtgaaaaataaggctgtcgtgattgatgagaaagagcgtatgatcagcctcctggaaacccagcagtctgagaacgacataaagatgcaggtactgatgtccgaaattgagcaactcaaaaatcagttatcaagaaagaggaacgagcggggccaggaaaagcgcgacgcagagaaagttatgagcgatctgatggccagaaatagtgaccttaggaagcacaacgatatcttgacggcggaaatttctcagatgaaatacaataacactatccaacggtccaagaatgtgatgagcaccacagtcgtgcctgctatcctgtcggtggccctactctcttcctcagtcgcaccaattatggccgctccgcccgacagtcctatgataaacccatggccccacgcgaaaaaccgcgttggcactgggatgtataagtacgatgacaatgatgacagcggatgccgacctatcagatacggtgtgtcctgtattggctttgatttcatgctgaaaatggacaagtatccatttttcaacgcctttatcgggcataagacaccccttgagtctttcgctgataaaataattgaaaaggaggaggaaacctgcgagatcggaaccaataaagaatttaagtgtttcgaggaaagggcctacatcaaaggcacgtgccctactaacattaatgcggtacactatatcgacaacaagggtaagctgcggtacgtgaaatgtaaggagaatttggagatgacagaagactgcgcattttgtcgtaaaattaagaaaaaggccgggcagagcgtccaggtgcaaaagacctcagttccactccaggatgctatatgccaggagaacagtgacaattattccggaccgaaaatccccttcaagggcgtgtgccgcattggcctgatcaaatacaaggaatgtaaatttaagactagctcttatgagacagtctcattcatcaccttaaaggaaaaagggaagatttacatagagcatctgatgctcaaaaacatcgaggtggtaacgaatgttagtttcgtgtgctacgaacacgccggacaggatgagcaagaagtcgagcacagagcacttaagagggtgagcgtcaacgactgtaaaattgtggataattccaagcagaaaatctgcaccggtgaccatgtgttttgtgagaagtatgattgctctacatcgtaccctgacgttacttgtattcacgctccaggcagcgggcccctgtatatcaacttgatgggatcctggataaagcctcagtgcgtaggctacgaacgggtcctagtggatcgagaggttaaacagccactgctcgcccccgaacaaaattgtgatacctgcgtgtcagagtgtctggacgaaggtgtccatatcaagagtacagggttcgagattacttctgcggtggcctgcagccacggctcctgcatctcagcacatcaggaggctagcacctctgtaattgtgccgtatcctggacttctggcctccgttggcgggcgcatcggaatacacttgagtcacacaagcgactctgcttccgtccatatggtggtggtctgtcccccaagagattcatgcgaagcccacaactgtctcctgtgctaccatggtattttaaactatcagtgtcacagtaccctgagcgcaatcctaacttcgtttctcctgattcttttcatctacacggtgttttccgttacaaccaatatgttgtacgtgctgaggctcatacctaaacagctgaagtctcccgtaggctggcttaaactgttcatcaactggttgctcactgccctgcggattaagacccgcaatgtcatggggagaatcaaccaaaggattggatgggtggaccaccatgacgttgagcgtccacggcaccgagaacccatgagaaggtttaagacaaccttactgctaactctcatcatgatgacaggcggtaatgcttgcagcaacacggtggtcgcaaattcaaaacagacccgctgtgtgcaggaggggagtaacactaagtgctccataacagcaaccattacactgcgggccggcgttatcggagctgaatcttgtttcatcattaaaggccctatggagaatcagcaaaagactatcagcattaaaaccatatcctcagagacggtgtgcagagaagggagcagtttttggacctctctttatatcccatcctgtttgagctcgaggcgctgccatctggtaggagattgcgtcggtaacaagtgtcagtcatggcgagacgatcagctctctcgggagttcagtggcgtgaaggacaatcacattatgaacgaaaataaatgctttgagcaatgtggggccatcggatgcggctgtttcaacattaatccgtcctgcctgtacgtgcatgcatatttaaagagcgcccgtaacgaagctgtcagagtgttttcttgtagcgattgggttcacagggtatccttcgaggtgaaaggtcccgacggggagacagaactggtcactcttggctcattgggaaccaagttcctcaactggggcacactgagtctaagcctggatgccgaggggatctctggaactaattccatatcatttctcgaaagtagcaaaggcggtttcgcactgtacgacgaggggtattccgagatccctcgcgaaggatttcttggcgagattcggtgttcttcggaaagcgcggctatctcagcccacaagtcctgcattagagcaccaggtttgatcaagtacaaacccatgaccgatcagatagagtgcacggccagtctggtggaccctttcgctatctttttaaagggctctctcccacagacaaggaacgggcagaccttcactagcacaaaagataagaaaaccgttcaagcctttactaatggagcaattaaggctctgctttccatcaacctggacgatcatgaaattgtgttcataaataaagtcaagtcatgtgacgccacctttttgaacgtgtctggctgctatagctgcgactacggggcgcacgtttgtgtgaaggtcaaaagttccgagagcgccgatttctttgctgagtctgaagacaagacaacggtactctcattccccatccagtccggaacccatgattactgccaggtgctgcactttcagaaaccgctagttgacgagcgactgagttatagctgtggctcggaacctaagctcattgtgatcaaaggtactctggtctacatgggggtgtatgatttccgcaataagacaggagggtcttccaccgtagtgaacccaagcgagggtgcatggtcaattagtaattggttctctggccttttggactggctgggcggacccatgaaggccatcttaaaaatactcggctttatcgctattgggatcgtctgcttcattctgtttatgatcatgatacggattgccgttaactccatcaatatcaagaaaaagaactga

SEQ ID NO: 11075 - RNA, 3942 nt, synthetic construct
  misc_feature 1..3942: note = derived and/or modified CDS sequence (opt3) from PTV(PAN483391)__KP272008.1__GP
  source 1..3942: mol_type = other RNA
atgatcttcaccattctgaacatactcacaagagccatgcttgtgatgagcatgtactccctgactacgtgggactctacctcaaggaatgatatgtgctttagtaacgacagccccttggagggcttagtctattactgggaaacacactccaagaaacatgattataagaaacaggagtctcaacggtgtcgcgttggggactcggataagaaaatgatcactaatgtgaccattatctcactgattagcgaaatccagaagagtatatccgagctatctctcagctgcggaaacgacgataattccacaggtcaggtactgaccttcaacggccttgaagacactatccgaggggattacattgtggactgtgtcacaggactgtatcagtcagatatcggcgtgggtgttgggttgggacgtacccaccatgaccaccaacaggtgaagaataaagctgtcgtgattgatgagaaggagagaatgatcagtctcctggaaacgcagcagagcgagaacgacataaaaatgcaagtactgatgtctgaaattgagcagctcaagaatcagttatccaaaaagaggaacgagcggggccaggaaaagcgcgacgcagagaaagttatgtcagatctgatggccagaaatagcgaccttaggaagcataacgatatcttgactgcggaaattagtcaaatgaaatacgacaataccatccagcggaacaagaatgtgatgtctacaactgtcgtgcctgctatcctgtccgtggccctactcagctcgtctattgcaccaataatggccgcttccccggattcacccatgatcaacccttggccacacgctaaaaaccgcgtcggcaccgggatgtataagtacgacgagaatgatgacagtggatgccgacccattagatacggtgttagctgtatcggctttgatttcatgctgaaaatggacaagtatccatttttcaacgcctttatagggcacaagacacctcttgaatccttcgctgataaaattatcgagaaggaggaagagacctgcgaaatcggaacgaataaagagtttaagtgtttcgaagagagggcctacattaaaggcacttgccccacaaacatcaatgcggtgcattatattgacaacaagggtaagctgcggtacgtaaaatgtaaggagaatttggaaatgaccgaggactgcgcattttgtcgtaaaataaagaaaaaggccgggcagtctgtgcaagtccagaagactagcgtgcctctccaggatgctatctgccaggaaaactcagacacatatagtggaccaaaaattccgttcaagggcgtttgcaaaatcggcctgatcaagtacaaagagtgtaagtttaagacctccagctatgaaacggtgtctttcattaccttaaaagagaaggggaaaatatacatcgagcacctgatgctcaagaatattgaagtcgtgacaaacgtatcattcgtttgctacgagcatgccggacaagatgaacaggaggtggagcaccgcgcacttaaaagagtcagtgtgaatgactgtaagatcgtcgataacagcaaacagaagatttgcactggtgaccacgtgttttgtgaaaagtatgattgctccacctcttaccccgacgttacatgtatccatgctcctggctcggggccactgtatataaatttgatgggaagctggatcaaaccccagtgcgtgggctacgagaaggtactggtcgatagggaagtgaaacaacctctgctcgccccagagcagaactgtgacacttgcgtttccgaatgtctggatgagggtgtgcacattaagtcaaccgggttcgagatcacaagtgcggtcgcctgctctcatggcagctgcatttccgcacaccaggaagcatcaaccagcgtgatcgtaccctatccgggacttctggcctctgtgggcgggaaaataggtattcatttgtcccacacttcagacagcgcttctgttcacatggtcgtggtgtgtcctccccgggattcctgcgccgcacataattgtctcctgtgctaccacggaatcttaaactatcagtgtcattcaacgctgagtgccattctaactagctttctcctgatccttttcatatacaccgtcttttcggttactaccaacatgttgtacgtgctgcgactcatcccaaagcaactgaagtcccctgtgggctggcttcgcctgttcattaattggttgctcacagctctgagaatcaaaaccaggaacgtaatggggcggattaatcagcgcatcggatgggtcgaccaccacgacgtggagagacccaggcatcgtgaaccaatgcggcgatttaagactacattactgctaacgctcataatgatgaccggcggtaacgcgtgctctaatactgttgtggcaaacagcaaacagacaagatgtgtccaggaggggtcaaataccaagtgcagtattacagccactatcaccctgaaagctggcgtgatcggagccgaatcctgtttcattatcaagggccccatggagaaccaacagaagacgatttctataaaaaccatcagctccgagacagtttgcagggaagggagtagcttttggacaagtctttatattccttcttgtttgtccagccgccggtgccacctggtgggagattgcgtaggtaataagtgtcagtcgtggagagacgatcaactctcaagggagttctctggcgtcaaagacaaccatatcatgaatgaaaacaagtgctttgagcagtgtggggcaattggatgcggctgtttcaatatcaacccaagttgcctgtacgtgcacgcctatttaaaatccgctcgcaatgaagccgtgcgagtctttagctgttctgattgggttcatcgggtgagcttcgaggtaaagggtccggacggggagaccgaactggtgacacttggctccttgggaactaagttcctcaactggggcaccctgtcactaagtctggatgcagaggggataagcggaacgaactctatctcctttctcgaatcaagtaaaggcggtttcgcgctgtacgacgaggggtatagcgagattccccgtgaaggatttcttggcgagatcagatgctcctctgaatcggctgccattagcgcacacaagtcatgtatcagggcccctggtttgataaaatacaagccaatgacagatcagattgagtgcaccgcttccctggtcgaccccttcgccatctttttaaaaggcagtctccctcagactcgcaatgggcaaacattcacctctactaaggataaaaagaccgtgcaggcatttacaaacggagctatcaaggccctgcttagcattaatctggacgatcacgaaatagttttcatcaacaaagtgcggtcctgtgacgcgacgtttttgaatgtctcaggctgctattcttgcgactacggggcccatgtgtgtgttaaggtgaaaagcagtgagtccgctgatttctttgcagagagcgaagacaagaccactgtcctctctttcccaattcagtcaggaacacacgattactgccaggtactgcattttcaaaaacccctagtggacgagagactgtcctatagttgtggcagcgaaccgaagctcatcgttattaagggtaccctggtgtacatgggggtctatgatttcaggaacaaaacaggaggctcgtctactgtggtaaatccttccgagggtgcctggagcatctcaaactggttcagtggccttttggactggctagggggaccaatgaaggctatattaaaaatcctcggctttattgccatcgggattgtgtgcttcatcctgtttatgatacttattcgaatcgcagtcaattctatcaacattaagaaaaagaattga

SEQ ID NO: 11076 - RNA, 3942 nt, synthetic construct
  misc_feature 1..3942: note = derived and/or modified CDS sequence (opt3) from PTV(GML902876)__KP272011.1__GP
  source 1..3942: mol_type = other RNA
atgatcttcaccattctgaacgtgctcacaagagccatgcttgtcatgagcatgtactccctgactacgtgggactctacctcaaggaatgatatgtgctttagtaacgacagccccttggagggcttagtttattactgggaaacacactccaagaaacatgattataagaaacaggagtctcaaaagtgtcgggtgggggactcggataaaaagatgatatcaaatgtaactatcattagcctgatcagtgaaattcagaagtccatctctgagctaagcctctcctgcggaaacgacgataattcaaccggtcaggtgctgacattcaacggccttgaagacaccatacgcggggattacatcgtcgactgtgtgactggactgtatcagagtgatattggcgttggtgtggggttgggacgaacacaccatgaccaccatcaagtcaaaaataaggctgtggtaatcgatgagaaagagcgtatgattagcctcctggaaacccagcagtctgagaacgacatcaagatgcaggttctgatgtccgaaatagagcaactcaaaaatcagttatcaagaaagaggaacgagcggggccaggaaaagcgcgacgcagagaaagtgatgagcgatctgatggccagaaatagtgaccttaggaagcacaacgatattttgacggcggaaatctctcagatggagaataacaatactattcaacggaacaaaaacgtcatgtccaccacagtggtgcctgctatcctgagcgtcgccctactctcgtcttccatcgcaccaattatggccgcttcaccggacagtcccatgataaatccttggccacacgcaaagaaccgcgttggcactgggatgtacaaatatgatgaaaatgacgatagcggatgccgacccatcagatacggtgtgtcctgtattggctttgacttcatgctgaagatggataaataccctttcttcaacgcctttatcgggcataagaccccacttgagtctttcgctgacaagataattgagaaagaagaggaaacatgcgagatcggaaccaataaggaatttaaatgtttcgaggagagggcctatatcaagggcacgtgccccactaacattaatgcggtacactacatcgataacaaaggtaagctgcggtatgtgaagtgtaaagaaaatttggagatgacagaagactgcgcattttgtcgtaagattaaaaagaaagccgggcagagcatacaggtccaaaagacctcagtgcctctccaggacgctatctgccaggagaacagtgatacttactccggaccaaagattccgttcaaaggcgtttgcaagatcggcctgatcaaatataaggaatgtaaatttaagacaagctcttacgagaccgtgtcattcattacgttaaaggagaaagggaagatatatatcgaacatctgatgctcaaaaatattgaggtcgtgaccaacgtaagtttcgtttgctacgaacacgccggacaggacgagcaagaggtggaacaccgcgcacttaagagagtcagcgtgaatgattgtaaaatcgtcgacaactccaagcagaaaatttgcacaggtgatcatatcttttgtgagaagtacgactgctctacttcgtatcccgatgtgacctgtatacacgctcctggcagcgggccactgtacatcaatttgatgggatcctggattaagccccagtgcgttggctatgaaagggtgctagtagaccgggaggtcaaacagcctctgctcgccccagaacaaaactgtgatacatgcgtgtcagagtgtctggacgagggtgttcatatcaagagtactgggttcgaaattacctctgcggtggcctgcagccacggctcctgcatctcagcacatcaggaggctagcacatctgtcatagtgccctacccgggacttctggcctccgtaggcgggcgaattggaatccacttgagtcacaccagcgattctgcttccgtgcatatggttgtcgtgtgtcctccccgcgactcatgcgccgcacacaactgtctcctgtgctatcatggtattttaaattaccagtgtcacagtactctgagcgccatcctaacgtcgtttctcctgatacttttcatctatacagtgttttccgtcaccactaacatgttgtacgttctgagactcattccaaaacagctgaagtctcctgtgggctggcttaggctgttcatcaattggttgctcaccgctctgcggattaaaacacgcaacgtgatggggagaatcaatcaaaggataggatgggtagatcaccatgacgtcgaacgtccccggcaccgagagccaatgagaaggtttaagaccactttactgctaacactcattatgatgacgggcggtaacgcgtgcagcaataccgtggttgcaaactcaaagcagactcgctgtgtgcaggaagggagttccacaaaatgctctatcaccgccacaatcactctgcgggctggcgtcattggagccgagagctgtttcatcattaagggccccatggagaatcagcagaaaaccatatccatcaagacgatttcaagcgaaaccgtgtgcagagaggggagttctttttggacatccctttacatccctagctgtttgtcgtcaaggcgctgccatctggttggagactgcgtgggtaacaaatgtcaatcttggcgagatgaccagctcagtcgggaattttccggcgtaaaggataatcacattatgaacgagaataagtgctttgaacaatgtggggcaatcggatgcggctgtttcaacataaatccaagctgcctgtatgtccatgcctacttaaaatctgctcgtaacgaggccgtgagagtgtttagctgttccgactgggtccacagggtttcattcgaggtgaagggtccggatggggaaactgagctggtagcacttggcagtttgggaaccaaattcctcaactggggcacactgagcctatctctggacgcggaagggatctccggaactaattcaattagttttctcgagagctccaagggcggtttcgctctgtatgatgaggggtactctgaaatcccccgcgagggatttcttggcgaaattcggtgctcgagcgagtcagccgcaatctccgcccacaaaagttgtataagagctcctggtttgattaagtataagccaatgaccgaccagatcgaatgcacggcctctctggtggatcccttcgcaatctttttaaaaggcagcctccctcagacaaggaacgggcagaccttcacttccacaaaggacaaaaagaccgtccaggcttttactaatggagccattaaagcgctgctttcaataaacctggatgaccatgagatcgtgttcattaataaggttaaatcttgtgatgccacctttttgaacgtgagcggctgctacagttgcgactatggggctcacgtctgtgtgaaggttaagtccagcgagtctgcagacttctttgccgaatcagaggataaaacaacggtgctctccttcccaatccaaagtggaacccatgactactgccaggtcctgcactttcagaagcccctagtagatgaacgactgagctactcgtgtggctctgagccgaaactcattgtgatcaagggtactctggtttatatgggggtgtacgacttccgcaataaaacaggaggctccagcaccgtcgtgaacccttcagaaggtgcttggagtatatctaattggttctccggccttttggattggttagggggaccaatgaaggccatcctgaagattctcggctttatcgcaattgggatcgtatgcttcatactgtttatgattatgatccggatcgcggtgaacagcattaatatcaaaaagaaaaactga

SEQ ID NO: 11077 - RNA, 3942 nt, synthetic construct
  misc_feature 1..3942: note = derived and/or modified CDS sequence (opt3) from PTV(PAN479603)__KP272014.1__GP
  source 1..3942: mol_type = other RNA
atgatcttcaccattctgaacatactcacaagagccatgcttgtgatgagcatgtactccctgactacgtgggactctacctcaaggaatgatatgtgctttagtaacgacagccccttggagggcttagtctattactgggaaacacactccaagcggcatgattataaaaagcaggagtctcaaaaatgtcgcgttggggactcggataagaaaatgatctcaaatgtgactattatcagcctgattagtgaaatccagaagtccatatctgagctaagcctctcctgcggaaacgacgataattcaaccggtcaggtactgacattcaacggccttgaagacaccatccgaggggattacattgtggactgtgtcactggactgtatcagagtgatatcggcgtgggtgttgggttgggacgtacacaccatgaccaccatcaagtgaagaataaagctgtcgtgattgatgagaaggagagaatgatcagcctcctggaaacccagcagtctgagaacgacataaaaatgcaggtactgatgtccgaaattgagcaactcaagaatcagttatcaaggaaacggaacgagcgcggccaggaaaagagagacgcagagaaggttatgagcgatctgatggccaggaatagtgaccttcggaaacacaacgatatcttgacggcggaaatttctcagatgaagtacgacaatactatccaacgcaacaaaaatgtgatgtccaccacagtcgtgcctgctatcctgagcgtggccctactctcgtcttccgtcgcaccaattatagccgctccgcccgattcacctatgatcaacccatggccccacgcaaagaaccgagttggcactgggatgtataaatacgacgataatgacgatagtggatgcagacctattaggtacggtgtgagctgtatcggctttgacttcatgctgaagatggataaatatccatttttcaacgcctttatagggcataagactccccttgagtccttcgctgacaagattatcgaaaaagaggaggaaacatgcgagatcggaaccaataaggaatttaaatgtttcgaggaacgggcctacattaagggcacgtgccctactaacatcaatgcggtacactatattgacaacaaaggtaagctgcgttacgtgaagtgtaaagagaatttggagatgacagaagattgcgcattttgtcgcaagatcaaaaagaaagccgggcagtctgtccaggtgcaaaagaccagcgttccactccaggacgctatatgccaggagaactcagatacttatagtggaccgaagattcccttcaaaggcgtgtgcaagatcggcctgatcaaatacaaggaatgtaaatttaagacatccagctatgagaccgtctctttcattacgttaaaggaaaaagggaagatatacatcgagcatctgatgctcaaaaatattgaggtggtaaccaacgtttcattcgtgtgctacgaacacgccggacaggacgagcaagaagtcgagcacagagcacttaagagggtgagtgtcaatgattgtaaaatcgtggacaacagcaagcagaaaatttgcacaggtgatcatgtattttgtgagaagtatgactgctccacttcttaccctgatgtgacctgtatccacgctccaggctcggggcccctgtatataaatttgatgggaagctggatcaagcctcagtgcgtaggctacgaacgggtcctagtggaccgagaggttaaacagccactgctcgcccccgaacaaaactgtgatacatgcgtgtccgagtgtctggacgaaggtgtccatattaagtcaactgggttcgagatcaccagtgcggtggcctgctctcacggcagctgcatttccgcacatcaggaggcttcaacaagcgtaatcgtgccgtatcctggacttctggcctctgttggcgggcgcatagggattcacttgtcccacaccagtgatagcgcttctgtccatatggtggtggtctgtcccccaagagactcctgcgccgcacacaattgtctcctgtgctaccatggtatcttaaactatcagtgtcactcaactctgagtgccattctaacgagctttctcctgatccttttcatatacacagtttttagcgtgaccactaacatgttgtacgtgctgaggctcatccctaaacagctgaagtcccccgtaggctggcttaaactgttcattaattggttgctcaccacactgcggatcaagacccgcaacgtcatggggagaattaatcaaaggatcggatgggtggaccactttgatgttgaacgtccacggcatcgagagcccatgagaaggttcaagactacattactgctaacgctcataatgatgaccggcggtaacgcttgctctaatactgtggtcgcgaacagcaaacagacacgctgtgtgcaggaagggtcaaataccaagtgcagtattacagcaactatcaccctgcgggccggcgttatcggagctgagtcctgttttattatcaaaggccctatggaaaaccagcaaaagacgatttctataaaaaccatcagctccgagacagtgtgcagagaggggtcatcgttctggaccagtctttatattccatcttgtttgtccagcaggcgctgccacctggtaggagactgcgtcggtaataagtgtcagtcgtggcgagatgaccagctctcacgggaattttctggcgtgaaggataaccatatcatgaatgagaacaaatgcttcgaacaatgtggggccattggatgcggctgttttaatatcaacccgagttgcctgtacgtgcacgcatatttaaagtccgcccgtaatgaggctgtcagagttttcagctgttctgactgggtgcatagggttagcttcgaagtgaaaggtcccgatggggagaccgagctggtcacacttggctccttgggaactaagtttctcaactggggcaccctgtcactaagtctggacgccgaagggataagcggaacgaactctatctccttcctcgagtcaagtaaaggcggttttgcactgtacgatgaagggtatagcgagattcctcgcgagggattccttggcgaaatccggtgctcctctgagtcggcggctattagcgcccacaagtcatgtatcagagcaccaggtttgataaagtacaaacccatgacagaccagattgaatgcaccgcctccctggtggatccttttgctatcttcttaaagggcagtctcccacagactaggaatgggcagacatttacctctactaaagacaagaaaaccgttcaagccttcacaaacggagcaatcaaggctctgcttagcattaatctggatgaccacgagatagtgtttatcaaccgagtcaaatcctgtgacgccacgttcttgaatgtgtcaggctgctattcttgcgattacggggcgcatgtttgtgtgaaggtcaagagcagtgaatccgccgactttttcgctgagagcgaggataaaaccactgtactctcttttcccattcagtcaggaacacacgactactgccaggtgctgcatttccagaagccgctagttgatgaacgcctgtcctatagttgtggcagcgagcctaaactcatcgtgattaagggtaccctggtctacatgggggtgtatgacttccggaacaaaacaggaggctcgtctactgtagtgaatccatccgaaggtgcatggagcatctcaaactggtttagtggccttttggattggctgggaggacccatgaaggccatattaaagatcctcggcttcattgctatcgggattgtctgctttatcctgttcatgatacttattagaatcgccgttaattctatcaacattaaaaagaaaaattga

SEQ ID NO: 11078 - RNA, 3942 nt, synthetic construct
  misc_feature 1..3942: note = derived and/or modified CDS sequence (opt3) from PTV(PAN478718)__KP272017.1__GP
  source 1..3942: mol_type = other RNA
atgatcttcaccattctgaacgtgctcacaagagccatgcttgtcatgagcatgtactccctgactacgtgggactcttcaagtaggaatgatatgtgctttagcaacgactcccccttggagggcttagtttattactgggaaacccactctaagaaacatgattataagaaacaggagtcgcaacggtgtcgcgtgggggactcagataagaaaatgataacaaatgtaactatcattagcctgatcagtgaaattcagaagtccatctctgagctaagcctctcctgcggaaacgacgataattcaaccggtcaggtgctgacattcaacggccttgaagacaccatacgaggggattacatcgtcgactgtgtgactggactgtatcagagtgatattggcgttggtgtggggttgggacgtacacaccatgaccaccaacaggtcaagaataaagctgtggtaatcgatgagaaggagagaatgattagcctcctggaaacccagcagtctgagaacgacatcaaaatgcaagttctgatgtccgaaatagagcagctcaagaatcagttaagcaaaaagaggaacgagcggggccaggaaaagcgcgacgcagagaaagtgatgtcagatctgatggccagaaatagtgaccttaggaagcataacgatattttgacggcggaaatctctcaaatgaaatacaataacactattcagcggaataagaacatcatgtccaccacagtcgtgcctgctatcctgagcgtggccctactctcgtcttccgtcgcaccaattatggccgctccgcccgactcacctatgataaacccatggccccacgccaaaaatcgcgttggcactgggatgtataagtacgatgacaacgatgacagtggatgccgacctatcagatacggtgtgagctgtattggctttgatttcatgctgaaaatggacaagtatccatttttcaatgcatttatcgggcacaagacaccccttgagtccttcgctgataaaataattgaaaaggaggaggaaacctgcgagatcggaaccaacaaagaatttaagtgtttcgaggaaagggcctacatcaaaggcacgtgccctactaatattaacgcggtacattatatcgacaataagggtaagctgcggtacgtgaaatgtaaggagaacttggagatgacagaagactgcgcattttgtcgtaaaattaagaaaaaggccgggcagtctgtccaagtgcagaagaccagcgttccactccaggatgctatatgccaggaaaattcagacacttatagtggaccgaaaatccccttcaagggcgtgtgcaaaattggcctgatcaagtacaaagaatgtaagtttaagacatccagctatgagaccgtctctttcatcacgttaaaagaaaaggggaaaatttacatagagcacctgatgctcaagaacatcgaggtggtaaccaatgtttcattcgtgtgctacgaacatgccggacaagatgagcaggaagtcgagcaccgcgcacttaaaagagtgagtgtcaacgactgtaagattgtggatagctccaaacagaagatctgcacaggtgaccacgtgttttgtgagaagtatgattgctctacttcgtaccctgacgtgacctgtattcatgctccaggcagcgggcccctgtatatcaatttgatgggatcctggataaaacctcagtgcgtaggctacgaaagggtcctagtggatcgggaggttaagcaaccactgctcgcccccgaacagaactgtgacacatgcgtgtcagagtgtctggatgaaggtgtccacatcaaaagtactgggttcgagattacctctgcggtggcctgcagccatggctcctgcatctcagcacaccaggaggctagcacatctgtaattgtgccgtatcctggacttctggcctccgttggcgggcgaatcggaatacatttgagtcacaccagcgactctgcttccgtccacatggtggtggtctgtcccccacgcgattcatgcgccgcacataattgtctcctgtgctaccacggtattttaaactatcagtgtcatagtactctgagcgccatcctaacgtcgtttctcctgattcttttcatctacacagtgttttccgttaccactaacatgttgtacgtgctgagactcatacctaagcaactgaaatctcccgtaggctggcttaagctgttcatcaattggttgctcaccgctctgaggattaagacacggaacgtcatggggcgcatcaatcagagaattggatgggtggaccaccacgacgttgaaaggccacgtcatcgggagcccatgcgaagatttaaaaccactttactgctaacactcatcatgatgacgggcggtaacgcgtgcagcaataccgtggtcgcaaactcaaagcagactaggtgtgtgcaggaagggagtaatacaaaatgctccataaccgccacaattactctgcgcgctggcgttatcggagccgagtcttgtttcatcgtgaagggccctatggaaaaccaacagaaaaccattagcatcaagacgatttcctcagagaccgtatgccgggaggggagcagtttttggacatctctttatataccatcctgtttgagctcgagaaggtgccacctggtcggagattgcgtgggtaataagtgtcagtcatggcgcgacgatcaactctctcgagagttcagtggcgtgaaagacaaccatatcatgaatgagaacaagtgctttgaacagtgtggggcaattggatgcggctgtttcaatatcaacccgtcctgcctgtacgtccacgcctatttaaaaagcgctcggaatgaggccgttcgtgtgttttcttgtagcgattgggtacatagagtgtccttcgaagtcaagggtcccgacggggagactgagctggtgacccttggctcattgggaacaaaattcctcaactggggcactctgagtctaagcctggatgcagaagggatttctggaaccaactccatctcatttctcgagagtagcaagggcggtttcgcgctgtacgacgaagggtattccgagatacctagggagggatttcttggcgaaatccgctgttcttcggagagcgctgccatttcagcacacaagtcctgcatccgggccccaggtttgattaaatacaagcccatgacggatcagatcgaatgcacagctagtctggttgaccctttcgccatatttttaaaaggctctctcccacagaccagaaatgggcaaactttcacaagcaccaaggataaaaagactgtgcaggcatttaccaacggagctattaaagccctgctttccatcaatctggacgatcacgagatcgtcttcattaacaaggtgatatcatgtgacgcgacatttttgaatgtttctggctgctatagctgcgactacggggcccatgtgtgtgtcaaggtaaaaagttccgaaagcgctgatttctttgcagagtctgaggacaagacgaccgtgctctcattccccatccagtccggaactcacgattactgccaggttctgcattttcaaaaaccgctagtggacgaaaggctgagttatagctgtggctcggagcctaagctcattgtcatcaaaggtacactggtgtacatgggggtatatgatttccgaaacaagaccggagggtcttccacagtggtcaatccaagcgaaggtgcctggtcaattagtaactggttctctggccttttggactggctgggcggacccatgaaggctatcttaaaaatactcggctttatcgccattgggatcgtttgcttcattctgtttatgatccttatacgcattgcagttaattccatcaacatcaagaaaaagaattga

SEQ ID NO: 11079 - RNA, 3942 nt, synthetic construct
  misc_feature 1..3942: note = derived and/or modified CDS sequence (opt3) from PTV(Balliet)__KP272023.1__GP
  source 1..3942: mol_type = other RNA
atgatcttcaccattctgaacgtgctcacaagagccatgcttgtcatgagcatgtactccctgactacgtgggactctacctcaaggaatgatatgtgctttagtaacgacagccccttggagggcttagtttattactgggaaacacactccaagaaacatgattataagaaacagaagtctcaacggtgtcgcgtgggggactcggataaaaagatgataactaatgtaaccatcatttcactgatcagcgagattcagaagagtatctccgaactatctctcagctgcggaaacgacgataattccacaggtcaggtgctgaccttcaacggccttgaggacactatacgaggggattacatcgtcgactgtgtgacaggactgtatcagtcagatattggcgttggtgtggggttgggacgtacccaccatggccaccaacagatgaaaaataaggctgtcgtgatcgacgaaaaagagagaatgattctcctgctggagacgcagcagagtgaaaacgatatcaagatgcaagtactcatgagcgagatagaacagctgaaaaatcagctgtctaagaagaggaacgagcggggccaggagaaacgcgacgcagaaaaggttatgtccgaccttatggccagaaattcagatttgaggaaacataacgacattctgactgcggagatcagccaaatgaagaataaaaacaccattcagcggaataagaacacagtgagtactaccgtcgtgcctgctatcctatctgtggccctcctgtccagctcggtcgcaccaatcattgccgctccgcccgattctcctatgataaacccatggccccacgcgaaaaatcgcgttgggacaggaatgtacaagtatgacgaaaacgatgactccggttgccgacctatcagatacggcgtgtcatgtattgggtttgatttcatgcttaagatggacaaatacccatttttcaatgcctttatcggacacaagacccccttagagagtttcgctgataaaataattgaaaaggaggaggaaacgtgcgagatcggcactaacaaagaatttaagtgtttcgaggaaagggcctatatcaagggtacatgccctaccaatattaacgcggtacattacatcgacaataaagggaagttgcggtatgtgaaatgtaaggagaacctcgagatgactgaagattgcgcattttgtcgtaaaattaagaagaaagccggacagagcgtccaagtgcagaagacatccgttccactgcaggacgctatatgccaggaaaattctgacacctacagcggcccgaaaatccccttcaagggcgtgtgcaaaattgggttaatcaagtataaggaatgtaaatttaagacgtcaagttacgagaccgtctccttcatcacactgaaagaaaagggaaaaatttatatagagcacctcatgcttaagaacatcgaggtggtaactaatgttagcttcgtgtgctacgaacatgccggtcaagatgagcaggaagtcgagcacaaagcactgaagcgcgtgtctgtcaacgactgtaagattgtggataattcaaaacagaagatctgcaccggcgaccacgtattttgtgagaaatacgattgcagtacaagctatcctgacgtgacttgtattcatgctccagggtccggacccttgtacatcaacctaatgggctcttggataaagcctcagtgcgtaggttatgaaagagtcctggtggatagggaggttaaacaaccactcctggcccccgaacagaattgtgatacctgcgtgtcggagtgtcttgacgaaggggtccacatcaagagcacaggcttcgagattacctccgcggtggcctgctcacatggaagttgcatctctgcacaccaggagccgagcacttccgtaattgtgccttaccccggcctgttggcttcagttgggggacggatcggtatacatctcagccacacgtctgactccgccagtgtccacatggtggtggtctgtccacctcgagatagctgcgctgcccataactgtctgttatgctatcacggcattctgaactaccagtgtcattctacactatccgcaatcctcacctcatttctgcttattttgttcatctatactgtttttagtgtgaccacaaatatactgtacgtgctccgcctgatccccaagcaacttaaaagcccagtagggtggctgaagttgttcattaactggctcctgaccgccttaagaatcaaaactaggaatgtcatgggacggattaaccagcgcatcggctgggtggaccaccacgatgttgaaagacccaggcatcgtgagcctatgcggcgatttaagacaacgctgctactcaccctgataatgatgactggtgggaatgcttgctcgaacacagtggtcgcaaattccaaacagaccagatgtgtgcaggaaggctctaacacaaagtgcagcattactgcaaccatcacgcttagggccggagttatcggcgctgagtcatgtttcattatcaaggggccaatggaaaatcaacagaaaaccattagtataaagacaatctcctctgagactgtgtgccgcgagggaagctccttttggacctcattgtacattccgagctgtctgagttctcggagatgccacctcgtaggtgactgcgtcggcaacaaatgtcagtcctggagggacgatcaactgagccgcgagttctcgggggtgaaggacaatcatatcatgaacgagaataaatgctttgaacagtgtggagccattggctgcggttgtttcaacatcaatccctcatgcttatatgtgcacgcatacctgaagtctgcccgaaacgaggctgtccgggtttttagttgttccgattgggtgcatcgtgttagcttcgaagtgaaggggcctgacggcgagacagagcttgtcactttgggatctctcggcaccaaattcctgaactgggggacgctaagcctgtccctcgatgccgaaggaatatcaggcacaaatagtatcagctttctggagtcttccaagggtgggttcgcactttatgacgaaggatacaacgagattccaagagagggctttttgggtgaaatcaggtgctcaagtgagagcgcggctatttccgcccacaaatcttgtatccgcgcacccggcctgataaagtataaacctatgaccgatcagattgaatgcactgcctcgttagtggacccattcgctatctttctcaaggggagcctgccccagacacggaatggacaaaccttcacttcaaccaaagataagaagacagttcaggcctttacgaacggcgcaatcaaagcccttctgtccattaatttggacgatcacgagatagtgttcatcaacaaggtcaaaaattgtgacgctacctttctcaacgtgagtgggtgctactcttgcgattatggagcgcatgtttgtgtgaaggtcaaaagctccgaatcagccgacttctttgctgagtctgaggacaagactacagtactgagcttcccgattcagagtggcacccacgattactgccaggtgctacattttcaaaagcctctggttgacgaaagactctcctacagctgtggttctgagccaaaactgatcgtgattaaggggacacttgtctatatgggagtgtacgatttcaggaataaaactggcggttcatccaccgtagtgaaccccagtgaaggcgcatggagcatctcgaattggttctctgggttgctggactggttaggaggccctatgaaggccatactcaaaatcctggggtttattgctatcggaattgtctgcttcgttctttttatgatcctgatacgaattgccgtgaactccatcaatatcaagaagaaaaactga

SEQ ID NO: 11080 - RNA, 3942 nt, synthetic construct
  misc_feature 1..3942: note = derived and/or modified CDS sequence (opt3) from PTV(Adames)__KP272029.1__GP
  source 1..3942: mol_type = other RNA
atgatcttcaccattctgaacgtgctcacaagagccatgcttgtcatgagcatgtactccctgactacgtgggactcttcaagtaggaatgatatatgctttagcaacgactcccccttggagggcttagtttattactgggaaacccactctaagaaacatgattataagaaacaggggtcgcaaaagtgtcgggtgggagactcagataaaaagatgatcagcaatgtaacaattatcagtctgatttccgagatccagaagtctataagcgaactatccctctcatgcggtaacaatgacaacagtactggccaggtgctgaccttcaatgggcttgaggatacaatccgcggagactacattgtcgattgtgtgaccggcctgtatcagagcgacatcggtgttggggtgggattgggccgaattaaccacgatcatcaacaggtcaaaaataaggctgtggtaatcgacgaaaaagagaagatgatatctctcctggagactcagcagtccgaaaacgatattaaaacacaagttctgatgtcagagatcgaacagctcaagaatcagttaagcaagcgtagaaacgagaggggccaggagaaacgggacgcagaaaagctgatgagtgaccttatggcccgcaattctgatttgagaaaccacaatgtgattctgaccgacgagatctcccaaatcaaaaacaacattacgatacataggaatcggaacatgatgagcactaccgtcgtgcctgcgatcctatcggtggctctcctgtcttcctcagtcgggccaattacagccgcaccgcccgatagtactatgatcaatccttggccacacgccaagaaccgcgttggaaccggtatgtacaaatatgacgaaaatgatgagagcggctgccgacccataagatacggggtgtcctgtattggatttgacttcatgcttaagatggataaataccctttcttcaacgcttttatcggccacaagacaccactggaatctttcgcagacaagatcattgagaaagaggaagagacctgcgaaatcggtacgaataaggagtttaaatgtttcgaagagagggcctatattaaggggacttgccccacaaacataaatgctgtacattacatcgataacaaaggaaagttgcggtatgtgaagtgtaaagagaatctcgaaatgaccgaggactgcgccttttgtcgtaagattaaaaagaaagcgggccagagcgtccaggtgcaaaagacttcagttcctctgcaggatgcaatctgccaggaaaacagtgacatctactccggcccaaagattccgttcaaaggggtgtgcaagataggattaatcaaatataaggagtgtaaatttaagacaagctcttacgaaaccatttcattcatcacgctgaagggtaaaggcaagatttatatcgagcacctcatgcttaaaaatatagaggtcgtgaccaacgtaagtttcgtttgctacgaacatgccgggcaggacgagcaagaagtggagcaccgcgctctgaagagagtcagcgtgaatgattgtaaaatcgtcgacaactccaagcagaaaatttgcacaggagatcacatcttttgtgagaagtacgactgctctacttcgtatcccgatgtgacctgtattcatacacctggcagcggtccattgtacatcaacctaatggggtcctggataaagccccagtgcgttggctatgaaagggtgctggtagaccgggaggtcaaacagcctctcctggtgccagaacaaaattgtgatacttgcgtttcagagtgtcttgacgaaggagtgcacattaagagtaccggcttcgagatcacatctgccgtcgcatgcagccatgggtcctgcatttcagctcaccaggaggccagcacctctgtgatcataccctacccgggactgttggcgtccgtaggtggccgaatcgggattcatctcagtcacactagcgattctgcctccgtgcacatggttgtcgtgtgtcctccccgcgactcatgcgcagctcataactgtctgttatgctatcacggaatcctgaattaccagtgtcatagtacgctaagcgccattctcacatcgtttctgcttatcttgttcatatataccgctttttccgtgactaccaacgtcctgtacgttctcagactgattccaaaacagcttaagtctcctgtgggctggctgaaattgttcgtgaattggctcctgacagccttaaggatcaagacccggcgcgtaatgggtagaatcaaccaaaggattgggtgggtcgatcaccacgacgtggaacgtccccggcatcgagagccaatgagaaggtttaagactacactgctactcacgctgatcatggttaccggcggaaatgcatgcagcaacactgtggtcgccaattcaaaacagacacgctgtgtgcaggaaggcagtaacaccaagtgctccattacagctactataacccttcgggcgggggttatcggagcagagtcttgtttcattatcaaaggtcccatggaaaatcagcaaaagacgattagcatcaaaaccatatcctcagagacagtgtgcagagagggcagcagtttttggacttctttgtacatcccttcctgtctgagctcgaggcgctgccacctcgtaggggattgcgtcggaaacaagtgtcagtcatggcgagacgaccagctgtctcgggaatttagtggcgtgaaggataatcatattatgaacgagaataaatgctttgaacaatgtggtgccatcgggtgcggctgtttcaacattaacccatcctgcttatatgtgcacgcttacctgaagtctgcccgtaatgaggcagtcagagtttttagctgtagcgactgggtgcatagggtatccttcgaagtgaaaggaccggatggcgagatggagcttgtcaccttggggtcactcggaacaaagttcctgaactggggcactctaagtctgagcctcgacgccgaaggtatctctgggaccaattccatatcatttctggagagtagcaaaggaggcttcgctctttatgatgaaggttactccgagattccccgcgagggctttttgggggaaatccggtgttcttcggagagcgccgcaatctcagcgcacaagtcctgcattagagctcctggactgataaagtataaaccaatgacggaccagatcgaatgcacagccagtttagtggatcccttcgcaatttttctcaagggctctctgcctcagaccaggaacgggcagactttcacaagcaccaaagacaagaaaactgttcaagcctttaccaatggagctatcaaggcccttctgtccattaacttggatgaccacgagatcatattcatcaataaagtgaagtcatgtgatgcaacatttctcaacgtctctggctgctacagctgcgactatggtgctcatgtgtgtgttaaggtgaaaagttccgaaagcgccgatttctttgcggagtctgaggacaagacgaccgtcctgtcattcccaattcagtccgggactcgagactactgccaggtactacactttcagaaacccctggtggatgaacgcctcagttacagctgtggatcggagccgaagctgatcgttattaaaggcacacttgtgtatatgggtgtctacgacttccggaataagaccggcgggtcttccacagtgatcaaccctagcgaaggaacttggtcaataagtaattggttctctggcttgctggattggttagggggaccaatgaaggccattctcaaaatcctgggctttatcgctattggtatcgtatgcttcatactttttatgattctgatcagaattgcagtgaactccatcaatataaagaaaaagaactga

SEQ ID NO: 11081 - RNA, 3942 nt, synthetic construct
  misc_feature 1..3942: note = derived and/or modified CDS sequence (opt3) from PTV(GML488831)__KP272032.1__GP
  source 1..3942: mol_type = other RNA
atgatcttcaccattctgaacgtgctcacaagagccatgcttgtcatgagcatgtactccctgactacgtgggactctacctcaaggaatgatatgtgctttagtaacgacagccccttggagggcttagtttattactgggaaacacactccaagaaacatgattataagaaacaggagtctcaacggtgtcgcgtgggggactcggataagaaaatgataactaatgtaaccatcatttcactgatcagcgaaattcagaagagtatctccgagctatctctcagctgcggaaacgacgataattccacaggtcaggtgctgaccttcaacggccttgaagacactatacgaggggattacatcgtcgactgtgtgacaggactgtatcagtcagatattggcgttggtgtggggttgggacgtgctcaccatgaccaccaacaggtcaagaataaagcagtggtaatcgatgagaaggagagaatgattagtctcctggaaacccagcagagcgagaacgacatcaaaatgcaagttctgatgtctgaaatagagcagctcaagaatcagttatccaaaaagaggaacgagcggggccaggaaaagcgcgacgccgagaaagtgatgtcagatctgatggcgagaaatagcgaccttaggaagcataacgatattttgacggctgaaatcagtcaaatgaaatacaataacactattcagcggtctaagaatgtcatgtccaccacagtggtgcctgccatcctgagcgtcgcactactctcgtcttccgttgccccaatcatggctgcaccgcccgactcacctatgattaacccatggccccacgccaaaaaccgcgtgggcactgggatgtataagtacgatgacaatgatgacagtggatgccgacctataagatacggtgtaagctgtatcggctttgatttcatgctgaaaatggacaagtatccatttttcaacgcttttattgggcacaagacaccccttgagtccttcgccgataaaatcatagaaaaggaggaggaaacctgcgagattggaaccaataaagaatttaagtgtttcgaggaaagggcgtacatcaaaggcacgtgccctactaacatcaatgcagtgcattatattgacaacaagggtaagctgcggtacgtcaaatgtaaggagaatttggagatgacagaagactgcgccttttgtcgtaaaatcaagaaaaaggctgggcagtctgtgcaagttcagaagaccagcgtgtcactccaggatgccatttgccaggagaacagtgacaattattccggaccaaaaataccgttcaagggcgtctgcaaaatcggcctgattaagtacaaagaatgtaagtttaagactagctcttatgagacagtgtcattcatcaccttaaaagaaaaggggaaaatctacattgagcacctgatgctcaagaacatagaggtagttacgaatgtgagtttcgtctgctacgaacatgcaggacaagatgagcaggaagtggagcaccgcgctcttaaaagagtcagcgtgaacgactgtaagatcgttgataattccaaacagaagatttgcaccggtgaccacgtgttttgtgagaagtatgattgctctacatcgtaccccgacgtaacttgtatccatgcccctggcagcgggccactgtatattaacttgatgggatcctggatcaaaccccagtgcgtcggctacgaaagggtgctagttgatcgggaggtgaagcaacctctgctcgcgccagaacagaattgtgatacctgcgtctcagagtgtctggacgaaggtgtgcacataaaaagtacagggttcgagatcacttctgccgtagcatgcagccatggctcctgcatttcagctcaccaggaggccagcacctctgtgatcgttccctatccgggacttctggcttccgtcggcgggcgaattggaatccatttgagtcacacaagcgactctgcctccgtgcacatggtggtcgtttgtcctccccgcgattcatgcgcagcccataactgtctcctgtgctaccacggtatattaaactatcagtgtcatagtaccctgagcgctattctaacttcgtttctcctgatccttttcatttacacggtgttttccgtgacaaccaatatgttgtacgtactgagactcatcccaaagcaactgaaatctcctgtcggctggcttaagctgttcataaactggttgctcactgcgctgaggatcaagacccggaatgtgatggggcgcattaaccagagaatcggatgggttgaccaccacgacgtggaaaggccccgtcatcgggagccaatgcgaagatttaaaacaaccttactgctaactctcattatgatgacaggcggtaatgcatgcagcaacacggtcgtggccaattcaaagcagaccaggtgtgttcaggaagggagtaacactaaatgctccatcacagctaccataacactgcgcgccggcgtgattggagcagagtcttgtttcatcatcaagggccccatggaaaatcaacagaaaactattagcatcaagaccatttcctcagagacggtatgccgggaggggagcagtttttggacctctctttatataccttcctgtttgagctcgagaaggtgccacctggtcggagattgcgtgggtaacaagtgtcagtcatggcgcgacgatcaactctctcgagagttcagtggcgtgaaagacaatcatatcatgaacgaaaataagtgctttgaacagtgtggggccattggatgcggctgtttcaacatcaatccatcctgcctgtacgtccacgcttatttaaaaagcgcccggaacgaggcagttcgtgtgttttcttgtagcgattgggtacatagagtgtccttcgaagtcaagggtccggacggggagacagagctggtgactcttggctcattgggaaccaaattcctcaactggggcacactgagtctaagcctggatgcggaagggatttctggaactaattccatctcatttctcgagagtagcaagggcggtttcgctctgtacgacgaagggtattccgagatacccagggagggatttcttggcgaaatccgctgttcttcggagagcgccgcaatttcagcccacaagtcctgcatccgggctcctggtttgattaaatacaagccaatgaccgatcagatcgaatgcacggccagtctggttgaccccttcgcaatatttttaaaaggctctctccctcagacaagaaacgggcaaaccttcactagcacaaaggataaaaagaccgtgcaggcttttactaatggagccattaaagcgctgctttccatcaacctggacgatcacgagatcgtcttcattaataaggtgaggtcatgtgacgccacctttttgaacgtttctggctgctatagctgcgactacggggctcatgtgtgtgtcaaggtaaaaagttccgaaagcgcagatttctttgccgagtctgaggacaagacaacggtgctctcattcccaatacagtccggaacccacgattactgccaggttctgcattttcaaaaacccctagtggacgaacgactgagttatagctgtggctcggagccgaagctcatcgtcattaaaggtactctggtgtacatcggggtatatgatttccgcaataagacaggagggtcttccaccgtggtcaaccctagcgaaggtgcttggtcaattagtaattggttctctggccttttggactggctgggcggaccaatgaaggccatcttaaaaatactcggctttatcgcaattgggatcgtttgcttcattctgtttatgatccttatacggattgcggtgaactccatcaatatcaagaaaaagaactga

SEQ ID NO: 11082 - RNA, 3942 nt, synthetic construct
  misc_feature 1..3942: note = derived and/or modified CDS sequence (opt3) from PTV(GML488778)__KP272038.1__GP
  source 1..3942: mol_type = other RNA
atgatcttcaccattctgaacgtgctcataagagccatgcttgtgatgagcatgtactccctgacaacttgggactctacgtcaaggaatgatatgtgctttagtaacgacagccccttggagggcttagtttattactgggaaacccactccaagaaacatgattataagaaacaggagtctcaacggtgtcgcgtgggggactcggataagaaaatgatcacaaatgtaactattatctcactgattagcgaaatccagaagagtatatccgagctatctctcagctgcggaaacgacgataattccaccggtcaggtgctgacattcaacggccttgaagacaccatccgaggggattacattgtcgactgtgtgactggactgtatcagtcagatatcggcgttggtgtggggttgggacgtacacaccatgaccaccaacaggtcaagaataaagctgtggtaattgatgagaaggagagaatgatcagtctcctggaaacccagcagagcgagaacgacataaaaatgcaagttctgatgtctgaaattgagcagctcaagaatcagttatccaaaaagaggaacgagcggggccaggaaaagcgcgacgcagagaaagtgatgtcagatctgatggccagaaatagcgaccttaggaagcataacggcatcttgacggcggaaattagtcaaatgaaatacaataacactgtccagcggtctaagaatgtgatgtccaccacagtggtccctgctatcctgagcgttgccctactctcgtcttccgtggcaccaatcatggccgctccgcccgattcacctatgattaacccatggccccacgccaaaaaccgcgtagggactggaatgtataagtacgacgataatgacgatagtggttgccgacctataagatacggcgtgagctgtatcgggtttgacttcatgctgaaaatggataagtatccatttttcaacgcatttattggacacaagacaccccttgagtccttcgctgacaaaatcatagaaaaggaggaggaaacctgcgagattggcaccaataaagaatttaagtgtttcgaggaaagggcctacatcaaaggtacgtgccctactaacatcaatgcggtccattatattgataacaaggggaagctgcggtacgtgaaatgtaaggagaatttggagatgacagaagactgcgcattttgtcgtaaaatcaagaaaaaggccggacagtctgttcaagtgcagaagaccagcgtctcactccaggacgctatttgccaggagaacagtgataattattccggcccaaaaataccgttcaagggcgtgtgcaaaatcgggctgattaagtacaaagaatgtaagtttaagactagctcttatgagacagtatcattcatcaccttaaaagaaaagggaaaaatctacattgagcacctgatgctcaagaacatagaggttgtgacgaatgtcagtttcgtgtgctacgaacatgccggtcaagacgagcaggaagtcgagcaccgcgcacttaaaagagtgagcgttaacgattgtaagatcgtggactcctctaaacagaagatttgcaccggcgatcacgtattttgtgagaagttcgactgctcgacaagctatcccgatgtcacttgtatccatgctcctgggtccggaccactgtacattaatttgatgggctcatggatcaaaccccagtgcgtgggttatgaaagggttctagtggaccgggaggtcaagcaacctctgctcgccccagaacagaactgtgatacctgcgtgagtgagtgtctggacgaaggggtacacataaaatctacaggctttgagatcactagcgcggtggcctgctcccatggatcatgcattagcgcacaccaggaggcttctacctccgttatcgtcccctacccgggccttctggccagtgtcgggggacgaattggtatccatttgagccacacatctgattccgcttcagtgcacatggtggttgtgtgtcctccccgcgacagttgcgccgcacataattgtctcctgtgctatcacggcatattaaactaccagtgtcatagcaccctgtcggccattctaacttccttcctcctgatcctttttatttatacggtgttctctgtaacaaccaacatgttgtacgtcctgagactcatcccaaagcaactgaaaagccctgtggggtggcttaagctgtttataaattggttgctcactgctctgaggatcaagacccggaacgttatgggacgcattaatcagagaatcggctgggtggatcaccacgacgtcgaaaggccccgtcatcgggagccaatgcgaagattcaaaacaaccttactgctaactctcattatgatgacaggtgggaacgcgtgctcaaatacggtggttgcaaacagtaagcagaccaggtgtgtgcaggaaggctccaatactaaatgctctatcacagccaccataacactgcgcgctggagtaattggcgccgagagctgttttatcatcaagtcccccatggaaaaccaacagaaaactatttcaatcaagaccattagcagtgagacggtctgccgggaggggtcttccttctggaccagcctttacataccttcgtgtttgtcatctagaaggtgccacctggtgggagactgcgtgggtaataagtgtcagagttggcgcgatgaccaactctcccgagaatttagcggcgtcaaagataaccatatcatgaatgagaacaagtgcttcgaacagtgtggggcaattggatgcggctgttttaatatcaacccatcttgcctgtatgttcacgcctacttaaaaagcgctcggaatgaggccgtgcgtgtattctcctgttcagactgggtgcatagagtcagtttcgaagtgaagggtccggatggggagacagagctggttactcttggcagcttgggaaccaaatttctcaactggggcacactgtctctatccctggacgcagaagggatttcaggaactaacagtatcagcttcctcgagtcctctaagggcggttttgcgctgtatgatgaagggtactcggagatacccagggagggattccttggcgaaatccgctgcagctcagagtccgctgccattagtgcacacaagtcttgtatccgggcccctggtttgattaaatataagccaatgaccgaccagatcgaatgcacggctagcctggtggatccctttgccatattcttaaaaggctccctccctcagacaagaaatgggcaaacctttacttcaacaaaggacaaaaagaccgtccaggcattcactaacggagctattaaagccctgctttctatcaatctggatgaccacgagatcatttttataaacaaggtgaggagctgtgatgcgaccttcttgaatgttagtggctgctactcctgcgactatggggcccatgtgtgtgtcaaggtaaaaagctctgaatcagctgactttttcgcagagtccgaggataagacaacggtgctcagttttccaatccagagcggaacccacgactactgccaggttctgcatttccaaaaacccctagtggatgaacgactgtcgtactcttgtggctccgagccgaagctcattgtcatcaaaggtactctggtgtatatgggggtatacgacttccgcaacaagacaggaggcagctcaaccgtggtcaatcctagtgaaggtgcctggtctatttccaactggtttagcggccttttggattggttagggggaccaatgaaggctatcataaaaatcctgggcttcattgccatcggggttgtgtgctttattctcttcatgatcctgatacggattgcagtcaattcaatcaacatcaagaaaaagaattga

SEQ ID NO: 11083 - RNA, 3945 nt, synthetic construct
  misc_feature 1..3945: note = derived and/or modified CDS sequence (opt3) from PTV(Adames)__DQ363407.1__GP
  source 1..3945: mol_type = other RNA
atgatcttcaccattctgaacgtgctcacaagagccatgcttgtcatgagcatgtactccctgactacgtgggactcttcaagtaggaatgatatatgctttagcaacgactcccccttggagggcttagtttattactgggaaacccactctaagaaacatgattataagaaacaggggtcgcaaaagtgtcgggtgggagactcagataaaaagatgatcagcaatgtaacaattatcagtctgatttccgagatccagaagtctataagcgaactatccctctcatgcggtaacaatgacaacagtactggccaggtgctgaccttcaatgggcttgaggatacaatccgcggagactacattgtcgattgtgtgaccggcctgtatcagagcgacatcggtgttggggtgggattgggccgaattaaccacgatcatcaacaggtcaaaaataaggctgtggtaatcgacgaaaaagagaagatgatatctctcctggagactcagcagtccgaaaacgatattaaaacacaagttctgatgtcagagatcgaacagctcaagaatcagttaagcaagcgtagaaacgagaggggccaggagaaacgggacgcagaaaagctgatgagtgaccttatggcccgcaattctgatttgagaaaccacaatgtgattctgaccgacgagatctcccaaatcaaaaacaacattacgatacataggaatcggaacatgatgagcactaccgtcgtgcctgcgatcctatcggtggctctcctgtcttcctcagtcgggccaattacagccgcaccgcccgatagtactatgatcaatccttggccacacgccaagaaccgcgttggaaccggtatgtacaaatatgacgaaaatgatgagagcggctgccgacccataagatacggggtgtcctgtattggatttgacttcatgcttaagatggataaataccctttcttcaacgcttttatcggccacaagacaccactggaatctttcgcagacaagatcattgagaaagaggaagagacctgcgaaatcggtacgaataaggagtttaaatgtttcgaagagagggcctatattaaggggacttgccccacaaacataaatgctgtacattacatcgataacaaaggaaagttgcggtatgtgaagtgtaaagagaatctcgaaatgaccgaggactgcgccttttgtcgtaagattaaaaagaaagcgggccagagcgtccaggtgcaaaagacttcagttcctctgcaggatgcaatctgccaggaaaacagtgacatctactccggcccaaagattccgttcaaaggggtgtgcaagataggattaatcaaatataaggagtgtaaatttaagacaagctcttacgaaaccatttcattcatcacgctgaagggtaaaggcaagatttatatcgagcacctcatgcttaaaaatatagaggtcgtgaccaacgtaagtttcgtttgctacgaacatgccgggcaggacgatgagcaagaagtggagcaccgcgctctgaagagagtcagcgtgaatgactgtaaaatcgtcgataactccaagcagaaaatttgcacaggagaccacatcttttgtgagaagtacgattgctctacttcgtatcccgacgtgacctgtattcatacacctggcagcggtccattgtacatcaacctaatggggtcctggataaagccccagtgcgttggctatgaaagggtgctggtagatcgggaggtcaaacagcctctcctggtgccagaacaaaattgtgacacttgcgtttcagagtgtcttgatgaaggagtgcacattaagagtaccggcttcgagatcacatctgccgtcgcatgcagccatgggtcctgcatttcagctcaccaggaggccagcacctctgtgatcataccctacccgggactgttggcgtccgtaggtggccgaatcgggattcatctcagtcacactagcgactctgcctccgtgcacatggttgtcgtgtgtcctccccgcgattcatgcgcagctcataactgtctgttatgctatcacggaatcctgaattaccagtgtcatagtacgctaagcgccattctcacatcgtttctgcttatcttgttcatatataccgctttttccgtgactaccaacgtcctgtacgttctcagactgattccaaaacagcttaagtctcctgtgggctggctgaaattgttcgtgaattggctcctgacagccttaaggatcaagacccggcgcgtaatgggtagaatcaaccaaaggattgggtgggtcgaccaccacgatgtggaacgtccccggcatcgagagccaatgagaaggtttaagactacactgctactcacgctgatcatggttaccggcggaaatgcatgcagcaacactgtggtcgccaattcaaaacagacacgctgtgtgcaggaaggcagtaacaccaagtgctccattacagctactataacccttcgggcgggggttatcggagcagagtcttgtttcattatcaaaggtcccatggaaaatcagcaaaagacgattagcatcaaaaccatatcctcagagacagtgtgcagagagggcagcagtttttggacttctttgtacatcccttcctgtctgagctcgaggcgctgccacctcgtaggggactgcgtcggaaacaagtgtcagtcatggcgagacgatcagctgtctcgggaatttagtggcgtgaaggacaatcatattatgaacgagaataaatgctttgaacaatgtggtgccatcgggtgcggctgtttcaacattaacccatcctgcttatatgtgcacgcttacctgaagtctgcccgtaatgaggcagtcagagtgttttcttgtagcgattgggtgcatagggtatccttcgaagtgaaaggaccggacggcgagatggagcttgtcaccttggggtcactcggaacaaagttcctgaactggggcactctaagtctgagcctcgatgccgaaggtatctctgggaccaattccatatcatttctggagagtagcaaaggaggcttcgctctttatgacgaaggttactccgagattccccgcgagggctttttgggggaaatccggtgcagctcggagagcgccgcaatctcagcgcacaagtcctgtattagagctcctggactgataaagtataaaccaatgacggatcagatcgaatgcacagccagtttagtggaccccttcgcaatttttctcaagggctctctgcctcagaccaggaacgggcagactttcacaagcaccaaagataagaaaactgttcaagcctttaccaatggagctatcaaggcccttctgtccattaacttggacgatcacgagatcatattcatcaataaagtgaagtcatgtgacgcaacatttctcaacgtctctggctgctacagctgcgattatggtgctcatgtgtgtgttaaggtgaaaagttccgaaagcgccgacttctttgcggagtctgaggacaagacgaccgtcctgtcattcccaattcagtccgggactcgagattactgccaggtactacactttcagaaacccctggtggacgaacgcctcagttacagctgtggatcggagccgaagctgatcgttattaaaggcacacttgtgtatatgggtgtctacgatttccgggacaagaccggcgggtcttccacagtgatcaatcctagcgaaggaacttggtcaataagtaactggttctctggcttgctggattggttagggggaccaatgaaggccattctcaaaatcctgggctttatcgctattggtatcgtatgcttcatactttttatgattctgatcagaattgcagttaattccatcaacataaagaaaaagaattga

SEQ ID NO: 11084 - RNA, 3942 nt, synthetic construct
  misc_feature 1..3942: note = derived and/or modified CDS sequence (opt3) from PTV__M11156.1__GP
  source 1..3942: mol_type = other RNA
atgatcttcaccattctgaacgtgctcacaagagccatgcttgtcatgagcatgtactccctgactacgtgggactctacctcaaggaatgatatgtgctttagtaacgacagccccttggagggcttagtttattactgggaaacacactccaagcggcatgattataaaaagcaggagtctcaacgctgtcgagtgggggactcggataaaaagatgataactaatgtaaccatcatttcactgatcagcgaaattcagaaaagtatctccgagctatctctcagctgcgtgaacgacgataattccacaggacaggtcctgaccttcaacggtcttgaagacactatacgtggcgattacatcgtggactgtgttacagggctgtatcagtcagatattggagtgggcgtcggtttggggagaacccaccatggacaccaacagatgaagaataaggctgtggtaatcgacgagaaagagaggatgattagtctcctggaaacgcagcagagcgagaacgatatcaagatgcaagttctgatgtctgaaatagagcagctcaaaaatcagttatccaagaaacggaacgagcgcggccaggaaaagagagacgcagagaaggtgatgtcagacctgatggccaggaatagcgatcttcggaaacataacgacattttgactgcggaaatcagtcaaatgaagaataaaaacaccattcagcgcaataagaacacagtctctactaccgtggtgcctgctatcctgtccgtcgccctactcagctcgtctgttgcaccaatcattgccgctccgcccgattcccctatgataaacccatggccccacgccaaaaatcgagtgggcacagggatgtacaagtatgacgagaacgatgactcaggatgcagacctatcaggtacggtgtaagttgtattggctttgatttcatgctgaaaatggacaagtacccatttttcaatgcatttatcgggcacaagacccccttggagagcttcgctgataaaataattgagaaggaggaagagacgtgcgaaatcggaactaacaaagagtttaagtgtttcgaagaacgggcctatatcaaaggcacatgccctaccaatattaacgcggtgcattacatcgacaataagggtaagctgcgttatgtcaaatgtaaggagaacttggaaatgactgaggattgcgcattttgtcgcaaaattaagaaaaaggccgggcagtccgtgcaagttcagaagacatctgtgccactccaggacgctatatgccaggaaaatagcgacacctactcaggaccgaaaatccccttcaagggcgtctgcaaaattggcctgatcaagtataaagagtgtaagtttaagacgagttcctacgaaaccgtgagcttcatcacattaaaagagaaggggaaaatttatatagagcacctgatgctcaagaacatcgaagtagttactaatgtgtctttcgtctgctacgagcatgtgggacaagatgaacaggaggtcgagcacagagcccttaaaagggtgtcagttaacgactgtaagattgtggataatagtaaacagaagatctgcaccggtgaccacgtattttgtgaaaagtacgattgcagcacatcctatcctgacgtcacttgtattcatgcaccaggctctgggcccctgtacatcaacttgatgggatcgtggataaaacctcagtgcgtgggctatgagcgggttctagtggatcgagaagtcaagcaaccactgctcgctcccgagcagaattgtgatacctgcgtgagcgaatgtctggacgagggtgtacacatcaaatccacagggttcgagattacctcagccgtggcgtgcagtcatggctcttgcatcagcgcccaccaggaaccgtccacttcagttattgtcccttaccccggacttctggcaagcgtgggcgggcgcatcggaatacatttgtctcacacgtccgacagtgctagcgtgcacatggtcgttgtgtgtccacctagagattcttgcgccgctcataactgtctcctgtgctatcacggtattttaaactaccagtgtcattccacactgtcagccatcctaaccagttttctcctgattcttttcatctatactgtgtttagcgtaaccacaaatatattgtacgtcctgaggctcatccccaagcaactgaaatcgccagtgggctggcttaagctgttcattaactggttgctcaccgcactgcggatcaagactcgcaatgttatgagaaggattaaccagcgtatcgggtgggtggaccaccacgatgtcgagcggccccgacatagagaacctatgaggcgctttaaaacaacgttactgctaaccctcataatgatgactggaggcaatgcctgctccaacacagtggttgctaattctaagcagacccggtgtgtgcaggagggtagcaacacaaaatgctcaattactgcgaccatcacgctgagagcaggggtaatcggcgccgaaagttgtttcattatcaagggaccaatggagaatcaacagaaaaccatttccataaagacaatctctagcgagactgtctgcagggaaggctcctcattttggaccagcctttacattccgagttgtttgtcttcccgccgatgccacctggtgggggactgcgtgggaaacaagtgtcagagctggcgggacgatcaactctcgcgtgagttctcaggtgtcaaagacaatcatatcatgaacgaaaataagtgctttgagcagtgtggcgctattgggtgcggatgtttcaacatcaatccctcttgcctgtatgttcacgcctacttaaaaagtgcaagaaacgaagccgtgagggtattttcctgtagcgattgggtgcatcgcgtctctttcgaggtgaagggccctgacggtgagacagaactggttactcttgggagcccaggcaccaaattcttgaactggggaacgctctccctgtcactagatgctgagggcataagtgggacaaatagcatctcttttctggaatcctcaaagggaggcttcgccctctatgacgagggttacaacgagattccccgggaagggtttctgggagagatcagatgcagtagcgaatccgcagcgatttctgctcacaagtcgtgtatcagggcccctggccttataaaatataagccaatgaccgatcagattgagtgcactgcaagccttgtggaccccttcgccatctttctgaaaggttcattaccgcagacacgaaatggccaaaccttcacttccaccaaggataaaaagacagtccaggcttttacgaacggggccatcaaagcactcctgagtattaatcttgacgatcacgaaatagtgttcatcaacaaggttaagaattgtgacgctacctttctgaacgtgtctggatgctacagctgcgattatggcgcccatgtctgtgtaaaagtgaagtcctcagagtctgcggacttctttgccgagagcgaagacaaaactacagttttgagtttccctattcagtccgggacccacgattactgccaggtgctccattttcaaaagccactggtcgacgagcgcctaagctactcttgtggatcagaacccaaactgatcgtgattaagggcacactcgtatgcatgggtgtgtatgatttccggaataagactgggggatccagtaccgtcgttaaccctagcgagggcgcttggtcgatctctaattggttctccggtctgcttgactggttgggcgggcccatgaaagcaatactgaagatcttaggatttattgccatcggcattgtgtgtttcgtgctctttatgatcctgataagaattgctgtcaacagcatcaatatcaaaaagaaaaactga

SEQ ID NO: 11085 - RNA, 3852 nt, synthetic construct
  misc_feature 1..3852: note = derived and/or modified CDS sequence (opt3) from Phlebovirus(CoAr170255)__HM566149.1__GP
  source 1..3852: mol_type = other RNA
atgtacaagctgatcaccaacattctcaaacttagcgtggtctccgccatgtattctataatgttctgggaccccacaggcatctcaaagctgtgcttgagtaataacagccctttagaggggctggtttactattgggaaaatactatgagagagggagaatttaaaagggagaagcggaaaaagtgtcgcctaggtatttccgaaccagctccggtgtctaaccagacgatcgtatcgctcattgaggaggtgcaaaagtcacccgcagaaatgatcctgatatgcgaggccaatggcaacagcaccgggagttccctttctttcgatggactgagcgacaatgaaatcaaaccttccattgtcgattgtacaactggcgaccgaacctcagatttgcgtgtgctcgttggtaaggggatctttgagaaaaagatgagtatgagcaacgagattgacagagtggtctctctggaagatcaccttcagagggagaaagaactcgtgcagacattccaggacttacatcacaatgagtccgaaaagaacaagctgcttgagcatgagttggaaaatgtacggcaacagctgaaacgcgagagagaatcaaacaagatcaaaatgtggaccactaagaggccagagataacaaccattggactaacgactaccatcgcgacaattctcctggctagccagagtgttgcctcttccgtgcccatgcctggccagcttaatacttggccacacgcaaagaaccgggtcggcgggggagtgtttaaggccaatgatgacgatgaagacagctgcaaactgatcgattacggtatcgcttgtcatggcttcgactatttgctccgcaccgacatttacccctttttcaacgcacacgtgtcgcaccgatctctgttagaggcctccaacgaggggataatcctgaaggatgaggcttcatgcgagattgaaacaaataaggactttaaatgttatgaggaaagagccttcctcaagtggagttgccctcatcttgtcaacagcgcgcactttatcgattccaaaggaaagctgaggataattaaatgtaaggcagagtacgagatcaccgaagactgcacgtactgtcggcgtatcaagaaaaaggccgctcaacagaaacaggtttataagtctagcattgccttgcaggatgcagtgtgccaagaaaattcagactactatgatggcccacgcatcactttcacaggtgtatgcaaaattgggaccatggaatacaagaagtgtaaacataagagttccagctttgagaacataggattcatcactattagagacaaaggcaagtattacatcgagaatatgaggaccaaaaacatcgaaatggtgtctaatgtctcattcatttgctataaccacaatggccaggatacagagaaggacgtgcggctactgaagcgagttaaaccgggggattgtaaggtggtcgacgacagtaaaacgaagcactgcaccggagatcatgtgttttgtgaaaaatacgactgcacaaagagctaccccgaggctacttgtatgcacgcccctggttccggcccaatactcgtactggttatgggggtgtggttcaaaccccagtgcgtcggatatgaacgcgtgcttgtcgagagagaggtgaaggcgcctgttctgatccaagaaaaggattgtgatacctgcgtgtttgagtgtttggaagacaaaattctcatcaagtctacaggcttcaaaatgatttcggccgtagcatgcagccatggttcctgcgtctcaagtcaccagtctccaagcacttttctgtacatcgactatcccgggttaaccgcttccgtgggcggagagataggcctgcatctatcacacacagatgacagcgtttctgtgcacaagaaaatccattgtccggccagggatccttgcgaagctcactcctgtattgtctgctaccatgggctcgtgaactatcagtgtcacaccgtactgagttacagcgtggtttctttccttttggtctgcatgatgtatctggcctttttcatcacttcccggctcctgtttttccttcgcattatgcccagaaggctgcgtaatccaatctcatggttgacgctcctgatacggtgggtgttacagacactgctagcaattctccgactgagttttaagaaacttagcgagaccatcggatggaactcgcctaataacagacaacagatggacgtggaggccaataggcgccccttgcggagatacaggactaccttcattctgacactcctgtttgtcggtttaacctccgcttgttctaacactgcggttagcaactcaaaacagacaaagtgcctgcagagtggcgggtccgtgaaatgttctatcacggcaaccataactcttaaggccggaacaatcggcgctgaaagctgcttcattatcaaaggtccatccgagaatcaacagaaggtgattcgcgtaaagaccgtctcaagcgaaacagtgtgtcgagaggggagttctttctggactggccagtttaccccctcctgcgttagctcgcggcgttgccacttggtgggagattgtgtcggcaacagatgccaggcctggagggacgaagtggtttcacgcgagttcgggaatatgaaagataacaatgtgatgtctgagaacaagtgttttgaacaatgcggagcagccggttgtggctgcttcaatatcaaccctagttgtctctacgtacattccacgtttaaaagcgtccggagagaggctataagggtgttcaagtgcaatgactgggtgcaccgactgacctttgaagtctctgggccaagcggagagaaagaccgcattgttctaaactccctgtcaacaaagttcctccagtggggcactatcagtctgagccttgatgccgagggtatctctgggaccaattcctattcatttttggaaagtaacaagggcggattcgcaattcatgacgaggaatttagcgagatcccgcgggaaggctacctgggggagattagatgttcctctgagtcggcggtgatagctgcccacaaaagctgcatcagggcacccaatttaattaagtataaacctatgacagatcagatcgactgtactgcctcactcgtagatccattcgctatttttctgaagggatcccttccccagagtcgttctggctacaccttcacgagctccacagacaaaaagaccgtgcaagccttcaactcaggttctatcaaagcactgataagcatcaatatggatgaccatgaaattgagtttttgaacgatgctgccgactgcgatgcgactttcctcaacgtcagtgggtgctattcctgtaattacggagcccaggtgtgcatcaaggttcgcagctctaagtcatccatttttagtagcaacaataacgacaattcgatcgtgataaacttcgatgctgaccagggcacacgggactattgtagaattatccactttaatggtcctctggtcgatgaaaccctacactactcttgcggcggggagtccaaactgctccaaatgaagggaagcctgatcactgtgggcccatacgacttcaggaacaccacagggggaaaatcaacgattgttaatccccatgaagagagttggaacctgttttcttggttctccggcttgctggattggttaggtgggccgctccgagcaatactgaagatcgtgcttattatcattatcggaataatcctgtttattgtcgtagccttcctaatccggctcgtgatttttaatgttctgttgaaaagcaagaagaactga

SEQ ID NO: 11086 - RNA, 3873 nt, synthetic construct
  misc_feature 1..3873: note = derived and/or modified CDS sequence (opt3) from Phlebovirus(CoAr171616)__HM566154.1__GP
  source 1..3873: mol_type = other RNA
atgttccagatcatttacctgctcaccaaactttatctggtgagctccatgtactctataatgttttgggagaacgaaaatatctcaaaattgtgcttaagtaacaatagccccctggagggcctagtctattactgggaaaacgttatgaaggagggggacttcaaagaagagaagaggaaaaagtgtagaattggaccttccgatctcaagcgggtgacaaatcaaactctgacgacccttatcgaggaagtacagaaatctccatcggagattcagctgttgtgcgaagaggacggtaacaagacaggcatctcaatgtttttcgatgggctcagcgacgatataagtactccgtccatcgtggactgtaatggaaacattcgcatctctgatctgcgagtccaggtgggccgtggtcactttgagaaagaaaatgagattagaaagatcgaagagatagttaccctggaagacgatctcaggcgggagcgcgacttaaacaaactgcttcaagatttgaataagaaggacgccgaggaaagaaggattatcgagcatgaactgacaaacatgcgggagcagctacagcgcgaacgagagagaagcaaacagcaaattaaggagcacgagaaaatcgaagtgaataaccataaggaacccgctacccacctcaatgtctccaaactgcttactatcgggctgttggcacaacaggtgggacaggtaattgccacagagcctggccagctcaacacctggatacatgcgaagaacaggatcggcaaagggctgtataagacggaagatactgacgaggacggatgccggggtttagattacggcgtttcatgtctggggttcgactatctccttcgtaccgatatttacccatttttcaatagttttgtgagccacctgtctatgttggaggcttccacagaagacctaatcgagaaggaaggaacttcatgcgagatagagaccaacaaagagttcaagtgttacgaagaacgcgcctttattaaaggcagctgcccccacctggtcaatagtgcacatttcctcgataacaagggtaaactgagaatcgtgaagtgtaagacagactttgagatgaccgaagattgcacgttctgtaggaaaatcaagaaaaagaactctcagcacaaacaggtgttcaagacttccattgcccttcaagacgctgtctgccagaataatagcgatctgtataacgggcctcggatcgtttactcgaatgtgtgcaagattggaatggtatcttataaacagtgtaagtccaaaacatcaagttacgagagcgtgggctttgtcatattgaagggcaaagggaagttctatatcgagaacatgaagattaaaaatatcgaagtgatcgcaaacgtttcctttatttgccatcagtaccaaggacaggacggtaccgagaaggaacagcgatctctcaaacgcataagcgtgggcgagtgtaagtcagtcaatccacagaaaactaagcactgcacaggggatcacgtgttctgtgaaaaatatgactgcaccaagagttaccccgaggtaacgtgtctgatggcccctggatccggcccaatcttagttcaaattatgggtagctggatcaagccgcagtgcgtggggtacgagaaagtcctggtggaaagagaggtcaagtctcccaccctaacagaagagagggactgtgatacttgcgtgtatgaatgtctcgaggacaaaattctgatcaagtcaaccggctttaaaatgataagtgctgttgcctgcagccatggaatgtgcgtgtcctctcaccaggagccttcgacattcctttacatcaactatccaggcatgagcgcgtccattgggggagaaatcggtttgcatctgtcacacactgatgacagtctctctctgcataaggtaattagctgtccctcccggaatccttgcgatgtccactcatgtatcatatgctaccacggcattatcaactatcagtgtcataccgcacttagctacacaattgtggccttttctttcatctcctttctgtatttgaccttcaaggttataagtcaactcctgtacacttttaaagtggtcccaaagaaattaaaggggcccttctactggatgggatatctgatcaaatggattgtgaagacgatcctaggcgtagtgcgcaacacatttttcaccatgagcaatagaattggttgggagaggcgtgacgaaatccacgaggatatagaggctaacccgcggcgacatctccagagattcaagactacctttgttctgacaatgcttatgattaatgggggcttgtgctgttctaacaccctggtctccaattcaaaacagactaggtgcgtgcagagtggaaacgaagtgaagtgtagcgtctcggccacagttgtgctcaaagcaggcgtgatcggggctgagtcctgcttcatcattaagggaccttctgaaaatcaacacaaaatgatcagcgtacgcacgctgtcaagtgagaccgtctgtcgggaaggtgcctccttttggactggccacttctctcccagctgcgtgtcctcaagaaggtgccatttagttggggagtgtcacggaaaccgctgccagagctggcgagacgatcagattagtcgggagtttggcggtgtgaaggacaataaccgtatgtctgaaaataagtgtttcgagcaatgcgggtccataggctgtggatgctttaacatgaatccaagctgtctgtacgtccatacaacccttaaatcggcgagaaacgaagccgtgagggttttcaagtgcaatgattggatccaccgcttgaactttgaggtgattggcccttcaggggaaaaagacgtagtcacactcaactctatgagtactaagttcctgcagtggggaaccatctccctaagcctggatgcagagggcattacgggtaccaattcttatagctttctcgagtcctcaaaagggggattcgctatccatgacgaagagtttagtgacataccccgggaaggctacctgggtgagatcagatgtagctctgaatccgccgtgatttcagctcacagtagctgcatcagggccccagatcttattaagtataaacccatgacagaccagatcgagtgtacttccaccttgatagatcctttcgcaattttcatgaagggctctctgccacagacacgatcggggtacacttttaccagctcaaaggacaaaaagacgatccaagccttcaacacaaattccatcaaggctttaattagtctcaacctggatgaccacgagatagtgtttgtctctgatcagaccaattgcgaatgcactttccttaacctgacaggatgttatagctgcgactacggcgcgcatgtttgttttcgcatcaagtccgataaaaagggggtgttcgtatcaaataccgaggcaaaggacatttcttttggattcgaagtgttgactggcacccacgattactgccagatccagcattttaacagcccgagtgtctataaaacactctcctacagctgtggtggggagtctaagctgctagtgattaaaggatcactgatcacgataggcccccacgactatcggaataagaccggtggcgcctccactgttgtgaaccctagtgaggaagggtggagcgtcacaaattggatcggaggcttcatttcgtggctcgggggaccactgaaagctcttttgaagatcgccgtgaccattctggcaggcgttgtgatctttttaataatttacttcttcctcagactgatcgccacaaacatccttatgaagactaaaaagaattga

SEQ ID NO: 11087 - RNA, 3852 nt, synthetic construct
  misc_feature 1..3852: note = derived and/or modified CDS sequence (opt3) from Buenaventura virus(CoAr3319)__KP272002.1__GP
  source 1..3852: mol_type = other RNA
atgtacaagctgatcaccaacattctcaaacttagcatggtgtccgccatgtattctataatgttctgggaccccacaggcatctcaaagctgtgcttgagtaataacagccctttagaggggctggtctactattgggaaaatactatgagagagggagaatttaaaagggagaagcggaaaaagtgtcgcctaggtatttccgaaccagctccggtttctaaccagacgatcgtgtcgctcattgaggaggtacaaaagtcacccgcagaaatgatcctgatatgcgagaccagcggcaatgccacagggagttccctttctttcgatggactgagcgacaacgaagtgaaaccttccatcgtcgattgtgcgactggcgagcgaacctcagacttgcgtgtgctcgttggtaaggggacatttgagaaaaagatgagtatgagcaatgaaattgatagagtggtctctctggaggaccacttgcagagggaacgggagctcgtgcagaccttccaggatttacatcacaacgaatccgagaaaaataagctgcttgagcatgaattggagaacgtacgccaacagctgagaagggaacgggagtcaaataaggttaaagtgtggactacaaagaaaccagaagtcaccacgatcggactaactaccacaattgctactatcctcctggccagccagagtatagcatcttccgtgcccatgcctggccagcttaacacctggccacacgccaagaatcgcgtgggcgggggagtctttaaagctaacgacgatgacgaggatagctgcaagctgattgactacggtatcgcatgtcatggcttcgattatttgctccgaacagacatttacccctttttcaatgcccacgtttcgcacagatctatgctggaggcttccaacgaagggatcatcttaaaagacgaggcctcatgcgaaattgagaccaacaaggatctgaagtgttatgaagagagggcgtttctcaaatggagttgccctcatcttgtgaatagcgcacacttcatagactccaagggaaaactgcggatcattaagtgtaaagccgagtacgaaatcacggaggattgcacttactgtcgtcgcataaagaagaaagctgcccaacagaagcaggtatataaatctagcattgcattgcaggacgctgtgtgccaagaaaactcagattactatgacggcccaagaatcacatttaccggtgtctgcaagatcgggagtatggagtacaaaaagtgtaagcataaatccagctctttcgagaatgtgggatttattactatcagggataagggcaaatattacattgaaaacatgcggataaagaatatcgagatggtttcaaacgtgagtttcatttgctataatcacaacggccaggacacagaaaaagatatccgactactgaagcgcgtcaagccgagcgactgtaaagtggtagatgactccaagtctaaacactgcaccggggaccatatcttctgtgataagtacgactgcacgaaatcgtaccccgaggccagctgtatgcacgcgcctggatccggtccaattctcgttctggtgatgggcgtctggtttaagccccagtgcgtggggtatgaaagagtccttgtggagagggaggttaaagtgcctgtactgacccaagaaaaggattgtgacacatgcgtcttcgagtgtcaggaagataagatattgatcaaatcaactggatttaagatgattagtgccgtggcatgctctcatggcagctgcgtttcctcacaccagagcccatctaccttcctctacatcgactatcccggtctgacagcttccgtcgggggcgagattggattacatctgagtcacactgatgacagcatctctgtgcacaaaaagatacattgtccggcccgggatccttgcgaagctcacaattgtgtgatctgctaccatggcctaattaactatcagtgtcacacctttctctcctactcagtagtgagtttcctgtttatcagcgttctttatttgacattctttattgtctcgcgcctgctcctgttccttaaaatcatgcccaagagactgaagaatccaatatcctggttgaccctcctgattaggtgggtgttacaaactctgatcacgattctacgtctctcttttaaaaagctgagcgagacaatcgggtggaccactaacgacaatcggcagcacgtggatgtcgaggccaaccgaagacctcttaggcgctaccggaccacattcatattgaccctgctctttatcggactggcatcaggttgcagtaatactgccgtttccaactctaaacagacaaagtgtttacagagcggcgggtccgtgaaatgctcaattacggctaccatcactctgaaggcgggaattatcggcgcagaaagctgtttcataattaagggtcccagtgagaaccaacagagagtgatcagggtaaaaacaatctcttccgaaaccgtctgccgcgaggggagctcgttctggacaggcctttttactccatcatgtgtgtctagtcgacggtgccatttggttggagactgcgtgggcaatcgttgtcagtcctggagagatgaagtcgtgagcagggagttcgggaacatgaaggacaataacgccatgtctgagaataaatgctttgaacagtgtggagctgccggttgcggctgtttcaacattaatcccagctgcctctacgttcactccgtgtttaagtcagtacgccgggaggcaatcagagtcttcaaatgtaacgactgggtgcataggctgacctttgaagtgagtgggcctagcggagagaaggatcgaattgtcctaaattctctgtccacgaagttcctccaatggggcaccatatcactgagtcttgacgccgagggtatcagcgggacaaactcctattcttttctggaatcgaataaaggcggattcgctattcacgatgaggaatttagcgagatcccacgcgaaggctacctgggggagattcggtgctcatccgagagtgccgttatcgcagcgcataagtcttgtataagagctccgaacttaatcaaatataagcccatgactgaccagattgattgcaccgccagcctcgtggaccctttcgcaatctttctgaaaggatcccttccacagtcaaggtctggctacacattcactagcagtaccgataagaaaacggtacaggccttcaattccggtgctattaaggccctgatcagcataaacttggacgatcacgaaattgagtttctctctgacacagcagattgtgacgctaccttcctgaatatctcagggtgctattcctgcaactacggagcccaagtgtgtatcaaggtccgtagtagcaaatcgtctatattttccagcaacaataacgataattcaattgtgatcaacttcgacgcggaacagggcactcgcgactattgccggattatccactttaatggtcccctagttgatgagacactgcattacagttgtggcggggaatctaagctcctgcagatgaaaggatcccttattaccgtgggcccttacgacttcagaaacactaccgggggaaagagcacagtcgtgaatccacacgaggagtcatggaacttgtttagttggttcagcggcctgttagattggctcggtgggcccctgagggccatccttaaaatagttctgatcgtgattatcggaattatcctatttatagtcgtagtgttcctcatgcgactggctattttgaatgttctgttaaagtccaagaaaaactga

SEQ ID NO: 11088 - RNA, 3942 nt, synthetic construct
  misc_feature 1..3942: note = derived and/or modified CDS sequence (opt3) from Cocle virus(GML244915)__KP272034.1__GP
  source 1..3942: mol_type = other RNA
atgatgttcacccacctggacgtgctcacaagagccatgcttgtcatgagcatgtactccctgactacgtgggattctatcaggcggaacgacatttgcttttcaaatgatagtcccttggagggcttagtttattactgggaaacccagagcaagatgcatgagtataaaaaggaagactcccaaaaatgtcgcgtgggggattctgagaagaaaatgatatcgaacgtaacaatcatttcactgatcagcgaaattcagaagagtatctccgagctatctctcagctgcggaaatgacgataactccactggtcaggtgctgatgttcaatggccttgaggacaccatacgaggggattacatcgtcgactgtctgacaggattgtatcagtcagatattggcgtgggtgttgggagtggaaagaccaaacacgaccatactaagctccgtaacaaagctgtgatcattgatgaaaaggagaaaatgatcagcctgctggaagcacaacagtctgagaatgacataaagacacaggtcctcatgtccgagattgaacagttaaagacccaactgcttaacagaaggtcagagcggggccacgaaaaacgcaagaatgaggaaatcgtgagcgacttgatggccagaaacagtgatctgaggaaacataatgacattctaaaggatgagatggaccagatcaaagagaacctcacgatctttaagtctcggaatgcgatttccactaccagcgtacctgctataatgtcgatcgccctgctttcttcctcagttatgccaattatcgcagccgtgagtgatagcccgatgataaacccctggcctcacgctaaaaatcgcgtcggctccgggatgtacaagtatgacgataacgacgaatctggatgccgaccaattagatacggtgtgagctgtatcggcttcgatcacatgctgaagatggacaaatacccctttttcaacgcatttatcgggcataagacattgctcgagtcattcgtggataaaattatcgaaaaggaggacgaaacttgcgagattggaaccaataaagagtttaagtgtttcgaagagagggcctatataaagggcacatgccctcacaacatcaatgctgtccattacctggacaacaaaggtaagttacggtatgttaaatgtaaggaaaatctggagatgaccgaagattgcgccttttgtcgtaaaattaagaagaaagcggggcagagtgtgcaggtacaaaagacgtccgtgccactccaggacgcaatctgccaggataacagcgacatctacactggaccccgcattccttataaaggcatgtgcaagataggccttgtcaaatacaaggagtgtaagtctaaaacatcaagttatgagaccgtgagcttcatcactctgaaggggaaaggaaagatttacatcgaacacttgatgttgaaaaatattgaggttgtgacaaacgtctcctttgtgtgctacgaacacgccggtcaagtagagcaggaggttgaacatagagctctgaagagggtgtctgtcaatgattgtaaaatcgtggactcgagcaagcagaagatatgcaccggcgatcacgtcttctgtgagaaatatgactgctccacgtcatacccagatgtgacctgtatccaggccccggggagtggacccctctatgttaacctgatgggctcttggattaagcctcaatgcgtgggttacgaacgggtacttgtcgagcgagaagtgaaacagccactgttgacacccgagcagaattgtgacacttgcgttagcgagtgtctcgatgaaggggtgcatatcaagtccaccggcttcgagattacatcagcagtcgcttgcagccacggatcttgcatctccgcccatcaggaagcgagtactagcataattgtgccttatccaggcctgttagcctctgtagggggaaaaatcggtctgcacctatcccacacctcagacagtgcaagcgtgcatatgattgttgtctgtcccccgcgcgattcgtgcgctgcccacaactgtctcctgtgctaccatggcatgcttaattatcaatgtcactccacattgtctgctatcctgaccagctttctcctgatacttttcatctacactacgttttcattcattacaaacatcctgtacttgctcagactgttacctaagcagctgaagagtcccattgggtggctaaaactctttatcaattggctgttcaccatacttaggattcggactaagtatttgatgggacgcctgaaccagagaatcggctgggtggagaaccacgacgtggaaaggccacgtcctcgggagcccatgcgaagatttaaaaccacactcatgctgaccatgttaatgatcactggtgggtacgcctgctccaatacagtcgttgcaaactctaagcagacgaggtgtgtgcaagagggcagcaataccaaatgctccgtgactgccacagtaaccctgaaggctggagtcattggcgcggaatcatgtttcgtgatcaaggggccaatggagaaccagcagaaaacaattagcataaagactgttagttctgaaaccgtgtgccgcgagggatccagcttttggacgtcgctttatatcccctcatgtttgtctagtcggagatgccatctcgtcggtgactgcgtgggcaataggtgtcagtcctggcgcgaagatcaactgagccgagagttctctggggttaaagacaaccagattatgaatgagaacaagtgctttgaacagtgtggagcaatcggctgcggttgtttcaatattaaccctagctgcctatacgtgcacgcctatctgaaatccgctcggaatgaggccgtacgtgtcttttcatgtagtgattgggtgcatagagtgagcttcgaagtcaaggggccagacggcgagaccgagctcgttacactgggatctcttggcactaagttcttgaactgggggaccctgtccttatcactcgatgcagaaggaatcacaggcactaatagtctgagctttcttgagtcctctaaaggtgggttcgccctgtacgacgaaggattttcggagataccgagggaaggcttcttgggtgagatccgctgcagctcagagtccgctgccattagtgcacacaagtcttgtatccgggcgcccggcctcattaaatataagcctatgaccgatcaaatcgaatgcacggctagcctggtggacccatttgccatattcctaaaagggtccctgccccagacaagaaacggacagacctttacttcaacaaaggataaaaagaccgtacaggcattcactaccggcgccattagggctctcctgtctatcaatcttgacgatcatgagatcacatttattagcaagatcaaaaactgtgaagccacgttcttgaacgtgagtgggtgctactcctgcgactacggagcacacgtctgtataaagattaaaagctctgagtcagctgatttttatgccgaatccgaggacaagaccactgtgctgagtttacctgttagctcgggcacacaagactactgccaggtgctccacttccagaaaccactggtcgatgagcgactttcttattcctgtggtagcgaacccaagctgatggtgatcaaggggaccctagtttacatgggagtgtatgactttcgcaataaaacaggcggttcaagtactgtcgtaaacccgtctgatgcgtcctggagcattgccaattggttctcaggcctcctggactggctagggggacctctgaaggctatcttaaaaatactcggcttcatcgcaatgggggtggtttgctttattctgttcatgatccttattaagatcgccgtgcggagtgtcaacatgaaaaagaagaattga

SEQ ID NO: 11089 - RNA, 3873 nt, synthetic construct
  misc_feature 1..3873: note = derived and/or modified CDS sequence (opt3) from Campana virus(VP-334K)__KP272041.1__GP
  source 1..3873: mol_type = other RNA
atgctgcacttcatcaccattacaactaagtttctcgccgtggctagcatgtacaaccttctgtattgggaccccaatggcttgtccagattatgcctgtctaacaattcacctctagaggggctcgtctactattgggaaaacctgatgaaagagagtgatttcaagaaagacaagaaaaagcattgtaggataggaacgagcgttgcagccccagtgaccaatgaaacacttactaccctgatcgaggaagtacagaagtccccgtctgagattatcttgcaatgcgagtcgcggaacaatgatacaggtaactcaatttactttgacggcctcgcggatgacatcgaaagccccagtatagtgaattgtgagtccgggaaacgcgaatctgatctgcgagtcctggtgggacagggcctcaagaaagagatcattttaaacgagatcgctgccattgaccgtcaggcaagcctggaagaacaccttagaggtgaaaaggccttgacctccctgctacaggagatctcaaaacaagatgaagctgagaggaagcggctcgagcatgaagttagtagcctgcgccagcagcttatgaatgagagagaagagaacaagaaaaggaagaatatacctgcattcggggtgtcttccactacatcaagcagtctgatgaacatttctcgggtcgtgaccatcggattgctctcccagcaagccattgctaatccaagcctgcccggccaggtaaacacgtggcctcacgccaaaaaccgcatcggccaggggttatatcgaatcgacacttcggatgaagacggatgcagaggtctgaattacggcgttatttgtctcgggtttgatcatcttctgaggatggacttgtatccattctttaacgcgtacgtgtctcacctatccctgctcgaggcatacaccgagaatataatccagaaggacgaaacagagtgcgaaattgagggaggcaaagagttcaagtgttatgaggagcgggcctacatcaaaggtgtctgcccccaccgtataaagtcagctcattatctggatcaaaaggggaaacttcgcattatcaagtgtaaagaaaacctggagttgactgaagactgcacctactgtagaaagatcaaaaaggataggggacacacaaagcaagtgtataaaaccagtgtgcctctccaggacgccatttgccaagataatagcgacgattactccggcccaaagatctcttttaaaggcgtctgcaagattgggatgatagagtataaagagtgtaagtacaagagctcaagtttcgaaacggttggatttatcactattaaagagaagggtaaattctacatcgaagacatgaagctgaaaaacttagaggtgacaaataacgtagcatttatctgccatcagtataccggccaggatgggactacagacgaagagaatcggcacctgaagcgaatgtccgtgaaggattgtaaaaacgtcaatagctctaagtcaaaatactgcaccggagaccacattttctgtcaggtgtatgactgcacgaagagttacccggaggctacctgtttcgttgcccccggcagcggtcctgtgctagtccaagtgatggggtcctggataaaaccacagtgcgtaggctatgaaaaggttctcgtggagcgcgaagtcaaaatgcccatcctgacagaggaaagagattgtgacacttgcgtgtacgagtgtaaggaggatcatattcttatcaagtctaccggatttaacatgatttcggcggtcgcctgcagccacggctcctgcgtgtcagcacatcaggaccctagtacattcttgaatatcgaatatccagggatgtctgctagcgttggaggtgagataggcatccacatttcccatactgatgactcactgagcctccacaaaaagatctactgtcccgccagggattcttgcgaagctcacaactgtattatgtgctaccatgggctgatcaattatcagtgtcacaccgccctttcctacgcagtggtaagttttatgttcgtcagcatagcctatgtgatttttaacgttctgcggttggtgctcgtcgctctgcatgtggtaccgcgcaaattaaagtctcctatcgactggctgattctactcatcaaatgggtgttcctgcttttggcgaaggttataagagcatttctgacacacctcaacaccactatcggatggagggagcgtcaaaataacttcgccgctgatctggaagcccagcggcgacccttacagagatttaagacgacagtcctgcttatgatgatgttgatttccgtggtgtcaagttgcagcaattcggtcgtttccaactctaaacagaccaggtgtatccaaagcggctcaaatactaagtgcagtgtgtccgcaaccattacactcaaagccggtgtgatcggggctgagtcttgtttcgtaataaagggcccaagcgagaaccagcacaaaaccattgtcatccgcactgtgtcctcagaaacaatctgccgggagggaagcagtttttggacgggccatttcaccccttcttgtctgtccagcagaaggtgccacctagttggggactgcgtgggatcgcgctgtcagggttggcgagaagatgtcatttcacgggagtttggcggggtgaaggacaataaccagatgtctgagaataagtgcttcgaacaatgtggagccgcaggctgcggttgtttcaacatcaatcccagttgcctgtacgttcatactattctccgttccgcgagaaacgaggctgtgagggtatttaaatgtaatgattgggtccacaagctgacattccatataaaagggccaaacggcgaagaggaagacgtggtgcttaatagcttgtctaccaagtttctgagctggggaacaatctccttatcactcgacagtgagggcattactgggaccaacagctattctttcctggagtcctcaaaaggaggctttgccatccacgatgaagagttcagtgaaattccccgcgagggttttcttggggaaatccggtgcagctccgagtctgcagtcgtttcggcccacaagagctgtataagagctcctggactgatcaagtacaaaccaatgacggaccaggtggagtgctcagcctccttggtagatccgttcgcaatttttatcaagggcagtctcccccagaccaggtctggttatacattcactagctcccgagacaaacgcaccattcaggcttttaacaatggcgccatcaaggcgctgctaacactgaacctcgatgaccatgaagtgatattctcagagtctgtcattacttgtgaatgcacctttctgaatatcagcgggtgctacagttgtaacttcggagcccaggtgtgcttcaaaatcaagtccagcggcattggggattttgtttcttcatccgagacgggaaatatacttttcagttttcctgtgaaaagcggcacagaagactactgtcagatccagcacttcaactcgccaatggtctctgagtccttgcaatatagctgcggtggggagtcaaagctgttactcattaagggaagtctgatctctgtgggcccctacgattatcggaataaaaccggtggctccagcactgttgtgaaccctgctgaagactcatggagtatttttaattggcttagcgggttcctggattggctaggaggcccactcagagcactggtcaagatcgccttggctataatcggggccctggcattactctttattacaatcatgctggcgaggtccgtaatttctaacacccttagccgtaaaaagaaaaattga

SEQ ID NO: 11090 - RNA, 3594 nt, synthetic construct
  misc_feature 1..3594: note = derived and/or modified CDS sequence (opt3) from RVFV(ZH-548)__DQ380206.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctatttcgggaatccgcgaagtgaagacctcaagccaggagctatatcgagcactcaaagccattatcgcggctgacggtctgaataacataacatgtcacggcaaggatccagaggacaaaatcagtcttattaaggggccgccccataaaaagcgtgtcggaatcgtgagatgcgaaaggcggcgcgatgccaagcaaattggcagagagactatggcaggtatcgccatgaccgttctgcctgctttggcagtgtttgccctcgctccagtcgtgttcgccgaagacccccacctgaggaatcggcctgggaaaggacataactacatagatggcatgacacaggaggacgcgacctgtaagccagtaacttatgcaggcgcctgctcctcttttgatgttctgctcgaaaaagggaagttccccttatttcagagctacgctcaccatcgcacactgcttgaggccgtgcacgacaccattatcgcaaaagctgatcctccatcctgtgacttgctgtcagcccacggaaatccgtgcatgaaggagaagctagtcatgaaaacgcattgtcccaacgattatcagagtgcgcactacctcaataacgacggtaagatggccagcgtgaaatgccctccaaagtatgaactgactgaggactgtaatttctgccgacaaatgaccggcgcatctcttaaaaaggggtcctaccccctgcaggatttgttttgccagtcaagcgaagacgatggaagtaaactcaagacaaagatgaaaggcgtgtgtgaggtcggtgttcaggctctgaagaaatgcgacgggcaattatctactgcccatgaagtggtacctttcgctgtgtttaagaactccaaaaaggtctacctggataagctcgaccttaaaaccgaggagaatctgttgccagatagcttcgtgtgttttgaacacaagggacagtataaaggcacaatggactcgggccagaccaagagagagctaaaatctttcgatatttcccagtgccccaagatcgggggacacggttcaaagaaatgtacgggcgacgccgcattttgcagtgcctacgaatgtactgctcaatatgcgaacgcatactgcagccatgccaatgggtccggaatcgttcagattcaggtgtctggcgtctggaagaaaccgctgtgtgtgggttatgagagggtagttgtgaagcgggaactcagcgctaaacctatacaacgtgtcgagccctgcacaacctgtatcactaagtgcgagccacacgggctggtggtccgctcaacaggcttcaagattagttccgccgtggcatgcgccagcggagtttgtgtgaccggctctcagtcacctagtacggaaatcacccttaaataccccgggataagccagtcctctggaggtgatattggcgtacatatggctcacgacgaccagtcggtcagctccaagatcgtggcccattgcccaccccaagatccttgtctggttcacgactgcatcgtgtgtgcacacgggttgattaactatcagtgccatacagcgctctcagctttcgtcgtggtatttgtgttcagttctatcgccattatatgtctggcaatcttatacagagttctgaaatgcctaaagattgccccaaggaaagtcctcaatccgctgatgtggatcactgcttttatccggtggatttacaagaaaatggtggcccgagtggcagataacataaaccaggtcaatcgcgagatcggatggatggaaggcggtcagcttgttttggggaaccccgctcctattccaagacacgcccccatccctaggtatagcacctacctgatgctcctgcttattgtgtcctatgcgtcagcctgtagcgagctgatccaggcttcttcccggataacaacttgcagtaccgagggcgtgaatacaaagtgtcgcttgagcggaaccgcactcatcagagccggctctgtaggggctgaagcctgcctgatgttaaagggagtcaaagaggaccaaactaagttcctgaaaattaagacggtgtcctcagaactaagttgcagggagggtcagagctactggacaggctcgttttccccaaaatgtctctctagccgtcggtgccatctggttggggaatgtcacgtgaaccgatgcctttcatggagagataatgagaccagtgcagagttctcctttgtcggagaatctactaccatgagggagaacaagtgtttcgaacagtgcggcggttgggggtgtggctgctttaatgtgaaccccagctgtttgttcgttcacacatatctgcaatccgtgcgcaaggaggcgctccgggtatttaattgcatcgactgggtccataaactgaccttagaaattactgatttcgacggatcagtgagcacaatcgatctgggcgccagttcttccagatttacgaactgggggagcgtgtcgctttcattggacgctgagggaatatctggcagtaattccttcagcttcattgagtctccgggtaaggggtacgccatcgtcgatgaaccttttagcgagattccaaggcagggattcctcggcgaaatccgctgtaactccgagtcaagtgttctgagcgcacacgaatcttgcctacgagctcccaatctgatatcctataaacctatgatcgaccagctcgagtgcaccactaacctgattgatccctttgtggtattcgagcggggttcacttccacagacacgtaatgacaagacctttgccgcaagtaaaggcaacagaggggtgcaagccttcagcaagggatccgtccaggctgacttgacactgatgtttgataacttcgaagtggactttgttggcgcggccgtgtcttgtgatgcagctttcttaaatctcactgggtgctactcgtgtaacgccggagccagggtctgcctgagcatcacctcaacgggcaccggttcccttagtgctcataataaggacgggtctctgcacattgtgttgcctagcgagaacggaacaaaagatcagtgtcaaatcctccattttactgttcccgaagtggaggaggagttcatgtactcctgcgacggcgatgagcgcccactgctagtcaagggtaccctgatagcaattgacccgtttgatgaccggagagaagccggcggggagtcaacagtagtgaatcctaaatctggaagctggaacttcttcgattggtttagtggcctcatgtcctggttcgggggacccctgaagactatccttttgatctgtctgtatgttgcgttaagcattggcctctttttcctgcttatctacctgggtaggaccgggctatctaaaatgtggctcgctgccacgaagaaggcatcatga

SEQ ID NO: 11091 - RNA, 3594 nt, synthetic construct
  misc_feature 1..3594: note = derived and/or modified CDS sequence (opt3) from RVFV(ZS-6365)__DQ380205.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctatttcgggaatccgcgaagtgaagacctcaagccaggagctatatcgagcactcaaagccattatcgcggctgacggtctgaataacataacatgtcacggcaaggatccagaggacaaaatcagtcttattaaggggccgccccataaaaagcgtgtcggaatcgtgagatgcgaaaggcggcgcgatgccaagcaaattggcagagagactatggcaggtatcgccatgaccgttctgcctgctttggcagtgtttgccctcgctccagtcgtgttcgccgaagacccccacctgaggaatcggcctgggaaaggacataactacatagatggcatgacacaggaggacgcgacctgtaagccagtaacttatgcaggcgcctgctcctcttttgatgttctgctcgaaaaagggaagttccccttatttcagagctacgctcaccatcgcacactgcttgaggccgtgcacgacaccattatcgcaaaagctgatcctccatcctgtgacttgcagtcagcccacggaaatccgtgcatgaaggagaagctggtcatgaaaacgcattgtcccaacgattatcaaagtgcgcactacctaaataacgacggtaagatggccagcgtgaaatgccctccaaagtatgaactcactgaggactgtaatttctgccgacagatgaccggcgcatctctgaaaaaggggtcctacccccttcaggatctgttttgccagtcaagcgaagacgatggaagtaaattgaagacaaagatgaaaggcgtgtgtgaggtcggtgttcaagctctcaagaaatgcgacgggcagctgtctactgcccatgaagtggtacctttcgctgtgtttaagaactccaaaaaggtctacttagataagctggacctcaaaaccgaggagaatcttctgccagatagcttcgtgtgttttgaacacaagggacagtataaaggcacaatggactcgggccagaccaagagagagttgaaatctttcgatatttcccaatgccccaagatcgggggacacggttcaaagaaatgtacgggcgacgccgcattttgcagtgcctacgaatgtactgctcagtatgcgaacgcatactgcagccatgccaatgggtccggaatcgttcagattcaagtgtctggcgtctggaagaaaccgctatgtgtgggttatgagagggtagttgtgaagcgggaactgagcgctaaacctatacagcgtgtcgagccctgcacaacctgtatcactaagtgcgagccacacgggctcgtggtccgctcaacaggcttcaagattagttccgccgtggcatgcgccagcggagtttgtgtgaccggctctcagtcacctagtacggaaatcaccctgaaataccccgggataagccagtcctctggaggtgatattggcgtacatatggctcacgacgaccaatcggtcagctccaagatcgtggcccattgcccaccccaggatccttgtcttgttcacgggtgcatcgtgtgtgcacacggactgattaactatcagtgccatacagcgttgtcagctttcgtcgtggtatttgtgttcagttctatcgccattatatgtctcgcaatcctgtacagagttttaaaatgcctgaagattgccccaaggaaagtcctaaatccgctcatgtggatcactgcttttatccggtggatttacaagaaaatggtggcccgagtggcagacaacataaaccaggtcaatcgcgagatcggctggatggaaggtgggcaactggttcttggcaaccccgctcctattccaagacacgcccccatccctaggtatagcacctacttgatgctgctcctgattgtgtcctatgcgtcagcctgtagcgagcttatccaggcttcttcccggataacaacttgcagtaccgagggagtgaatacaaagtgtcgcctgagcggcaccgcattgatcagagccgggtctgtaggagctgaagcctgcctcatgctgaagggtgtcaaagaggatcagactaagttcttaaaaattaagacggtgtcctcagaactgagttgcagggagggccagagctactggacagggtcgttttccccaaaatgtctatctagccgtcggtgccatctcgttggagaatgtcacgtgaaccgatgcctgtcatggagagacaatgagaccagtgcagagttctcctttgtcggcgaatctactaccatgagggagaacaagtgtttcgaacaatgcggtgggtggggctgtggatgctttaatgtgaaccccagctgtcttttcgttcacacatatttgcagtccgtgcgcaaggaggcgctgcgggtatttaattgcatcgattgggtccataaactcaccctggaaattactgacttcgatggctcagtgagcacaatcgacttaggggccagttcttccagatttacgaactggggaagcgtgtcgctgtcacttgatgctgagggcatatctggtagtaattccttcagcttcattgagtctccggggaagggatacgccatcgtcgacgaaccttttagcgagattccaaggcagggcttcttgggtgaaatccgctgtaactccgagtcaagtgttctcagcgcacacgaatcttgcctgcgagctcccaatctaatatcctataaacctatgatcgatcagctggagtgcaccactaacctcattgacccctttgtggtattcgagcggggctcactgccacaaacacgtaatgataagacctttgccgcaagtaaagggaacagaggagtgcaggccttcagcaagggctccgtccaggctgaccttacattgatgtttgacaacttcgaagtggattttgttggggcggccgtgtcttgtgacgcagctttcctgaatttaactggatgctactcgtgtaacgccggcgccagggtctgcctcagcatcacctcaacgggtaccgggtccctgagtgctcataataaggatggatctcttcacattgtgctgcctagcgagaacggcacaaaagaccaatgtcagatcttgcattttactgttcccgaagtggaggaggagttcatgtactcctgcgatggtgacgagcgcccactcctggtcaagggcaccctaatagcaattgatccgtttgacgatcggagagaagccgggggagagtcaacagtagtgaatcctaaatctggcagctggaacttcttcgactggtttagtgggctgatgtcctggttcggaggccccctcaagactatcctgcttatctgtttgtatgttgcgctgagcattggtttatttttcctcctgatctaccttgggaggaccggactgtctaaaatgtggctagctgccacgaagaaggcatcatga

SEQ ID NO: 11092 - RNA, 3594 nt, synthetic construct
  misc_feature 1..3594: note = derived and/or modified CDS sequence (opt3) from RVFV(CAR-R1622)__DQ380219.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctatttcgggaatccgcgaagtgaagacctcaagccaggagctatatcgagcactcaaagccattatcgcggctgacggtctgaataacataacatgtcacggcaaggatccagaggacaaaatcagtcttattaaggggccgccccataaaaagcgtgtcggaatcgtgagatgcgaaaggcggcgcgatgccaagcaaattggcagagagactatggcaggtatcgccatgaccgttctgcctgctttggcagtgtttgccctcgctccagtcgtgttcgccgaagacccccacctgaggaatcggcctgggaaaggacataactacatagatggcatgacacaggaggacgcgacctgtaagccagtaacttatgcaggcgcctgctcctcttttgatgttctgctcgaaaaagggaagttccccttatttcagagctacgctcaccatcgcacactgcttgaggccgtgcacgacaccattatcgcaaaagctgatcctccatcctgtgacttgcagtcagcccacggaaatccgtgcatgaaggagaagctggtcatgaaaacgcattgtcccaacgattatcaaagtgcgcactacctaaataacgacggtaagatggccagcgtgaaatgccctccaaagtatgaactcactgaggactgtaatttctgccgacagatgaccggcgcatctctgaaaaaggggtcctacccccttcaggatctgttttgccagtcaagcgaagacgatggaagtaaattgaagacaaagatgaaaggcgtgtgtgaggtcggtgttcaagctctcaagaaatgcgacgggcagctgtctactgcccatgaagtggtacctttcgctgtgtttaagaactccaaaaaggtctacttagataagctggacctcaaaaccgaggagaatcttctgccagatagcttcgtgtgttttgaacacaagggacagtataaaggcacaatggactcgggccagaccaagagagagttgaaatctttcgatatttcccaatgccccaagatcgggggacacggttcaaagaaatgtacgggcgacgccgcattttgcagtgcctacgaatgtactgctcagtatgcgaacgcatactgcagccatgccaatgggtccggaatcgttcagattcaagtgtctggcgtctggaagaaaccgctatgtgtgggttatgagagggtagttgtgaagcgggaactgagcgctaaacctatacagcgtgtcgagccctgcacaacctgtatcactaagtgcgagccacacgggctcgtggtccgctcaacaggcttcaagattagttccgccgtggcatgcgccagcggagtttgtgtgaccggctctcagtcacctagtacggaaatcaccctgaaataccccgggataagccagtcctctggaggtgatattggcgtacatatggctcacgacgaccaatcggtcagctccaagatcgtggcccattgcccaccccaggatccttgtcttgttcacgggtgcatcgtgtgtgcacacggactgattaactatcagtgccatacagcgttgtcagctttcgtcgtggtatttgtgttcagttctatcgccattatatgtctcgcaatcctgtacagagttttaaaatgcctgaagattgccccaaggaaagtcctaaatccgctcatgtggatcactgcttttatccggtgggtgtacaagaaaatggtggcccgagtcgcagacaacattaaccaggttaatcgcgagataggctggatggaaggtgggcaactggtgcttggcaaccccgctcctatcccaagacacgcccccattcctaggtatagcacctacttgatgctgctcctgatcgtgtcctatgcgtcagcctgtagcgagcttattcaggcttcttcccggatcacaacttgcagtaccgagggagtaaatacaaagtgtcgcctgagcggcaccgcattgataagagccgggtctgtcggagctgaagcctgcctcatgctgaagggtgtgaaagaggatcagactaagttcttaaaaatcaagacggtttcctcagaactgagttgcagggagggccagagctactggacagggtcgttttccccaaaatgtctatctagccgtcggtgccatctcgtgggagaatgtcacgtcaaccgatgcctgtcatggagagacaatgagaccagtgcagagttctcctttgtgggcgaatctactaccatgagggagaacaagtgtttcgaacaatgcggtgggtggggctgtggatgctttaatgttaaccccagctgtcttttcgtgcacacatatttgcagtccgtacgcaaggaggcgctgcgggtctttaattgcattgattgggtgcataaactcaccctggaaatcactgacttcgatggctcagtgagcacaattgacttaggggccagttcttccagatttacgaactggggaagcgtctcgctgtcacttgatgctgagggcatctctggtagtaattccttcagcttcatagagtctccggggaagggatacgccattgttgacgaaccttttagcgagatcccaaggcagggcttcttgggtgaaattcgctgtaactccgagtcaagtgtgctcagcgcacacgaatcttgcctgcgagctcccaatctaatctcctataaacctatgatagatcagctggagtgcaccactaacctcatcgacccctttgtagtgttcgagcggggctcactgccacaaacacgtaatgataagacctttgccgcaagtaaagggaacagaggagtccaggccttcagcaagggctccgtgcaggctgaccttacattgatgtttgacaacttcgaagttgattttgtgggggcggccgtctcttgtgacgcagctttcctgaatttaactggatgctactcgtgtaacgccggcgccagggtgtgcctcagcattacctcaacgggtaccgggacactgtccgctcataataaggatggaagtcttcacatcgttctgccttctgagaacggcactaaagaccaatgtcagattttgcattttaccgtgcccgaagtcgaggaggagttcatgtacagctgcgatggtgacgagcgcccactcctggtaaagggcacactaatcgcaatagatccgtttgacgatcggagagaagccgggggagagtccactgtggttaatcctaaatcaggctcttggaacttcttcgactggtttagcgggctgatgagttggttcggaggccccctcaagaccattctgcttatctgtttgtatgtggcgctgtccatcggtttatttttcctcctgatttaccttgggaggacgggactgagcaaaatgtggctagctgccacaaagaaggcatcttga

SEQ ID NO: 11093 - RNA, 3594 nt, synthetic construct
  misc_feature 1..3594: note = derived and/or modified CDS sequence (opt3) from RVFV(2250/74)__DQ380209.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctatttcgggaatccgcgaagtgaagacctcaagccaggagctatatcgagcactcaaagccattatcgcggctgacggtctgaataacataacatgtcacggcaaggatccagaggacaaaatcagtcttattaaggggccgccccataaaaagcgtgtcggaatcgtgagatgcgaaaggcggcgcgatgccaagcaaattggcagagagactatggcaggtatcgccatgaccgttctgcctgctttggcagtgtttgccctcgctccagtcgtgttcgccgaagacccccacctgaggaatcggcctgggaaaggacataactacatagatggcatgacacaggaggacgcgacctgtaagccagtaacttatgcaggcgcctgctcctcttttgatgttctgctcgaaaaagggaagttccccttatttcagagctacgctcaccatcgcacactgcttgaggccgtgcacgacaccattatcgcaaaagctgatcctccatcctgtgacttgcagtcagcccacggaaatccgtgcatgaaggagaagctggtcatgaaaacgcattgtcccaacgattatcaaagtgcgcactacctaaataacgacggtaagatggccagcgtgaaatgccctccaaagtatgaactcactgaggactgtaatttctgccgacagatgaccggcgcatctctgaaaaaggggtcctacccccttcaggatctgttttgccagtcaagcgaagacgatggaagtaaattgaagacaaagatgaaaggcgtgtgtgaggtcggtgttcaagctctcaagaaatgcgacgggcagctgtctactgcccatgaagtggtacctttcgctgtgtttaagaactccaaaaaggtctacttagataagctggacctcaaaaccgaggagaatcttctgccagatagcttcgtgtgttttgaacacaagggacagtataaaggcacaatggactcgggccagaccaagagagagttgaaatctttcgatatttcccaatgccccaagatcgggggacacggttcaaagaaatgtacgggcgacgccgcattttgcagtgcctacgaatgtactgctcagtatgcgaacgcatactgcagccatgccaatgggtccggaatcgttcagattcaagtgtctggcgtctggaagaaaccgctatgtgtgggttatgagagggtagttgtgaagcgggaactgagcgctaaacctatacagcgtgtcgagccctgcacaacctgtatcactaagtgcgagccacacgggctcgtggtccgctcaacaggcttcaagattagttccgccgtggcatgcgccagcggagtttgtgtgaccggctctcagtcacctagtacggaaatcaccctgaaataccccgggataagccagtcctctggaggtgatattggcgtacatatggctcacgacgaccaatcggtcagctccaagatcgtggcccattgcccaccccaggatccttgtcttgttcacgggtgcatcgtgtgtgcacacggactgattaactatcagtgccatacagcgttgtcagctttcgtcgtggtatttgtgttcagttctatcgccattatatgtctcgcaatcctgtacagagttttaaaatgcctgaagattgccccaaggaaagtcctaaatccgctcatgtggatcactgcttttatccggtggatttacaagaaaatggtggcccgagtggcagacaacataaaccaggtcaatcgcgagatcggctggatggaaggtgggcaactggttcttggcaaccccgctcctattccaagacacgcccccatccctaggtatagcacctacttgatgctgctcctgattgtgtcctatgcgtcagcctgtagcgagcttatccaggcttcttcccggataacaacttgcagtaccgagggagtgaatacaaagtgtcgcctgagcggcaccgcattgatcagagccgggtctgtaggagctgaagcctgcctcatgctgaagggtgtcaaagaggatcagactaagttcttaaaaattaagacggtgtcctcagaactgagttgcagggagggccagagctactggacagggtcgttttccccaaaatgtctatctagccgtcggtgccatctcgttggagaatgtcacgtgaaccgatgcctgtcatggagagacaatgagaccagtgcagagttctcctttgtcggcgaatctactaccatgagggagaacaagtgtttcgaacaatgcggtgggtggggctgtggatgctttaatgtgaaccccagctgtcttttcgttcacacatatttgcagtccgtgcgcaaggaggcgctgcgggtatttaattgcatcgattgggtccataaactcaccctggaaattactgacttcgatggctcagtgagcacaatcgacttaggggccagttcttccagatttacgaactggggaagcgtgtcgctgtcacttgatgctgagggcatatctggtagtaattccttcagcttcattgagtctccggggaagggatacgccatcgtcgacgaaccttttagcgagattccaaggcagggcttcttgggtgaaatccgctgtaactccgagtcaagtgttctcagcgcacacgaatcttgcctgcgagctcccaatctaatatcctataaacctatgatcgatcagctggagtgcaccactaacctcattgacccctttgtggtattcgagcggggctcactgccacaaacacgtaatgataagacctttgccgcaagtaaagggaacagaggagtgcaggccttcagcaagggctccgtccaggctgaccttacattgatgtttgacaacttcgaagtggattttgttggggcggccgtgtcttgtgacgcagctttcctgaatttaactggatgctactcgtgtaacgccggcgccaaggtctgcctcagcatcacctcaacgggtaccgggtccctgagtgctcataataaagatggatctcttcacattgtgctgcctagcgagaacggcacaaaggaccaatgtcagatcttgcattttactgttcccgaagtggaggaggagttcatgtactcctgcgatggtgacgagaggccactcctggtcaaaggcaccctaatagcaattgatccgtttgacgatcgccgggaagccgggggagagtcaacagtagtgaatcctaagtctggcagctggaacttcttcgactggtttagtgggctgatgtcctggttcggaggccccctcaaaactatcctgcttatctgtttgtatgttgcgctgagcattggtttatttttcctcctgatctaccttgggagaaccggactgtctaagatgtggctagctgccacgaagaaagcatcatga

SEQ ID NO: 11094 - RNA, 3594 nt, synthetic construct
  misc_feature 1..3594: note = derived and/or modified CDS sequence (opt3) from RVFV(T1)__DQ380201.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctatttcgggaatccgcgaagtgaagacctcaagccaggagctatatcgagcactcaaagccattatcgcggctgacggtctgaataacataacatgtcacggcaaggatccagaggacaaaatcagtcttattaaggggccgccccataaaaagcgtgtcggaatcgtgagatgcgaaaggcggcgcgatgccaagcaaattggcagagagactatggcaggtatcgccatgaccgttctgcctgctttggcagtgtttgccctcgctccagtcgtgttcgccgaagacccccacctgaggaatcggcctgggaaaggacataactacatagatggcatgacacaggaggacgcgacctgtaagccagtaacttatgcaggcgcctgctcctcttttgatgttctgctcgaaaaagggaagttccccttatttcagagctacgctcaccatcgcacactgcttgaggccgtgcacgacaccattatcgcaaaagctgatcctccatcctgtgacttgcagtcagcccacggaaatccgtgcatgaaggagaagctggtcatgaaaacgcattgtcccaacgattatcaaagtgcgcactacctaaataacgacggtaagatggccagcgtgaaatgccctccaaagtatgaactcactgaggactgtaatttctgccgacagatgaccggcgcatctctgaaaaaggggtcctacccccttcaggatctgttttgccagtcaagcgaagacgatggaagtaaattgaagacaaagatgaaaggcgtgtgtgaggtcggtgttcaagctctcaagaaatgcgacgggcagctgtctactgcccatgaagtggtacctttcgctgtgtttaagaactccaaaaaggtctacttagataagctggacctcaaaaccgaggagaatcttctgccagatagcttcgtgtgttttgaacacaagggacagtataaaggcacaatggactcgggccagaccaagagagagttgaaatctttcgatatttcccaatgccccaagatcgggggacacggttcaaagaaatgtacgggcgacgccgcattttgcagtgcctacgaatgtactgctcagtatgcgaacgcatactgcagccatgccaatgggtccggaatcgttcagattcaagtgtctggcgtctggaagaaaccgctatgtgtgggttatgagagggtagttgtgaagcgggaactgagcgctaaacctatacagcgtgtcgagccctgcacaacctgtatcactaagtgcgagccacacgggctcgtggtccgctcaacaggcttcaagattagttccgccgtggcatgcgccagcggagtttgtgtgaccggctctcagtcacctagtacggaaatcaccctgaaataccccgggataagccagtcctctggaggtgatattggcgtacatatggctcacgacgaccaatcggtcagctccaagatcgtggcccattgcccaccccaggatccttgtcttgttcacgggtgcatcgtgtgtgcacacggactgattaactatcagtgccatacagcgttgtcagctttcgtcgtggtatttgtgttcagttctatcgccattatatgtctcgcagttctgtacagagtcttaaaatgcctgaagatcgccccaaggaaagtgctaaatccgctcatgtggattactgcttttatccggtggatctacaagaaaatggtggcccgagtcgcagacaacattaaccaggttaatcgcgagataggctggatggaaggtgggcaactggtgcttggcaaccccgctcctatcccaagacacgcccccattcctaggtatagcacctacttgatgctgctcctgatcgtgtcctatgcgtcagcctgtagcgagcttattcaggcttcttcccggatcacaacttgcagtaccgagggagtaaatacaaagtgtcgcctgagcggcaccgcattgataagagccgggtctgtcggagctgaagcctgcctcatgctgaagggtgtgaaagaggatcagactaagttcttaaaaatcaagacggtttcctcagaactgagttgcagggagggccagagctactggacagggtcgttttccccaaaatgtctatctagccgtcggtgccatctcgtgggagaatgtcacgtcaaccgatgcctgtcatggagagacaatgagaccagtgcagagttctcctttgtgggcgaatctactaccatgagggagaacaagtgtttcgaacaatgcggtgggtggggctgtggatgctttaatgttaaccccagctgtcttttcgtgcacacatatttgcagtccgtacgcaaggaggcgctgcgggtctttaattgcattgattgggtgcataaactcaccctggaaatcactgacttcgatggctcagtgagcacaattgacttaggggccagttcttccagatttacgaactggggaagcgtctcgctgtcacttgatgctgagggcatctctggtagtaattccttcagcttcatagagtctccggggaagggatacgccattgttgacgaaccttttagcgagatcccaaggcagggcttcttgggtgaaattcgctgtaactccgagtcaagtgtgctcagcgcacacgaatcttgcctgcgagctcccaatctaatctcctataaacctatgatagatcagctggagtgcaccactaacctcatcgacccctttgtagtgttcgagcggggctcactgccacaaacacgtaatgataagacctttgccgcaagtaaagggaacagaggagtccaggccttcagcaagggctccgtgcaggctgaccttacattgatgtttgacaacttcgaagttgattttgtgggggcggccgtctcttgtgacgcagctttcctgaatttaactggatgctactcgtgtaacgccggcgccagggtgtgcctcagcattacctcaacgggtaccgggtccctgagtgctcataataaggatggatctcttcacatcgttctgcctagcgagaacggcacaaaagaccaatgtcagattttgcattttactgtgcccgaagtcgaggaggagttcatgtactcctgcgatggtgacgagcgcccactcctggtaaagggcaccctaatcgcaatagatccgtttgacgatcggagagaagccgggggagagtcaacagtggttaatcctaaatctggcagctggaacttcttcgactggtttagtgggctgatgtcctggttcggaggccccctcaagactattctgcttatctgtttgtatgtggcgctgagcatcggtttatttttcctcctgatttaccttgggaggaccggactgtctaaaatgtggctagctgccacgaagaaggcatcatga

SEQ ID NO: 11095 - RNA, 3594 nt, synthetic construct
  misc_feature 1..3594: note = derived and/or modified CDS sequence (opt3) from RVFV(1853/78)__DQ380220.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctatttcgggaatccgcgaagtgaagacctcaagccaggagctatatcgagcactcaaagccattatcgcggctgacggtctgaataacataacatgtcacggcaaggatccagaggacaaaatcagtcttattaaggggccgccccataaaaagcgtgtcggaatcgtgagatgcgaaaggcggcgcgatgccaagcaaattggcagagagactatggcaggtatcgccatgaccgttctgcctgctttggcagtgtttgccctcgctccagtcgtgttcgccgaagacccccacctgaggaatcggcctgggaaaggacataactacatagatggcatgacacaggaggacgcgacctgtaagccagtaacttatgcaggcgcctgctcctcttttgatgttctgctcgaaaaagggaagttccccttatttcagagctacgctcaccatcgcacactgcttgaggccgtgcacgacaccattatcgcaaaagctgatcctccatcctgtgacttgcagtcagcccacggaaatccgtgcatgaaggagaagctggtcatgaaaacgcattgtcccaacgattatcaaagtgcgcactacctaaataacgacggtaagatggccagcgtgaaatgccctccaaagtatgaactcactgaggactgtaatttctgccgacagatgaccggcgcatctctgaaaaaggggtcctacccccttcaggatctgttttgccagtcaagcgaagacgatggaagtaaattgaagacaaagatgaaaggcgtgtgtgaggtcggtgttcaagctctcaagaaatgcgacgggcagctgtctactgcccatgaagtggtacctttcgctgtgtttaagaactccaaaaaggtctacttagataagctggacctcaaaaccgaggagaatcttctgccagatagcttcgtgtgttttgaacacaagggacagtataaaggcacaatggactcgggccagaccaagagagagttgaaatctttcgatatttcccaatgccccaagatcgggggacacggttcaaagaaatgtacgggcgacgccgcattttgcagtgcctacgaatgtactgctcagtatgcgaacgcatactgcagccatgccaatgggtccggagttgtgcagatccaagtctctggcgtgtggaagaaaccgctatgtgtaggttatgagagggttgtggtcaagcgggaactgagcgctaaacctattcagcgtgtggagccctgcacaacctgtataactaagtgcgagccacacgggctcgtcgtgcgctcaacaggcttcaagatcagttccgccgttgcatgcgccagcggagtgtgtgtaaccggctctcagtcacctagtacggaaattaccctgaaataccccgggatcagccagtcctctggaggtgatataggcgtccatatggctcacgacgaccaatcggtgagctccaagattgttgcccattgcccaccccaggatccttgtcttgtgcacgggtgcatcgtctgtgcacacggactgatcaactatcagtgccatacagcgttgtcagctttcgtggtagtgtttgttttcagttctattgccatcatttgtctcgcaatactgtacagagtcttaaaatgcctgaagatcgccccaaggaaagtgctaaatccgctcatgtggattactgcttttatccggtgggtgtacaagaaaatggtcgcccgagttgcagacaacatcaaccaggtgaatcgcgagattggctggatggaaggtgggcaactggtgcttggcaaccccgctcctataccaagacacgcccccatccctaggtatagcacctacttgatgctgctcctgattgtatcctatgcgtcagcctgtagcgagcttatccaggcttcttcccggattacaacttgcagtaccgagggagtcaatacaaagtgtcgcctgagcggcaccgcattgatcagagccgggtctgtgggagctgaagcctgcctcatgctgaagggtgttaaagaggatcagactaagttcttaaaaataaagacggtgtcctcagaactgagttgcagggagggccagagctactggacagggtcgttttccccaaaatgtctatctagccgtcggtgccatctcgtcggagaatgtcacgtgaaccgatgcctgtcatggagagacaatgagaccagtgcagagttctcctttgttggcgaatctactaccatgagggagaacaagtgtttcgaacaatgcggtgggtggggctgtggatgctttaatgtgaaccccagctgtcttttcgtacacacatatttgcagtccgtccgcaaggaggcgctgcgggtgtttaattgcatcgattgggtgcataaactcaccctggaaattactgacttcgatggctcagtcagcacaatcgacttaggggccagttcttccagatttacgaactggggaagcgtttcgctgtcacttgatgctgagggcatttctggtagtaattccttcagcttcatcgagtctccggggaagggatacgccatagtggacgaaccttttagcgagattccaaggcagggcttcttgggtgaaatccgctgtaactccgagtcaagtgtactcagcgcacacgaatcttgcctgcgagctcccaatctaatttcctataaacctatgatcgatcagctggagtgcaccactaacctcatagacccctttgtggtcttcgagcggggctcactgccacaaacacgtaatgataagacctttgccgcaagtaaagggaacagaggagtgcaggccttcagcaagggctccgttcaggctgaccttacattgatgtttgacaacttcgaagtggattttgtcggggcggccgtgtcttgtgacgcagctttcctgaatttaactggatgctactcgtgtaacgccggcgccagggtttgcctcagcatcacctcaacgggtaccgggacactgtccgctcataataaggatggaagtcttcacattgtgctgccttctgagaacggcactaaagaccaatgtcagatcttgcattttaccgtccccgaagtagaggaggagttcatgtacagctgcgatggtgacgagcgcccactcctggtgaagggcacactaattgcaatcgatccgtttgacgatcggagagaagccgggggagagtccactgttgtgaatcctaaatcaggctcttggaacttcttcgactggtttagcgggctgatgagttggttcggaggccccctcaagaccatactgcttatttgtttgtatgtcgcgctgtccatcggtttatttttcctcctgatctaccttgggaggacgggactgagcaaaatgtggctagctgccacaaagaaggcatcttga

SEQ ID NO: 11096 - RNA, 3594 nt, synthetic construct
  misc_feature 1..3594: note = derived and/or modified CDS sequence (opt3) from RVFV(MP-12)__DQ380208.1__GP
  source 1..3594: mol_type = other RNA
atgtacgtgctgctcaccatccttacaagcgtcctggtttgcgaggccattataagagtgtccttgtcttcaactagggaagagacgtgtttcggcgacagtaccaaccccgaaatgatcgagggggcttgggatagcttacgggaagaggagatgcctgaagaactgtcctgctctatttcgggaatccgcgaagtaaagacatcaagccaggagctatatcgagcactcaaagccattatcgcggctgacggtctgaataacataacttgtcacggcaaggatccagaggacaaaatcagtcttattaaggggccgccccataaaaagcgtgtgggaatcgtcagatgcgaaaggcggcgcgatgccaagcaaattggcagagagaccatggcaggtatcgccatgacagtgctgcctgctttggcagtttttgccctcgctccagtggtcttcgccgaagacccccacctgaggaatcggcctgggaaaggacataactacatagatggcatgacccaggaggacgcgacttgtaagccagtgacatatgcaggcgcctgctcctcttttgatgtactgctcgaaaaagggaagttccccttatttcagagctacgctcaccatcgcaccctgcttgaggccgttcacgacacgattatcgcaaaagctgatcctccatcctgtgacttgctgtcagcccacggaaatccgtgcatgaaggagaagctagtgatgaaaactcattgtcccaacgattatcagagtgcgcaccatctcaataacgacggtaagatggccagcgtcaaatgccctccaaagtacgaactgaccgaggactgtaatttctgccgacaaatgacaggcgcatctcttaaaaaggggtcctatcccctgcaggatttgttttgccagtcaagcgaagacgatggaagtaaactcaagactaagatgaaaggcgtgtgtgaggtgggtgtccaggctctgaagaaatgcgacgggcaattatctaccgcccacgaagttgtgcctttcgctgtatttaagaactccaaaaaggtgtacctggataagctcgaccttaaaacagaggagaatctgttgccagatagcttcgtctgttttgaacacaagggacagtacaaaggcaccatggactcgggccagacgaagagagagctaaaatctttcgatatttcccagtgccccaagatcgggggacatggttcaaagaaatgtactggcgacgccgcattttgcagtgcctatgaatgtacagctcaatacgcgaacgcatattgcagccacgccaatgggtccggaatcgtgcagattcaggtttctggcgtgtggaagaaaccgctgtgtgtcggttacgagagggtggtagttaagcgggaactcagcgctaaacctatacaacgtgtggagccctgcaccacttgtatcacaaagtgcgagccacatgggctggtcgtgcgctcaaccggcttcaagattagttccgccgtcgcatgcgccagcggagtgtgtgttacgggctctcagtcacctagtaccgaaatcacacttaaatatcccgggataagccagtcctctggaggtgatattggcgtgcacatggctcatgacgaccagtcggtaagctccaagatcgtcgcccactgcccaccccaagatccttgtctggtgcacgactgcatcgtttgtgcacatgggttgattaactaccagtgccacactgcgctctcagctttcgtggtcgtgtttgtattcagttctatcgccattatatgtctggcaatcttatatagagtgctgaaatgcctaaagattgccccaaggaaagttctcaatccgctgatgtggatcaccgcttttatccggtggatttacaagaaaatggtcgcccgagtggcagataacataaaccaggtgaatcgcgagatcggatggatggaaggcggtcagcttgtcttggggaaccccgctcctattccaagacatgcccccatccctaggtacagcacatatctgatgctcctgcttattgtttcctacgcgtcagcctgtagcgagctgatccaagctagttcccggataactacctgcagtacagagggcgtgaataccaagtgtcgcttgagcggaactgcactcatcagagccggctctgtgggggctgaagcctgcctgatgttaaagggagtaaaagaggaccagacgaagttcctgaaactaaagacagtctcctcagaactcagttgcagggagggtcagagctattggaccggctcgttttccccaaaatgtctgtctagccgtcggtgccaccttgtgggggaatgtcacgttaaccgatgcttgtcatggagagataatgagacttctgcagagttctcctttgtgggagaatctaccacaatgagggagaacaagtgtttcgaacagtgcggcggttgggggtgtggctgctttaatgtcaaccccagctgtctgttcgtgcatacctacctccaatccgttcgcaaggaggcgctgcgggtgtttaattgcattgactgggtacacaaattaactctggaaatcacagatttcgacggatcagtcagcacgattgatcttggcgccagttcttccagatttaccaactgggggagcgtgtcgttgtcactcgacgctgagggaatctctggcagtaattccttcagcttcatagagtctccgggtaaggggtatgccattgtggatgaaccttttagcgagatcccaaggcagggattcctgggcgaaattcgctgtaactccgagtcaagtgtcctaagcgcacatgaatcttgcctgcgagctcccaatctcatctcctacaaacctatgatagaccagctggagtgcactacaaaccttatcgatccctttgttgtgttcgagcggggttcattgccacagacccgtaatgacaagacatttgccgcaagtaaaggcaacagaggggtacaagccttcagcaagggatccgtgcaggctgacctgactttaatgtttgataacttcgaagtcgactttgtgggcgcggccgtttcttgtgatgcagctttcctcaatctgaccgggtgctattcgtgtaacgccggagccagggtgtgccttagcattacgtcaaccggcacaggttccctgagtgctcacaataaggacgggtctttgcatatcgtcctccctagcgagaacggaactaaagatcagtgtcaaattctgcactttaccgtgcccgaagttgaggaggagttcatgtactcctgcgacggcgatgagcgcccactactggtgaagggtacactcatcgcaatagacccgtttgatgaccggagagaagccggcggggagtcaactgtcgtaaatcctaaatctggaagctggaacttcttcgattggtttagtggcctgatgtcctggttcgggggaccccttaagaccattttgctgatctgtttatacgtggcgctcagcatcggcctgtttttccttctgatttatctaggtgggacgggactctctaaaatgtggctggctgccacaaagaaggcatcatga

SEQ ID NO: 11097 - RNA, 3594 nt, synthetic construct
  misc_feature 1..3594: note = derived and/or modified CDS sequence (opt3) from RVFV(ZM-657)__DQ380204.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctatttcgggaatccgcgaagtgaagacctcaagccaggagctatatcgagcactcaaagccattatcgcggctgacggtctgaataacataacatgtcacggcaaggatccagaggacaaaatcagtcttattaaggggccgccccataaaaagcgtgtcggaatcgtgagatgcgaaaggcggcgcgatgccaagcaaattggcagagagactatggcaggtatcgccatgaccgttctgcctgctttggcagtgtttgccctcgctccagtcgtgttcgccgaagacccccacctgaggaatcggcctgggaaaggacataactacatagatggcatgacacaggaggacgcgacctgtaagccagtaacttatgcaggcgcctgctcctcttttgatgttctgctcgaaaaagggaagttccccttatttcagagctacgctcaccatcgcacactgcttgaggccgtgcacgacaccattatcgcaaaagctgatcctccatcctgtgacttgcagtcagcccacggaaatccgtgcatgaaggagaagctggtcatgaaaacgcattgtcccaacgattatcaaagtgcgcactacctaaataacgacggtaagatggccagcgtgaaatgccctccaaagtatgaactcactgaggactgtaatttctgccgacagatgaccggcgcatctctgaaaaaggggtcctacccccttcaggatctgttttgccagtcaagcgaagacgatggaagtaaattgaagacaaagatgaaaggcgtgtgtgaggtcggtgttcaagctctcaagaaatgcgacgggcagctgtctactgcccatgaagtggtacctttcgctgtgtttaagaactccaaaaaggtctacttagataagctggacctcaaaaccgaggagaatcttctgccagatagcttcgtgtgttttgaacacaagggacagtataaaggcacaatggactcgggccagaccaagagagagttgaaatctttcgatatttcccaatgccccaagatcgggggacacggttcaaagaaatgtacgggcgacgccgcattttgcagtgcctacgaatgtactgctcagtatgcgaaggcatactgcagccatgccaacgggtccggaatcgttcagattcaagtgtctggcgtctggaaaaagccgctatgtgtgggttatgagagggtagttgtgaaacgggaactgagcgctaagcctatacagcgtgtcgagccctgcacaacctgtatcactaagtgcgagccacacgggctcgtggtccgctcaacaggcttcaaaattagttccgccgtggcatgcgccagcggagtttgtgtgaccggctctcagtcacctagtacggaaatcaccctgaagtaccccgggataagccagtcctctggaggtgatattggcgtacatatggctcacgacgaccaatcggtcagctccaaaatcgtggcccattgcccaccccaggatccttgtcttgttcacgggtgcatcgtgtgtgcacacggactgattaattatcagtgccatacagcgttgtcagctttcgtcgtggtatttgtgttcagttctatcgccattatatgtctcgcaatcctgtacagagttttaaagtgcctgaaaattgccccaaggaaggtcctaaacccgctcatgtggatcactgcttttatccggtggatttacaaaaagatggtggcccgagtggcagacaatataaaccaggtcaaccgcgagatcggctggatggaaggtgggcaactggttcttggcaatcccgctcctattccaagacacgcccccatccctaggtatagcacctacttgatgctgctcctgattgtgtcctatgcgtcagcctgtagcgagcttatccaggcttcttcccggataacaacttgcagtaccgagggagtgaacacaaagtgtcgcctgagcggcaccgcattgatcagagccgggtctgtaggagctgaagcctgcctcatgctgaaaggtgtcaaggaggatcagactaaattcttaaagattaaaacggtgtcctcagaactgagttgcagggagggccagagctactggacagggtcgttttccccaaagtgtctatctagccgtcggtgccatctcgttggagaatgtcacgtgaatcgatgcctgtcatggagagacaacgagaccagtgcagagttctcctttgtcggcgaatctactaccatgagggagaataagtgtttcgaacaatgcggtgggtggggctgtggatgctttaacgtgaatcccagctgtcttttcgttcacacatatttgcagtccgtgcgcaaagaggcgctgcgggtatttaactgcatcgattgggtccataagctcaccctggaaattactgacttcgatggctcagtgagcacaatcgacttaggggccagttcttccagatttacgaattggggaagcgtgtcgctgtcacttgatgctgagggcatatctggtagtaactccttcagcttcattgagtctccggggaaaggatacgccatcgtcgacgaaccttttagcgagattccaaggcagggcttcttgggtgaaatccgctgtaattccgagtcaagtgttctcagcgcacacgaatcttgcctgcgagctcccaacctaatatcctataagcctatgatcgatcagctggagtgcaccactaatctcattgacccctttgtggtattcgagcggggctcactgccacaaacacgtaacgataaaacctttgccgcaagtaaggggaatagaggagtgcaggccttcagcaagggctccgtccaggctgaccttacattgatgtttgacaacttcgaagtggattttgttggggcggccgtgtcttgtgacgcagctttcctgaacttaactggatgctactcgtgtaatgccggcgccagggtctgcctcagcatcacctcaacgggtaccgggtccctgagtgctcataacaaagatggatctcttcacattgtgctgcctagcgagaatggcacaaaggaccaatgtcagatcttgcattttactgttcccgaagtggaggaggagttcatgtactcctgcgatggtgacgagcgcccactcctggtcaaaggcaccctaatagcaattgatccgtttgacgatcggagagaagccgggggagagtcaacagtagtgaaccctaagtctggcagctggaatttcttcgactggtttagtgggctgatgtcctggttcggaggccccctcaaaactatcctgcttatctgtttgtatgttgcgctgagcattggtttatttttcctcctgatctaccttgggaggaccggactgtctaagatgtggctagctgccacgaagaaagcatcatga

SEQ ID NO: 11098 - RNA, 3594 nt, synthetic construct
  misc_feature 1..3594: note = derived and/or modified CDS sequence (opt3) from RVFV(ZH-501-777)__DQ380202.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctatttcgggaatccgcgaagtgaagacctcaagccaggagctatatcgagcactcaaagccattatcgcggctgacggtctgaataacataacatgtcacggcaaggatccagaggacaaaatcagtcttattaaggggccgccccataaaaagcgtgtcggaatcgtgagatgcgaaaggcggcgcgatgccaagcaaattggcagagagactatggcaggtatcgccatgaccgttctgcctgctttggcagtgtttgccctcgctccagtcgtgttcgccgaagacccccacctgaggaatcggcctgggaaaggacataactacatagatggcatgacacaggaggacgcgacctgtaagccagtaacttatgcaggcgcctgctcctcttttgatgttctgctcgaaaaagggaagttccccttatttcagagctacgctcaccatcgcacactgcttgaggccgtgcacgacaccattatcgcaaaagctgatcctccatcctgtgacttgcagtcagcccacggaaatccgtgcatgaaggagaagctggtcatgaaaacgcattgtcccaacgattatcaaagtgcgcactacctaaataacgacggtaagatggccagcgtgaaatgccctccaaagtatgaactcactgaggactgtaatttctgccgacagatgaccggcgcatctctgaaaaaggggtcctacccccttcaggatctgttttgccagtcaagcgaagacgatggaagtaaattgaagacaaagatgaaaggcgtgtgtgaggtcggtgttcaagctctcaagaaatgcgacgggcagctgtctactgcccatgaagtggtacctttcgctgtgtttaagaactccaaaaaggtctacttagataagctggacctcaaaaccgaggagaatcttctgccagatagcttcgtgtgttttgaacacaagggacagtataaaggcacaatggaccccggccagaccaagagagagttgaaatcgttcgatatttctcaatgcccgaagatcgggggacacggttccaagaaatgtacgggcgacgccgcattttgctcagcctacgaatgtactgctcagtatgcgaacgcatactgcagtcatgccaatgggagcggaatcgttcagattcaagtgtccggcgtctggaagaaacctctatgtgtgggttatgagagggtagttgtgaagcgggaactgtctgctaaacccatacagcgtgtcgagccatgcacaacctgtatcactaagtgcgagcctcacgggctcgtggtccgcagcacaggcttcaagatttcaagtgccgtggcatgcgcctccggagtttgtgtgaccggcagccagtctccctcaacggaaatcaccctgaaatacccagggataagtcagagctccggaggtgatattggcgtacatatggctcacgacgaccaatctgtctcgagcaagatcgtggcccattgtccccctcaggatccatgccttgttcacgggtgcatcgtgtgtgcacacggactgattaactatcagtgccatacagcgttgtccgctttcgtcgtggtatttgtgttctcaagtatcgccattatatgtctcgcagttctgtacagagtcttaaaatgcctgaagatcgccccgaggaaagtgctaaatcccctcatgtggattactgcttttatccggtggatctacaagaaaatggtggcccgagtcgcagacaacattaaccaggttaatcgcgagataggctggatggaaggtgggcaactggtgcttggcaaccctgctccaatccccagacacgcccctattccaaggtattctacctacttgatgctgctcctgatcgtgagctatgcgtccgcctgttcagagcttattcaggctagctctcggatcacaacttgctccaccgagggagtaaatacaaagtgtcgcctgagtggcaccgcattgataagagccgggagcgtcggagctgaagcctgcctcatgctgaagggtgtgaaagaggatcagactaagttcttaaaaatcaagacggtttcttccgaactgtcatgcagggagggccagagttactggacagggagcttttcgcccaaatgtctatcctctcgtcggtgccatctcgtgggagaatgtcacgtcaaccgatgcctgagctggagagacaatgagacctcagcagagttcagttttgtgggcgaatccactaccatgagggagaacaagtgtttcgaacaatgcggtgggtggggctgtggatgctttaatgttaacccgtcttgtcttttcgtgcacacatatttgcagagcgtacgcaaggaggcgctgcgggtctttaattgcattgattgggtgcataaactcaccctggaaatcactgacttcgatggctccgtgtcaacaattgacttaggggccagcagttctagatttacgaactggggatccgtcagcctgtcgcttgatgctgagggcatctcaggttctaatagtttctccttcatagagagccctgggaagggatacgccattgttgacgaaccattttctgagatccccaggcagggcttcttgggtgaaattcgctgtaacagcgagtcctcagtgctcagtgcacacgaaagctgcctgcgagctcctaatctaatctcttataaacccatgatagatcagctggagtgcaccactaacctcatcgacccatttgtagtgttcgagcggggctccctgcctcaaacacgtaatgataagacctttgccgcatcaaaagggaacagaggagtccaggccttcagtaagggcagcgtgcaggctgaccttacattgatgtttgacaacttcgaagttgattttgtgggggcggccgtctcctgtgacgcagctttcctgaatttaactggatgctactcttgtaacgccggcgccagggtgtgcctctcgattaccagcacgggtaccgggtcactgtccgctcataataaggatggaagtcttcacatcgttctgccctctgagaacggcacaaaagaccaatgtcagattttgcattttactgtgccagaagtcgaggaggagttcatgtacagctgcgatggtgacgagcgcccgctcctggtaaagggcaccctaatcgcaatagatccttttgacgatcggagagaagccgggggagagtccacagtggttaatcccaaatcaggctcttggaacttcttcgactggtttagcgggctgatgagttggttcggaggcccactcaagactattctgcttatctgtttgtatgtggcgctgtccatcggtttatttttcctcctgatttaccttgggaggaccggactgagcaaaatgtggctagctgccacgaagaaggcatcttga

SEQ ID NO: 11099 - RNA, 3594 nt, synthetic construct
  misc_feature 1..3594: note = derived and/or modified CDS sequence (opt3) from RVFV(OS-3)__DQ380184.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctatttcgggaatccgcgaagtgaagacctcaagccaggagctatatcgagcactcaaagccattatcgcggctgacggtctgaataacataacatgtcacggcaaggatccagaggacaaaatcagtcttattaaggggccgccccataaaaagcgtgtcggaatcgtgagatgcgaaaggcggcgcgatgccaagcaaattggcagagagactatggcaggtatcgccatgaccgttctgcctgctttggcagtgtttgccctcgctccagtcgtgttcgccgaagacccccacctgaggaatcggcctgggaaaggacataactacatagatggcatgacacaggaggacgcgacctgtaagccagtaacttatgcaggcgcctgctcctcttttgatgttctgctcgaaaaagggaagttccccttatttcagagctacgctcaccatcgcacactgcttgaggccgtgcacgacaccattatcgcaaaagctgatcctccatcctgtgacttgcagtcagcccacggaaatccgtgcatgaaggagaagctggtcatgaaaacgcattgtcccaacgattatcaaagtgcgcactacctaaataacgacggtaagatggccagcgtgaaatgccctccaaagtatgaactcactgaggactgtaatttctgccgacagatgaccggcgcatctctgaaaaaggggtcctacccccttcaggatctgttttgccagtcaagcgaagacgatggaagtaaattgaagacaaagatgaaaggcgtgtgtgaggtcggtgttcaagctctcaagaaatgcgacgggcagctgtctactgcccatgaagtggtacctttcgctgtgtttaagaactccaaaaaggtctacttagataagctggacctcaaaaccgaggagaatcttctgccagatagcttcgtgtgttttgaacacaagggacagtataaaggcacaatggactcgggccagaccaagagagagttgaaatctttcgatatttcccaatgccccaagatcgggggacacggttcaaagaaatgtacgggcgacgccgcattttgcagtgcctacgaatgtactgctcagtatgcgaacgcatactgcagccatgccaatgggtccggagttgtgcagatccaagtctctggcgtgtggaagaaaccgctatgtgtaggttatgagagggttgtggtcaagcgggaactgagcgctaaacctattcagcgtgtggagccctgcacaacctgtataactaagtgcgagccacacgggctcgtcgtgcgctcaacaggcttcaagatcagttccgccgttgcatgcgccagcggagtgtgtgtaaccggctctcagtcacctagtacggaaattaccctgaaataccccgggatcagccagtcctctggaggtgatataggcgtccatatggctcacgacgaccaatcggtgagctccaagattgttgcccattgcccaccccaggatccttgtcttgtgcacgggtgcatcgtctgtgcacacggactgatcaactatcagtgccatacagcgttgtcagctttcgtggtagtgtttgttttcagttctgtcgccattatctgtctcgcaattctgtacaaagtgttaaagtgcctgaaaatagccccaagaaaggtgctaaatccgctcatgtggatcactgcttttattaggtgggtctacaaaaagatggttgcccgggtggcagacaacatcaaccaggtgaatcgagagatcggctggatggaaggtgggcaactggctcttggcaaccccgcccctattccacgccacgcgcccatacctagatatagcacctacttgatgctgctcctgatcgtatcctatgcctcagcttgtagcgagcttattcaggcatcttccaggatcacaacttgcagtaccgagggagtcaatacaaagtgtcggctgagcggcaccgccttgattcgcgctgggtctgtgggagccgaagcatgcctcatgctgaaaggtgttaaggaggatcagactaaattcttaaagatcaaaacggtgtcctcagaactgagttgcagagagggccagagctactggacagggtcgttttccccaaagtgtctatctagcaggcgttgccatctcgtcggagaatgtcacgtgaaccggtgcctgtcatggcgagacaatgagaccagtgcggagttctcctttgttggcgaatctactaccatgagagagaacaagtgtttcgaacaatgcggtgggtggggctgtggatgctttaatgtgaaccccagctgtcttttcgtacacacatatttgcagtccgtcaggaaagaggccctgcgcgtgtttaattgcatagattgggtgcataagctcaccctggaaatcactgacttcgatggctcagtcagcacaattgacttaggggctagttcttcccggtttacgaactggggaagcgtttcgctgtcacttgatgccgagggcatctctggtagtaattccttcagcttcattgagtctccggggaaaggatacgcaatcgtggacgaaccttttagcgagataccaagacagggcttcttgggtgaaattaggtgtaactccgagtcaagtgtactcagcgctcacgaatcttgcctgcgcgcccccaatctaatctcctataagcctatgattgatcagctggagtgcaccactaacctcatcgacccctttgtggtcttcgagcgaggctcactgccacaaacacggaatgataaaacctttgcagccagtaaggggaaccgtggagtgcaggctttcagcaagggctccgttcaggcggaccttacattgatgtttgacaacttcgaagtggattttgtcggggccgcagtgtcttgtgacgctgccttcctgaatttaactggatgctactcgtgtaacgccggcgctagagtttgcctcagcataacctcaacgggtaccgggacactgtccgcacataataaagatggaagtcttcacatcgtgctgccttctgagaacggcactaaggaccaatgtcagattttgcattttaccgtccccgaagtagaggaggagttcatgtacagctgcgatggtgacgagaggccactcctggtgaaaggcacactaatcgccattgatccgtttgacgatcgccgggaagctgggggagagtccactgttgtgaatcctaagtcaggctcttggaacttcttcgactggtttagcgggctgatgagttggttcggaggccccctcaaaaccatcctgcttatatgtttgtatgtcgcgctgtccattggtttatttttcctcctgatctaccttgggagaacgggactgagcaagatgtggctagccgcaacaaagaaagcctcttga

SEQ ID NO: 11100 - RNA, 3594 nt, synthetic construct
  misc_feature 1..3594: note = derived and/or modified CDS sequence (opt3) from RVFV(Sudan 86-2010)__JQ820489.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctgtgtcgggtattcgcgaagtcaagacctcaagccaggagctatatcgagcactcaaagccatcattgcggctgacggactgaataacatcacatgtcacggcaagaatccagaggataaaataagtcttatcaaggggccgccccataaaaagcgtgtgggaattgttagatgcgaaaggcggcgcgacgccaagcaaatcggcagagagactatggcaggtattgccatgaccgtgctgcctgctttggcagtctttgccctcgctccagtggtattcgccgaagatccccacctgaggaaccggcctgggaaaggacataattacatcgacggcatgacacaggaggatgcgacctgtaagccagttacttatgcaggcgcctgctcctcttttgacgtgctgctcgaaaaagggaagttccccttatttcagagctacgctcaccatcgcacactgcttgaggccgtccacgataccataattgcaaaagctgaccctccatcctgtgatttgcagtcagcccacggaaacccgtgcatgaaggagaagctggtgatgaaaacgcattgtcccaatgactatcaaagtgcgcactacctaaacaatgatggtaagatggccagcgtgaaatgccctccaaagtatgaactcactgaggactgtaacttctgccgacagatgaccggcgcatctctgaaaaaggggtcctacccccttcaggacctgttttgccagtcaagcgaagatgacggaagtaaattgaagacaaagatgaaaggcgtctgtgaggttggtgtgcaagctctcaagaaatgcgatgggcagctgtctactgcccatgaagtagtgcctttcgctgtctttaaaaattccaagaaggtgtacttagacaagctggatctcaaaaccgaggagaaccttctgccagacagcttcgtttgttttgaacacaagggacagtataaaggcacaatggattcgggccagaccaagagagagttgaaatctttcgacatctcccaatgccccaagattgggggacacggttcaaagaaatgtacgggcgatgccgcattttgcagtgcctacgaatgtactgctcagtatgcgaatgcatactgcagccatgccaacgggtccggaatcgtgcagatccaagtctctggcgtgtggaagaaaccgctatgtgtaggttatgagagggttgtggtcaagcgggaactgagcgctaaacctattcagcgtgtggagccctgcacaacctgtataactaagtgcgagccacacgggctcgtcgtgcgctcaacaggcttcaagatcagttccgccgttgcatgcgccagcggagtgtgtgtaaccggctctcagtcacctagtacggaaattaccctgaaataccccgggatcagccagtcctctggaggtgacataggcgtccatatggctcacgatgaccaatcggtgagctccaagattgttgcccattgcccaccccaggacccttgtcttgtgcacgggtgcatcgtctgtgcacacggactgatcaattatcagtgccatacagcgttgtcagctttcgtggtagtgtttgttttcagttctattgccatcatttgtctcgcaatactgtacagagtcttaaaatgcctgaagatcgccccaaggaaagtgctaaacccgctcatgtggattactgcttttatccggtgggtgtacaagaaaatggtcgcccgagttgcagataacatcaatcaggtgaaccgcgagattggctggatggaaggtgggcaactggtgcttggcaatcccgctcctataccaagacacgcccccatccctaggtatagcacctacttgatgctgctcctgattgtatcctatgcgtcagcctgtagcgagcttatccaggcttcttcccggattacaacttgcagtaccgagggagtcaacacaaagtgtcgcctgagcggcaccgcattgatcagagccgggtctgtgggagctgaagcctgcctcatgctgaagggtgttaaagaggaccagactaagttcttaaaaataaagacggtgtcctcagaactgagttgcagggagggccagagctactggacagggtcgttttccccaaaatgtctatctagccgtcggtgccatctcgtcggagaatgtcacgtgaatcgatgcctgtcatggagagataacgagaccagtgcagagttctcctttgttggcgaatctactaccatgagggagaataagtgtttcgaacaatgcggtgggtggggctgtggatgctttaacgtgaatcccagctgtcttttcgtacacacatatttgcagtccgtccgcaaggaggcgctgcgggtgtttaactgcatcgactgggtgcataaactcaccctggaaattactgatttcgacggctcagtcagcacaatcgatttaggggccagttcttccagatttacgaattggggaagcgtttcgctgtcacttgacgctgagggcatttctggtagtaactccttcagcttcatcgagtctccggggaagggatacgccatagtggatgaaccttttagcgagattccaaggcagggcttcttgggtgaaatccgctgtaattccgagtcaagtgtactcagcgcacacgaatcttgcctgcgagctcccaacctaatttcctataaacctatgatcgaccagctggagtgcaccactaatctcatagatccctttgtgatcttcgagcggggctcactgccacaaacacgtaacgacaagacctttgccgcaagtaaagggaacagaggagtccaggccttcagcaagggctccgtgcaggctgatcttacattgatgtttgacaatttcgaagttgactttgtgggggcggccgtctcttgtgatgcagctttcctgaacttaactggatgctactcgtgtaatgccggcgccagggtgtgcctcagcattacctcaacgggtaccgggacactgtccgctcataacaaggacggaagtcttcacatcgttctgccttctgagaatggcactaaagatcaatgtcagattttgcattttaccgtgcccgaagtcgaggaggagttcatgtacagctgcgacggtgatgagcgcccactcctggtaaagggcacactaatcgcaatagacccgtttgatgaccggagagaagccgggggagagtccactgtggttaaccctaaatcaggctcttggaatttcttcgattggtttagcgggctgatgagttggttcggaggccccctcaagaccattctgcttatctgtttgtatgtggcgctgtccatcggtttatttttcctcctgatttaccttgggaggacgggactgagcaaaatgtggctagctgccacaaagaaggcatcttga

SEQ ID NO: 11101 - RNA, 3594 nt, synthetic construct
  misc_feature 1..3594: note = derived and/or modified CDS sequence (opt3) from RVFV(T-46 (228113))__DQ380199.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctatttcgggaatccgcgaagtgaagacctcaagccaggagctatatcgagcactcaaagccattatcgcggctgacggtctgaataacataacatgtcacggcaaggatccagaggacaaaatcagtcttattaaggggccgccccataaaaagcgtgtcggaatcgtgagatgcgaaaggcggcgcgatgccaagcaaattggcagagagactatggcaggtatcgccatgaccgttctgcctgctttggcagtgtttgccctcgctccagtcgtgttcgccgaagacccccacctgaggaatcggcctgggaaaggacataactacatagatggcatgacacaggaggacgcgacctgtaagccagtaacttatgcaggcgcctgctcctcttttgatgttctgctcgaaaaagggaagttccccttatttcagagctacgctcaccatcgcacactgcttgaggccgtgcacgacaccattatcgcaaaagctgatcctccatcctgtgacttgcagtcagcccacggaaatccgtgcatgaaggagaagctggtcatgaaaacgcattgtcccaacgattatcaaagtgcgcactacctaaataacgacggtaagatggccagcgtgaaatgccctccaaagtatgaactcactgaggactgtaatttctgccgacagatgaccggcgcatctctgaaaaaggggtcctacccccttcaggatctgttttgccagtcaagcgaagacgatggaagtaaattgaagacaaagatgaaaggcgtgtgtgaggtcggtgttcaagctctcaagaaatgcgacgggcagctgtctactgcccatgaagtggtacctttcgctgtgtttaagaactccaaaaaggtctacttagataagctggacctcaaaaccgaggagaatcttctgccagatagcttcgtgtgttttgaacacaagggacagtataaaggcacaaaggactcgggccagaccaaaagagagttgaagtctttcgatatttcccaatgccccaagatcgggggacacggtagtaaaaagtgtacgggcgacgccgcattttgctcagcctacgaatgtactgctcagtatgcgaacgcatactgcagccatgccaatgggtccggaatcgttcagattcaagtgtctggcgtctggaaaaagccgctatgtgtgggttatgagagggtagttgtgaaacgggaactgagcgctaagcctatacagcgtgtcgagccctgcacaacctgtatcactaagtgcgagccacacgggctcgtggtccgctcaacaggcttcaaaattagttccgccgtggcatgcgccagcggagtttgtgtgaccggctctcagtcacctagtacggaaatcaccctgaagtaccccgggataagccagtcctctggaggtgatattggcgtacatatggctcacgacgaccaatcggtcagctccaaaatcgtggcccattgcccaccccaggatccttgtcttgttcacgggtgcatcgtgtgtgcacacggactgattaactatcagtgccatacagcgttgtcagctttcgtcgtggtatttgtgttcagttctatcgccattatatgtctcgcagttctgtacagagtcttaaagtgcctgaaaatcgccccaaggaaggtgctaaatccgctcatgtggattactgcttttatccggtggatctacaaaaagatggtggcccgagtcgcagacaacattaaccaggttaatcgcgagataggctggatggaaggtgggcaactggtgcttggcaaccccgctcctatcccaagacacgcccccattcctaggtatagcacctacttgatgctgctcctgatcgtgtcctatgcgtcagcctgtagcgagcttattcaggcttcttcccggatcacaacttgcagtaccgagggagtaaatacaaagtgtcgcctgagcggcaccgcattgataagagccgggtctgtcggagctgaagcctgcctcatgctgaaaggtgtgaaggaggatcagactaaattcttaaagatcaaaacggtttcctcagaactgagttgcagggagggccagagctactggacagggtcgttttccccaaagtgtctatctagccgtcggtgccatctcgtgggagaatgtcacgtcaaccgatgcctgtcatggagagacaatgagaccagtgcagagttctcctttgtgggcgaatctactaccatgagggagaacaagtgtttcgaacaatgcggtgggtggggctgtggatgctttaatgttaaccccagctgtcttttcgtgcacacatatttgcagtccgtacgcaaagaggcgctgcgggtctttaattgcattgattgggtgcataagctcaccctggaaatcactgacttcgatggctcagtgagcacaattgacttaggggccagttcttccagatttacgaactggggaagcgtctcgctgtcacttgatgctgagggcatctctggtagtaattccttcagcttcatagagtctccggggaaaggatacgccattgttgacgaaccttttagcgagatcccaaggcagggcttcttgggtgaaattcgctgtaactccgagtcaagtgtgctcagcgcacacgaatcttgcctgcgagctcccaatctaatctcctataagcctatgatagatcagctggagtgcaccactaacctcatcgacccctttgtagtgttcgagcggggctcactgccacaaacacgtaatgataaaacctttgccgcaagtaaggggaacagaggagtccaggccttcagcaagggctccgtgcaggctgaccttacattgatgtttgacaacttcgaagttgattttgtgggggcggccgtctcttgtgacgcagctttcctgaatttaactggatgctactcgtgtaacgccggcgccagggtgtgcctcagcattacctcaacgggtaccgggtccctgagtgctcataataaagatggatctcttcacatcgttctgcctagcgagaacggcacaaaggaccaatgtcagattttgcattttactgtgcccgaagtcgaggaggagttcatgtactcctgcgatggtgacgagcgcccactcctggtaaaaggcaccctaatcgcaatagatccgtttgacgatcggagagaagccgggggagagtcaacagtggttaatcctaagtctggcagctggaacttcttcgactggtttagtgggctgatgtcctggttcggaggccccctcaaaactattctgcttatctgtttgtatgtggcgctgagcatcggtttatttttcctcctgatttaccttgggaggaccggactgtctaagatgtggctagctgccacgaagaaagcatcatga

SEQ ID NO: 11102 - RNA, 3594 nt, synthetic construct
  misc_feature 1..3594: note = derived and/or modified CDS sequence (opt3) from RVFV(2007000094)__EU574055.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctgtgtcgggtattcgcgaagtcaagacctcaagccaggagctatatcgagcactcaaagccatcattgcggctgacggactgaataacatcacatgtcacggcaagaatccagaggataaaataagtcttatcaaggggccgccccataaaaagcgtgtgggaattgttagatgcgaaaggcggcgcgacgccaagcaaatcggcagagagactatggcaggtattgccatgaccgtgctgcctgctttggcagtctttgccctcgctccagtggtattcgccgaagatccccacctgaggaaccggcctgggaaaggacataattacatcgacggcatgacacaggaggatgcgacctgtaagccagttacttatgcaggcgcctgctcctcttttgacgtgctgctcgaaaaagggaagttccccttatttcagagctacgctcaccatcgcacactgcttgaggccgtccacgataccataattgcaaaagctgaccctccatcctgtgatttgcagtcagcccacggaaacccgtgcatgaaggagaagctggtgatgaaaacgcattgtcccaatgactatcaaagtgcgcactacctaaacaatgatggtaagatggccagcgtgaaatgccctccaaagtatgaactcactgaggactgtaacttctgccgacagatgaccggcgcatctctgaaaaaggggtcctacccccttcaggacctgttttgccagtcaagcgaagatgacggaagtaaattgaagacaaagatgaaaggcgtctgtgaggttggtgtgcaagctctcaagaaatgcgatgggcagctgtctactgcccatgaagtagtgcctttcgctgtctttaaaaattccaagaaggtgtacttagacaagctggatctcaaaaccgaggagaaccttctgccagacagcttcgtttgttttgaacacaagggacagtataaaggcacaatggattcgggccagaccaagagagagttgaaatctttcgacatctcccaatgccccaagattgggggacacggttcaaagaaatgtacgggcgatgccgcattttgcagtgcctacgaatgtactgctcagtatgcgaatgcatactgcagccatgccaacgggtccggaatcgtgcagatccaagtctctggcgtgtggaagaaaccgctatgtgtaggttatgagagggttgtggtcaagcgggaactgagcgctaaacctattcagcgtgtggagccctgcacaacctgtataactaagtgcgagccacacgggctcgtcgtgcgctcaacaggcttcaagatcagttccgccgttgcatgcgccagcggagtgtgtgtaaccggctctcagtcacctagtacggaaattaccctgaaataccccgggatcagccagtcctctggaggtgacataggcgtccatatggctcacgatgaccaatcggtgagctccaagattgttgcccattgcccaccccaggacccttgtcttgtgcacgggtgcatcgtctgtgcacacggactgatcaattatcagtgccatacagcgttgtcagctttcgtggtagtgtttgttttcagttctattgccatcatttgtctcgcaatactgtacagagtcttaaaatgcctgaagatcgccccaaggaaagtgctaaacccgctcatgtggattactgcttttatccggtgggtgtacaagaaaatggtcgcccgagttgcagataacatcaatcaggtgaaccgcgagattggctggatggaaggtgggcaactggtgcttggcaatcccgctcctataccaagacacgcccccatccctaggtatagcacctacttgatgctgctcctgattgtatcctatgcgtcagcctgtagcgagcttatccaggcttcttcccggattacaacttgcagtaccgagggagtcaacacaaagtgtcgcctgagcggcaccgcattgatcagagccgggtctgtgggagctgaagcctgcctcatgctgaagggtgttaaagaggaccagactaagttcttaaaaataaagacggtgtcctcagaactgagttgcagggagggccagagctactggacagggtcgttttccccaaaatgtctatctagccgtcggtgccatctcgtcggagaatgtcacgtgaatcgatgcctgtcatggagagataacgagaccagtgcagagttctcctttgttggcgaatctactaccatgagggagaataagtgtttcgaacaatgcggtgggtggggctgtggatgctttaacgtgaatcccagctgtcttttcgtacacacatatttgcagtccgtccgcaaggaggcgctgcgggtgtttaactgcatcgactgggtgcataaactcaccctggaaattactgatttcgacggctcagtcagcacaatcgatttaggggccagttcttccagatttacgaattggggaagcgtttcgctgtcacttgacgctgagggcatttctggtagtaactccttcagcttcatcgagtctccggggaagggatacgccatagtggatgaaccttttagcgagattccaaggcagggcttcttgggtgaaatccgctgtaattccgagtcaagtgtactcagcgcacacgaatcttgcctgcgagctcccaacctaatttcctataaacctatgatcgaccagctggagtgcaccactaatctcatagatccctttgtggtcttcgagcggggctcactgccacaaacacgtaacgacaagacctttgccgcaagtaaagggaacagaggagtgcaggccttcagcaagggctccgttcaggctgatcttacattgatgtttgacaatttcgaagtggactttgtcggggcggccgtgtcttgtgatgcagctttcctgaacttaactggatgctactcgtgtaatgccggcgccagggtttgcctcagcatcacctcaacgggtaccgggacactgtccgctcataacaaggacggaagtcttcacattgtgctgccttctgagaatggcactaaagatcaatgtcagatcttgcattttaccgtccccgaagtagaggaggagttcatgtacagctgcgacggtgatgagcgcccactcctggtgaagggcacactaattgcaatcgacccgtttgatgaccggagagaagccgggggagagtccactgttgtgaaccctaaatcaggctcttggaatttcttcgattggtttagcgggctgatgagttggttcggaggccccctcaagaccatactgcttatttgtttgtatgtcgcgctgtccatcggtttatttttcctcctgatctaccttgggaggacgggactgagcaaaatgtggctagctgccacaaagaaggcatcttga

SEQ ID NO: 11103 - RNA, 3594 nt, synthetic construct
  misc_feature 1..3594: note = derived and/or modified CDS sequence (opt3) from RVFV(ZC-3349)__DQ380207.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctatttcgggaatccgcgaagtgaagacctcaagccaggagctatatcgagcactcaaagccattatcgcggctgacggtctgaataacataacatgtcacggcaaggatccagaggacaaaatcagtcttattaaggggccgccccataaaaagcgtgtcggaatcgtgagatgcgaaaggcggcgcgatgccaagcaaattggcagagagactatggcaggtatcgccatgaccgttctgcctgctttggcagtgtttgccctcgctccagtcgtgttcgccgaagacccccacctgaggaatcggcctgggaaaggacataactacatagatggcatgacacaggaggacgcgacctgtaagccagtaacttatgcaggcgcctgctcctcttttgatgttctgctcgaaaaagggaagttccccttatttcagagctacgctcaccatcgcacactgcttgaggccgtgcacgacaccattatcgcaaaagctgatcctccatcctgtgacttgcagtcagcccacggaaatccgtgcatgaaggagaagctggtcatgaaaacgcattgtcccaacgattatcaaagtgcgcactacctaaataacgacggtaagatggccagcgtgaaatgccctccaaagtatgaactcactgaggactgtaatttctgccgacagatgaccggcgcatctctgaaaaaggggtcctacccccttcaggatctgttttgccagtcaagcgaagacgatggaagtaaattgaagacaaagatgaaaggcgtgtgtgaggtcggtgttcaagctctcaagaaatgcgacgggcagctgtctactgcccatgaagtggtacctttcgctgtgtttaagaactccaaaaaggtctacttagataagctggacctcaaaaccgaggagaatcttctgccagatagcttcgtgtgttttgaacacaagggacagtataaaggcacaatggactcgggccagaccaagagagagttgaaatctttcgatatttcccaatgccccaagatcgggggacacggttcaaagaaatgtacgggcgacgccgcattttgcagtgcctacgaatgtactgctcagtatgcgaacgcatactgcagccatgccaatgggtccggaatcgttcagattcaagtgtctggcgtctggaagaaaccgctatgtgtgggttatgagagggtagttgtgaagcgggaactgagcgctaaacctatacagcgtgtcgagccctgcacaacctgtatcactaagtgcgagccacacgggctcgtggtccgctcaacaggcttcaagattagttccgccgtggcatgcgccagcggagtttgtgtgaccggctctcagtcacctagtacggaaatcaccctgaaataccccgggataagccagtcctctggaggtgatattggcgtacatatggctcacgacgaccaagccgtctcgagcaagatcgtggcacattgcccaccccaggatccttgtcttgttcacgggtgcatcgtgtgtgcgcacggactgattaactatcagtgccatacagctttgtccgccttcgtcgtggtatttgtgttctcaagtatcgcaattatatgtctcgccatcctgtacagagttttaaaatgcctgaagattgctccaaggaaagtcctaaatccgctcatgtggatcactgcctttatccggtggatttacaagaaaatggtggcacgagtggctgacaacataaaccacgtcaatcgcgagatcggctggatggaaggtgggcagctggttcttggcaaccccgcccctattccaagacatgcgcccatccctaggtattctacctacttgatgctgctcctgattgtgagctatgcctccgcttgttcagagcttatccaagcaagctctcggataacaacttgctccaccgagggagtgaatacaaagtgtcgcctgagtggcaccgccttgatcagagctgggagcgtaggagccgaagcatgcctcatgctgaagggtgtcaaagaggatcagactaagttcttaaaaattaagacggtgtcttccgaactgtcatgcagggagggccagagttactggacagggagcttttcgccaaaatgtctatcctctcgtcggtgccacctcgttggagaatgtcacgtgaaccgatgcctgagctggagagacaatgagacctcagcggagttcagttttgtcggcgaatccactaccatgagggagaacaagtgtttcgaacagtgcggtgggtggggctgtggatgctttaatgtgaacccctcttgtcttttcgttcatacatatttgcaaagcgtgcgcaaggaggccctgcgggtatttaattgcatcgattgggtccacaaactcaccctggaaattactgacttcgatggctccgtgtcaacaatcgacttaggggctagcagttctagatttacgaactggggatccgtgagcctgtcgcttgatgccgagggcatatcaggttctaatagtttctccttcattgagagcccggggaagggatacgcaatcgtcgacgaacctttttctgagattccaaggcagggcttcttgggtgaaatccgctgtaacagcgagtcctcagttctcagtgctcatgaaagctgcctgaaagcccccaatctaatatcttataagcctatgatcgatcagctggagtgcaccactaacctcattgacccctttgtggtattcgagcgaggctccctgccacagacacggaatgataaaacctttgcagcctcaaaggggaaccgtggagtgcaagcgttcagtaagggcagcgtccaggcggaccttacattgatgtttgacaacttcgaagtggattttgttggggccgcagtgtcctgtgacgctgccttcctgaatttaactggatgctactcttgtaacgccggcgctagagtctgcctctcgatcaccagcacgggtaccgggtcactgtccgcacacaataaagatggaagtcttcatattgtgctgccttctgagaacggcacaaaggaccagtgtcaaatcttgcactttactgttcccgaagtggaggaggagttcatgtacagctgcgatggtgacgagaggccactcctggtcaaaggcaccctaatagccattgatccgtttgacgatcgccgggaagctgggggagagtccacagtagtgaatcctaagtcaggctcttggaacttcttcgactggtttagcgggctgatgagttggttcggaggccccctcaaaactatcctgcttatctgtttgtatgttgctctgtccattggtttatttttcctcctgatctaccttgggagaaccggactgagcaagatgtggctagccgcaacgaagaaagcctcttga

SEQ ID NO: 11104 - RNA, 3594 nt, synthetic construct
  misc_feature 1..3594: note = derived and/or modified CDS sequence (opt3) from RVFV(2007001602)__EU574043.1__GP
  source 1..3594: mol_type = other RNA
atgtacgtgctgctcaccatccttattagcgtcctggtttgcgaggccgtgataagagtatccatctcttcaacaagggaagagacttgtttcggcgacagtacgaaccccgaaatgattgagggggcttgggatagcttgcgggaagaggagatgcctgaagagttatcctgctctgtgtcgggaatccgcgaagtcaagacctcaagccaggagctgtatcgagcactaaaagccattatcgcggctgacggtctcaataacataacatgtcacggcaagaatccagaggataaaatcagtctgattaaggggccgccccataaaaagcgtgtgggaatcgttagatgcgaaaggcggcgcgacgccaagcaaattggcagagagactatggcaggtatcgccatgaccgtgcttcctgctctggcagtctttgccttggctccagtggtattcgccgaagatccccacctcaggaaccggcctgggaaaggacataattacatagacggcatgacacaggaggatgcgacctgtaagccagttacttatgcaggcgcctgctcctcttttgacgtgctgctggaaaaagggaagttccccctctttcagagctacgctcaccatcgcacattactggaggccgtccacgataccattatcgcaaaagctgaccctccatcctgtgatcttcagtcagcccacggaaacccgtgcatgaaggagaagttggtgatgaaaacgcattgtcccaatgactatcaaagtgcgcactacctgaacaatgatggtaagatggccagcgtgaaatgccctccaaagtatgaactaactgaggactgtaacttctgccgacagatgaccggcgcatctctcaaaaaggggtcctaccccctgcaggaccttttctgccagtcaagcgaagatgacggaagtaaactgaagacaaagatgaaaggcgtctgtgaggttggtgtgcaagcgttgaagaaatgcgatgggcagctctctactgcccatgaagtagtgcctttcgctgtctttaagaatagtaaaaaggtgtacctggacaagttagatctgaaaaccgaggagaacctccttccagacagcttcgtttgttttgaacacaagggacagtataaaggcacaatggattcgggccagaccaagagagagctgaaatctttcgacatttcccaatgccccaagatcgggggacacggttcaaagaaatgtacgggcgatgccgcattttgcagtgcctacgaatgtactgctcagtatgcgaatgcatactgcagccatgccaacgggtccggaatcgtgcagattcaagtctctggcgtgtggaagaaaccgttgtgtgtaggttatgagagggttgtggtcaagcgggaactaagcgctaaacctatacagcgtgtggagccctgcacaacctgtatcactaagtgcgagccacacgggctggtcgtgcgctcaacaggcttcaagattagttccgccgttgcatgcgccagcggagtgtgtgtaaccggctctcagtcacctagtacggaaatcaccctcaaataccccgggataagccagtcctctggaggtgacattggcgtccatatggctcacgatgaccaatcggtgagctccaagatcgttgcccattgcccaccccaggacccttgtctggtgcacgggtgcatcgtctgtgcacacggacttattaattatcagtgccatacagcgctgtcagctttcgtggtaatctttgtgttcagttctactgccattatatgtttggcagttctctacagagtcctgaaatgcttaaagatcgccccaaggaaagtgctgaacccgctaatgtggattaccgcttttatccggtgggtgtacaagaaaatggtcgcccgagttgcagataacatcaatcaggtgaaccgcgagattggctggatggaaggtgggcaactcgctctgggcaatcccgcccctataccaagacacgcgcccatccctaggtatagcacataccttatgttgctgctcattgtgtcctatgcctcagcttgtagcgagctgatccaggcatcttcccggattactacctgcagtacagagggagtaaacaccaagtgtcgccttagcggcactgccctgatcagagctgggtctgtcggagccgaagcatgcttgatgctcaagggtgtgaaagaggaccagacgaagttcctgaaaataaagacagtttcctcagaattaagttgcagggagggccagagctactggaccgggtcgttttccccaaaatgtctgtctagccgtcggtgccatctagtgggagaatgtcacgtcaatcgatgcctctcatggagagataacgagacttccgcggagttctcctttgtgggcgaatctaccacaatgagggagaataagtgtttcgaacaatgcggtgggtggggctgtggatgctttaacgttaatcccagctgtctgttcgtgcacacctatcttcagtccgtacgcaaggaggccttgcgggtctttaactgcatcgactgggtgcataaactgactctcgaaattacagatttcgacggctcagtgagcacgatcgatctgggggctagttcttccagatttaccaattggggaagcgtctcgttatcactggacgccgagggcatttctggtagtaactccttcagcttcatcgagtctccggggaagggatacgcaatagttgatgaaccttttagcgagattccaaggcagggcttccttggtgaaatccgctgtaattccgagtcaagtgtgttgagcgctcacgaatcttgcctccgagcccccaacctggtatcctataaacctatgattgaccagctagagtgcactacaaatctgatcgatccctttgtggtcttcgagcggggctcactcccacaaacccgtaacgacaagacatttgcagccagtaaagggaacagaggagtgcaggctttcagcaagggctccgttcaggcggatctgactcttatgtttgacaatttcgaagtggactttgtcggggccgcagtgtcttgtgatgctgccttcttgaacctgaccggatgctactcgtgtaatgccggcgctagggtttgcttaagcataacgtcaaccggtacagggactctctccgcacataacaaggacggaagtctgcacatcgtgcttccttctgagaatggcaccaaagatcaatgtcagattctgcattttacagtccccgaagtagaggaggaatttatgtacagctgcgacggtgatgagcgcccattgctcgtgaagggcactctgatcgccattgacccgtttgatgaccggagagaagctgggggagagtccaccgttgtgaaccctaaatcaggctcttggaatttcttcgattggtttagcgggctaatgagttggttcggaggccccctgaagacgatcctcctgatatgtctttatgtcgctttgtccattggtctgtttttcttactcatctacctggggaggacaggacttagcaaaatgtggctggccgcaaccaagaaggcctcttga

SEQ ID NO: 11105 - RNA, 3594 nt, synthetic construct
  misc_feature 1..3594: note = derived and/or modified CDS sequence (opt3) from RVFV(1260/78)__DQ380214.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaggaactgtcctgctctatttcgggaatccgcgaagtgaagacctcaagccaggagctatatcgagcactcaaagccattatcgcggctgacggtctgaataacataacatgtcacggcaaggatccagaggacaaaatcagtcttattaaggggccgccccataaaaagcgtgtcggaatcgtgagatgcgaaaggcggcgcgatgccaagcaaattggcagagagactatggcaggtatcgccatgaccgttctgcctgctttggcagtgtttgccctcgctccagtcgtgttcgccgaagacccccacctgaggaatcggcctgggaaaggacataactacatagatggcatgacacaggaggacgcgacctgtaagccagtaacttatgcaggcgcctgctcctcttttgatgttctgctcgaaaaagggaagttccccttatttcagagctacgctcaccatcgcacactgcttgaggccgtgcacgacaccattatcgcaaaagctgatcctccatcctgtgacttgcagtcagcccacggaaatccgtgcatgaaggagaagctggtcatgaaaacgcattgtcccaacgattatcaaagtgcgcactacctaaataacgacggtaagatggccagcgtgaaatgccctccaaagtatgaactcactgaggactgtaatttctgccgacagatgaccggcgcatctctgaaaaaggggtcctacccccttcaggatctgttttgccagtcaagcgaagacgatggaagtaaattgaagacaaagatgaaaggcgtgtgtgaggtcggtgttcaagctctcaagaaatgcgacgggcagctgtctactgcccatgaagtggtacctttcgctgtgtttaagaactccaaaaaggtctacttagataagctggacctcaaaaccgaggagaatcttctgccagatagcttcgtgtgttttgaacacaagggacagtataaaggcacaatggactcgggccagaccaagagagagttgaaatctttcgatatttcccaatgccccaagatcgggggacacggttcaaagaaatgtacgggcgacgccgcattttgcagtgcctacgaatgtactgctcagtatgcgaacgcatactgcagccatgccaatgggtccggaatcgttcagattcaagtgtctggcgtctggaagaaaccgctatgtgtgggttatgagagggtagttgtgaagcgggaactgagcgctaaacctatacagcgtgtcgagccctgcacaacctgtatcactaagtgcgagccacacgggctcgtggtccgctcaacaggcttcaagattagttccgccgtggcatgcgccagcggagtttgtgtgaccggctctcagtcacctagtacggaaatcaccctgaaataccccgggataagccagtcctctggaggtgatattggcgtacatatggctcacgacgaccaatcggtcagctccaagatcgtggcccattgcccaccccaggatccttgtcttgttcacgggtgcatcgtgtgtgcacacggactgattaactatcagtgccatacagcgttgtcagctttcgtcgtggtatttgtgttcagttctatcgccattatatgtctcgcaatcctgcacagagttttaaaatgcctgaagattgccccaaggaaagtcctaaatccgctcatgtggatcactgcttttatccggtgggtgtacaagaaaatggtggcccgagtcgcagacaacattaaccaggttaatcgcgagataggctggatggaaggtgggcaactggtgcttggcaaccccgctcctatcccaagacatgcccccattcctaggtacagcacctatttgatgctgctcctgatcgtgtcctacgcgtcagcctgtagcgagcttattcaggcttcttcccggatcacaacttgcagtaccgagggagtaaatacaaagtgtcgcctgagcggcaccgcattgataagagccgggtctgtcggagctgaagcctgcctcatgctgaagggtgtgaaagatgaccagactaagttcttaaaaatcaagacggtttcctcagagctgagttgcagggaaggccagagctattggacagggtcgttttccccaaaatgtctatctagccgtcggtgccacctcgtgggagagtgtcacgtcaaccgatgcctgtcatggagagataatgaaaccagtgcagagttctcctttgtgggcgagtctactaccatgagggaaaacaagtgtttcgagcaatgcggtgggtggggctgtggatgctttaatgttaaccccagctgtcttttcgtgcatacatacttgcagtccgtacgcaaggaagcgctgcgggtctttaattgcattgactgggtgcacaaactcaccctggagatcactgatttcgacggctcagtgagcacaattgatttaggggccagttcttccagatttacgaactggggaagcgtctcgctgtcacttgacgctgaaggcatctctggtagtaattccttcagcttcatagagtctccggggaagggatatgccattgttgatgagccttttagcgaaatcccaaggcagggcttcttgggtgagattcgctgtaactccgaatcaagtgtgctcagcgcacatgagtcttgcctgcgagctcccaatctaatctcctacaaacctatgatagaccagctggaatgcaccactaacctcatcgatccctttgtagtgttcgagcggggctcactgccacaaacacgtaatgacaagacctttgccgcaagtaaagggaacagaggagtccaggccttcagcaagggctccgtgcaggctgaccttacattgatgtttgataacttcgaggttgactttgtgggggcggccgtctcttgtgatgcagctttcctgaatttaactggatgctattcgtgtaacgccggcgccagggtgtgcctcagcattacctcaacgggtaccgggacactgtccgctcacaataaggacggaagtcttcatatcgttctgccttctgaaaacggcactaaagatcaatgtcagattttgcactttaccgtgcccgaggtcgaagaggagttcatgtacagctgcgacggtgatgaacgcccactcctggtaaagggcacactaatcgcaatagacccgtttgatgaccggagagaggccgggggagaatccactgtggttaatcctaaatcaggctcttggaacttcttcgattggtttagcgggctgatgagttggttcggaggccccctcaagaccattctgcttatctgtttgtacgtggcgctgtccatcggtttatttttcctcctgatttatcttgggaggacgggactgagcaaaatgtggctagctgccacaaagaaggcatcttga

SEQ ID NO: 11106 - RNA, 3594 nt, synthetic construct
  misc_feature 1..3594: note = derived and/or modified CDS sequence (opt3) from RVFV(2007000324)__JF326195.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctgtgtcggggattcgcgaagtcaagacctcaagccaggagctatatcgagcactcaaagccatcattgcggctgacggtctgaataacatcacatgtcacggcaagaatccagaggataaaataagtcttatcaaggggccgccccataaaaagcgtgtgggaattgttagatgcgaaaggcggcgcgacgccaagcaaatcggcagagagactatggcaggtattgccatgaccgtgctgcctgctttggcagtctttgccctcgctccagtggtattcgccgaagatccccacctgaggaaccggcctgggaaaggacataattacatcgacggcatgacacaggaggatgcgacctgtaagccagttacttatgcaggcgcctgctcctcttttgacgtgctgctcgaaaaagggaagttccccttatttcagagctacgctcaccatcgcacactgcttgaggccgtccacgataccataattgcaaaagctgaccctccatcctgtgatttgcagtcagcccacggaaacccgtgcatgaaggagaagctggtgatgaaaacgcattgtcccaatgactatcaaagtgcgcactacctaaacaatgatggtaagatggccagcgtgaaatgccctccaaagtatgaactcactgaggactgtaacttctgccgacagatgaccggcgcatctctgaaaaaggggtcctacccccttcaggacctgttttgccagtcaagcgaagatgacggaagtaaattgaagacaaagatgaaaggcgtctgtgaggttggtgtgcaagctctcaagaaatgcgatgggcagctgtctactgcccatgaagtagtgcctttcgctgtctttaagaatagtaaaaaggtgtacttagacaagctggatctcaaaaccgaggagaaccttctgccagacagcttcgtttgttttgaacacaagggacagtataaaggcacaatggattcgggccagaccaagagagagttgaaatctttcgacatctcccaatgccccaagattgggggacacggttcaaagaaatgtacgggcgatgccgcattttgcagtgcctacgaatgtactgctcagtatgcgaatgcatactgcagccatgccaacgggtccggaatcgtgcagatccaagtctctggcgtgtggaagaaaccgctatgtgtaggttatgagagggttgtggtcaagcgggaactgagcgctaaacctattcagcgtgtggagccctgcacaacctgtataactaagtgcgagccacacgggctcgtcgtgcgctcaacaggcttcaagatcagttccgccgttgcatgcgccagcggagtgtgtgtaaccggctctcagtcacctagtacggaaattaccctgaaataccccgggatcagccagtcctctggaggtgacataggcgtccatatggctcacgatgaccaatcggtgagctccaagattgttgcccattgcccaccccaggacccttgtcttgtgcacgggtgcatcgtctgtgcacacggactgatcaattatcagtgccatacagcgttgtcagctttcgtggtaatttttgtgttcagttctactgccatcatttgtctcgcagttctgtacagagtcttaaaatgcctgaagatagccccaaggaaagtgctaaacccgctcatgtggatcaccgcttttattcggtgggtgtacaagaaaatggtcgcccgagttgcagataacatcaatcaggtgaaccgcgagatcggctggatggaaggtgggcaactggctcttggcaatcccgcccctattccaagacacgcgcccatacctaggtatagcacatacttgatgctgctcctgatcgtgtcctatgcctcagcttgtagcgagcttattcaggcatcttcccggatcactacctgcagtacagagggagtaaacaccaagtgtcgcctgagcggcactgccttgattagagctgggtctgtcggagccgaagcatgcctcatgctgaagggtgtgaaagaggaccagacgaagttcttaaaaatcaagacagtttcctcagaactgagttgcagggagggccagagctactggaccgggtcgttttccccaaaatgtctatctagccgtcggtgccatctcgtgggagaatgtcacgtcaatcgatgcctgtcatggagagataacgagacttccgcggagttctcctttgtgggcgaatctaccacaatgagggagaataagtgtttcgaacaatgcggtgggtggggctgtggatgctttaacgttaatcccagctgtcttttcgtgcacacctatttgcagtccgtacgcaaggaggccctgcgggtctttaactgcatagactgggtgcataaactcactctggaaatcacagatttcgacggctcagtgagcacgattgatttaggggctagttcttccagatttaccaattggggaagcgtctcgctgtcacttgacgccgagggcatctctggtagtaactccttcagcttcattgagtctccggggaagggatacgcaatcgttgatgaaccttttagcgagataccaaggcagggcttcttgggtgaaattcgctgtaattccgagtcaagtgtgctcagcgctcacgaatcttgcctgcgagcccccaacctagtatcctataaacctatgatcgaccagctggagtgcactacaaatctcattgatccctttgtggtcttcgagcggggctcactgccacaaacccgtaacgacaagacatttgcagccagtaaagggaacagaggagtgcaggctttcagcaagggctccgttcaggcggatcttactttgatgtttgacaatttcgaagtggactttgtcggggccgcagtgtcttgtgatgctgccttcctgaacttaaccggatgctactcgtgtaatgccggcgctagggtttgcctcagcatcacgtcaaccggtacagggactctgtccgcacataacaaggacggaagtcttcacatagtgctgccttctgagaatggcaccaaagatcaatgtcagatcttgcattttacagtccccgaagtagaggaggagttcatgtacagctgcgacggtgatgagcgcccactcctggtgaagggcactctaattgccatcgacccgtttgatgaccggagagaagcgggaggagagtccaccgttgtgaaccctaaatcaggctcttggaatttcttcgattggtttagcgggctgatgagttggttcggaggccccctcaagacgattctgcttatctgtttgtatgtcgctctgtccataggtttatttttcctcctgatttaccttgggaggacaggactgagcaaaatgtggctagccgcaaccaagaaggcctcttga

SEQ ID NO: 11107 - RNA, 3594 nt, synthetic construct
  misc_feature 1..3594: note = derived and/or modified CDS sequence (opt3) from RVFV(KEN/Gar-Msq/131B-04/06)__HM586972.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagctttcgggaagaggagatgcctgaagagttatcctgctctgtgtcggggattcgcgaagtcaagacctcaagccaggagctgtatcgagcactaaaagccatcattgcggctgacggtctcaataacatcacatgtcacggcaagaatccagaggataaaataagtctgatcaaggggccgccccataaaaagcgtgtgggaattgttagatgcgaaaggcggcgcgacgccaagcaaatcggcagagagactatggcaggtattgccatgaccgtgcttcctgctctggcagtcttcgccttggctccagtggtatttgccgaagatccccacctcaggaaccggcctgggaaaggacataattacatcgacggcatgacacaggaggatgcgacctgtaagccagttacttatgcaggcgcctgctcctctttcgacgtgctgctggaaaaagggaagtttcccctcttccagagctacgctcaccatcgcacattactggaggccgtccacgataccataattgcaaaagctgaccctccatcctgtgatcttcagtcagcccacggaaacccgtgcatgaaggagaagttggtgatgaaaacgcattgtcccaatgactatcaaagtgcgcactacctgaacaatgatggtaagatggccagcgtgaaatgccctccaaagtatgaactaactgaggactgtaacttttgccgacagatgaccggcgcatctctcaaaaaggggtcctaccccctgcaggaccttttctgccagtcaagcgaagatgacggaagtaaactgaagacaaagatgaaaggcgtctgtgaggttggtgtgcaggctttgaagaaatgcgatgggcaactctctactgcccatgaagtagtgccttttgctgtcttcaagaatagtaaaaaggtgtacctggacaagttagatctgaaaaccgaggagaacctccttccagacagctttgtttgtttcgaacacaagggacagtataaaggcacaatggattcgggccagaccaagagagagctgaaatcttttgacatctcccaatgccccaagattgggggacacggttcaaagaaatgtacgggcgatgccgcattctgcagtgcctacgaatgtactgctcagtatgcgaatgcatactgcagccatgccaacgggtccggaatcgtgcagatccaagtctctggcgtgtggaagaaaccgttgtgtgtaggttatgagagggttgtggtcaagcgggaactaagcgctaaacctattcagcgtgtggagccctgcacaacctgtataactaagtgcgagccacacgggctggtcgtgcgctcaacaggcttcaagatcagttccgccgttgcatgcgccagcggagtgtgtgtaaccggctctcagtcacctagtacggaaattaccctcaaataccccgggatcagccagtcctctggaggtgacataggcgtccatatggctcacgatgaccaatcggtgagctccaagattgttgcccattgcccaccccaggacccttgtctggtgcacgggtgcatcgtctgtgcacacggacttatcaattatcagtgccatacagcgctgtcagcttttgtggtaattttcgtgtttagttctactgccatcatttgtttggcagttctctacagagtcctgaaatgcttaaagatagccccaaggaaagtgctgaacccgctaatgtggatcaccgctttcattcggtgggtgtacaagaaaatggtcgcccgagttgcagataacatcaatcaggtgaaccgcgagatcggctggatggaaggtgggcaactcgctctgggcaatcccgcccctattccaagacacgcgcccatacctaggtatagcacataccttatgttgctgctcatcgtgtcctatgcctcagcttgtagcgagctgattcaggcatcttcccggatcactacctgcagtacagagggagtaaacaccaagtgtcgccttagcggcactgccctgattagagctgggtctgtcggagccgaagcatgcttgatgctcaagggtgtgaaagaggaccagacgaagtttctgaaaatcaagacagtttcctcagaattaagttgcagggagggccagagctactggaccgggtcgttctccccaaaatgtctgtctagccgtcggtgccatctagtgggagaatgtcacgtcaatcgatgcctctcatggagagataacgagacttccgcggagttttccttcgtgggcgaatctaccacaatgagggagaataagtgttttgaacaatgcggtgggtggggctgtggatgcttcaacgttaatcccagctgtctgtttgtgcacacctatcttcagtccgtacgcaaggaggccttgcgggtcttcaactgcatagactgggtgcataaactgactctcgaaatcacagattttgacggctcagtgagcacgattgatctgggggctagttcttccagattcaccaattggggaagcgtctcgttatcactggacgccgagggcatctctggtagtaactccttcagctttattgagtctccggggaagggatacgcaatcgttgatgaacctttcagcgagataccaaggcagggctttcttggtgaaattcgctgtaattccgagtcaagtgtgttgagcgctcacgaatcttgcctccgagcccccaacctggtatcctataaacctatgatcgaccagctagagtgcactacaaatctgattgatcccttcgtggtctttgagcggggctcactcccacaaacccgtaacgacaagacattcgcagccagtaaagggaacagaggagtgcaggcttttagcaagggctccgttcaggcggatctgactcttatgttcgacaattttgaagtggacttcgtcggggccgcagtgtcttgtgatgctgcctttttgaacctgaccggatgctactcgtgtaatgccggcgctagggtttgcttaagcatcacgtcaaccggtacagggactctctccgcacataacaaggacggaagtctgcacatagtgcttccttctgagaatggcaccaaagatcaatgtcagatcctgcatttcacagtccccgaagtagaggaggaatttatgtacagctgcgacggtgatgagcgcccattgctcgtgaagggcactctgattgccatcgacccgttcgatgaccggagagaagcgggaggagagtccaccgttgtgaaccctaaatcaggctcttggaatttctttgattggttcagcgggctaatgagttggtttggaggccccctgaagacgattctcctgatctgtctttatgtcgctttgtccataggtctgttctttttactcatttacctggggaggacaggacttagcaaaatgtggctggccgcaaccaagaaggcctcttga

SEQ ID NO: 11108 - RNA, 3594 nt, synthetic construct
  misc_feature 1..3594: note = derived and/or modified CDS sequence (opt3) from RVFV(2007004194)__EU574031.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctgtgtcgggtattcgcgaagtcaagacctcaagccaggagctatatcgagcactcaaagccatcattgcggctgacggactgaataacatcacatgtcacggcaagaatccagaggataaaataagtcttatcaaggggccgccccataaaaagcgtgtgggaattgttagatgcgaaaggcggcgcgacgccaagcaaatcggcagagagactatggcaggtattgccatgaccgtgctgcctgctttggcagtctttgccctcgctccagtggtattcgccgaagatccccacctgaggaaccggcctgggaaaggacataattacatcgacggcatgacacaggaggatgcgacctgtaagccagttacttatgcaggcgcctgctcctcttttgacgtgctgctcgaaaaagggaagttccccttatttcagagctacgctcaccatcgcacactgcttgaggccgtccacgataccataattgcaaaagctgaccctccatcctgtgatttgcagtcagcccacggaaacccgtgcatgaaggagaagctggtgatgaaaacgcattgtcccaatgactatcaaagtgcgcactacctaagcaacgatggtaagatggcctctgtgaaatgccctccaaagtatgaactcactgaggactgtaatttctgccgacagatgaccggcgcatccctgaaaaaggggtcatacccccttcaggacctgttttgccagagcagtgaagatgacggatctaaattgaagacaaagatgaaaggcgtctgtgaggttggtgtgcaagctctcaagaaatgcgatgggcagctgtccactgcccatgaagtagtgcctttcgctgtctttaagaacagcaaaaaggtgtacttagacaagctggatctcaaaaccgaggagaatcttctgccagactcgttcgtttgttttgaacacaagggacagtataaaggcacaatggattctggccagaccaagagagagttgaaatccttcgacatctcacaatgccccaagattgggggacacggtagtaagaaatgtacgggcgatgccgcattttgcagcgcctacgaatgtactgctcagtatgcgaacgcatactgctcccatgccaatgggtctggaatcgtgcagatccaagtcagcggcgtgtggaagaaaccgctatgtgtaggttatgagagggttgtggtcaagcgggaactgtcagctaaacctattcagcgtgtggagccctgcacaacctgtataactaagtgcgagccacacgggctcgtcgtgcgcagtacaggcttcaagatctccagcgccgttgcatgcgcctctggagtgtgtgtaaccggctcacagagtcctagcacggaaattaccctgaaataccccgggatctcccagtcttcgggaggtgacataggcgtccatatggctcacgatgaccaaagcgtgtcctcaaagattgttgcccattgcccaccccaggacccttgtcttgtgcacgggtgcatcgtctgtgcacacggactgatcaactatcagtgccatacagcgttgagtgctttcgtggtagtgtttgttttctctagcattgccatcatttgtctcgcaatactgtacagagtcttaaaatgcctgaagatcgccccaaggaaagtgctaaatccgctcatgtggattactgcttttatccggtgggtgtacaagaaaatggtcgcccgagttgcagataacatcaaccaggtgaatcgcgagattggctggatggaaggtgggcaactggtgcttggcaaccccgctcctataccaagacacgcccccatccctaggtattccacctacttgatgctgctcctgattgtatcatatgcgagcgcctgttctgagcttatccaggcttccagtcggattacaacttgcagcaccgagggagtcaatacaaagtgtcgcctgtctggcaccgcattgatcagagccgggtccgtgggagctgaagcctgcctcatgctgaagggtgttaaagaggaccagactaagttcttaaaaataaagacggtgtcaagtgaactgagctgcagggagggccagtcgtactggacagggtccttttctccaaaatgtctaagctcacgtcggtgccatctcgtcggagaatgtcacgtgaaccgatgcctgagttggagagataatgagacctccgcagagttctcttttgttggcgaaagcactaccatgagggagaacaagtgtttcgaacaatgcggtgggtggggctgtggatgctttaatgtgaacccctcctgtcttttcgtacacacatatttgcagtcagtccgcaaggaggcgctgcgggtgtttaattgcatcgactgggtgcataaactcaccctggaaattactgatttcgacggcagcgtcagtacaatcgatttaggggcctcttccagcagatttacgaactggggatcggtttcactgtctcttgacgctgagggcattagtggttccaatagcttctctttcatcgagagcccggggaagggatacgccatagtggatgaacctttttccgagattccaaggcagggcttcttgggtgaaatccgctgtaactcagagagtagcgtactctctgcacacgaatcctgcctgcgagctcccaatctaatttcatataaacctatgatcgaccagctggagtgcaccactaacctcatagatccctttgtggtcttcgagcggggcagtctgccacaaacacgtaatgacaagacctttgccgcaagcaaagggaacagaggagtgcaggccttctccaagggctctgttcaggctgatcttacattgatgtttgacaacttcgaagtggactttgtcggggcggccgtgtcgtgtgatgcagctttcctgaatttaactggatgctacagctgtaacgccggcgccagggtttgcctctcaatcacctccacgggtaccgggacactgagtgctcataataaggacggatctcttcacattgtgctgcctagcgagaacggcactaaagatcaatgtcagatcttgcattttaccgtccccgaagtagaggaggagttcatgtactcctgcgacggtgatgagcgcccactcctggtgaagggcacactaattgcaatcgacccgtttgatgaccggagagaagccgggggagagtcaactgttgtgaatcctaaatctggcagctggaacttcttcgattggtttagtgggctgatgtcctggttcggaggccccctcaagaccatactgcttatttgtttgtatgtcgcgctgagcatcggtttatttttcctcctgatctaccttgggaggacgggactgtctaaaatgtggctagctgccacaaagaaggcatcatga

SEQ ID NO: 11109 - RNA, 3594 nt, synthetic construct
  misc_feature 1..3594: note = derived and/or modified CDS sequence (opt3) from RVFV(73HB1230)__DQ380221.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctatttcgggaatccgcgaagtgaagacctcaagccaggagctatatcgagcactcaaagccattatcgcggctgacggtctgaataacataacatgtcacggcaaggatccagaggacaaaatcagtcttattaaggggccgccccataaaaagcgtgtcggaatcgtgagatgcgaaaggcggcgcgatgccaagcaagttggcagagagactatggcaggtattgccatgaccgtgctgcctgctttggcagtctttgccctcgctccagtggtattcgccgaagacccccacctgaggaatcggcctgggaaaggacataactacatcgatggcatgacacaggaggacgcgacctgtaagccagttacttatgcaggcgcctgctcctcttttgatgtgctgctcgaaaaagggaagttccccttatttcagagctacgctcaccatcgcacactgcttgaggccgtccacgacaccataattgcaaaagctgatcctccatcctgtgacttgcagtcagcccacggaaatccgtgcatgaaggagaagctggtgatgaaaacgcattgtcccaacgattatcaaagtgcgcactacctaaataacgacggtaagatggccagcgtgaaatgccctccaaagtatgaactcactgaggactgtaatttctgccgacagatgaccggcgcatctctgaaaaaggggtcctacccccttcaggatctgttttgccagtcaagcgaagacgatggaagtaaattgaagacaaagatgaaaggcgtctgtgaggttggtgtgcaagctctcaagaaatgcgacgggcagctgtctactgcccatgaagtagtgcctttcgctgtctttaagaactccaaaaaggtgtacttagataagctggacctcaaaaccgaggagaatcttctgccagatagcttcgtttgttttgaacacaagggacagtataaaggcacaatggactcgggccagaccaagaaagagttgaagtctttcgatatctcccaatgccccaagattgggggacacggtagtaaaaagtgtacgggcgacgccgcattttgctcagcctacgaatgtactgctcagtatgcgaacgcatactgcagccatgccaatgggtccggaatcgtgcagatccaagtctctggcgtgtggaaaaagccgctatgtgtaggttatgagagagttgtggtcaaaagggaactgagcgctaagcctattcagcgggtggagccctgcacaacctgtataactaagtgcgagccacacgggctcgtcgtgcgttcaacaggcttcaaaatcagttccgccgttgcatgcgccagcggagtgtgtgtaaccggctctcagtcacctagtacggaaattaccctgaagtaccccgggatcagccagtcctctggaggtgatataggcgtccatatggctcacgacgaccaatcggtgagctccaaaattgttgcccattgcccaccccaggatccttgtcttgtgcacgggtgcatcgtctgtgcacacggactgatcaactatcagtgccatacagcgttgtcagctttcgtggtagtgtttgttttcagttctattgccatcatttgtctcgcaatactgtaccgcgtcttaaagtgcctgaaaatcgccccaagaaaggtgctaaatccgctcatgtggattactgcttttatcaggtgggtgtacaaaaagatggtcgcccgggttgcagacaacatcaaccaggtgaatcgagagattggctggatggaaggtgggcaactggtgcttggcaaccccgctcctataccacgccacgcccccatccctagatatagcacctacttgatgctgctcctgattgtatcctatgcgtcagcctgtagcgagcttatccaggcttcttccaggattacaacttgcagtaccgagggagtcaatacaaagtgtcggctgagcggcaccgcattgatccgcgccgggtctgtgggagctgaagcctgcctcatgctgaaaggtgttaaggaggatcagactaaattcttaaagataaaaacggtgtcctcagaactgagttgcagagagggccagagctactggacagggtcgttttccccaaagtgtctatctagcaggcgttgccatctcgtcggagaatgtcacgtgaaccggtgcctgtcatggcgagacaatgagaccagtgcagagttctcctttgttggcgaatctactatcatgagagagaacaagtgtttcgaacaatgcggtgggtggggctgtggatgctttaatgtgaaccccagctgtcttttcgtacacacctatttgcagtccgtcaggaaagaggcgctgcgcgtgtttaattgcattgattgggtgcataagctcacactggaaatcaccgacttcgatggctcagtcagcactattgacttaggggccagttcttcccggtttacaaactggggaagcgtttcgctgtcacttgatgctgagggcatctctggtagtaattccttcagcttcatagagtctccggggaaaggatacgccattgtggacgaaccttttagcgagatcccaagacagggcttcttgggtgaaattaggtgtaactccgagtcaagtgtactcagcgcacacgaatcttgcctgcgcgctcccaatctaatctcctataagcctatgatagatcagctggagtgcacgaccaacctcatcgacccctttgtggtcttcgagcgaggctcactgccacaaactcggaatgataaaacatttgccgcaagtaaggggaaccgtggagtgcaggccttcagcaagggctccgttcaggctgaccttaccttgatgtttgacaacttcgaagtggattttgtcggggcggccgtgtcttgtgacgcagctttcctgaatttaacaggatgctactcgtgtaacgccggcgccagagtttgcctcagcattacttcaaccggtacggggaccctgtccgctcataataaagatggaagtcttcacatcgtgctgccttctgagaacggcacaaaggaccaatgtcagattttgcattttactgtccccgaagtagaggaggagttcatgtacagctgcgatggtgacgagaggccactcctggtgaaaggcaccctaatcgcaatagatccgtttgacgatcgccgggaagccgggggagagtccacagttgtgaatcctaagtcaggctcttggaacttcttcgactggtttagcgggctgatgagttggttcggaggccccctcaaaactattctgcttatctgtttgtatgtcgcgctgtccatcggtttatttttcctcctgatttaccttgggagaaccggactgagcaagatgtggctagctgccacgaagaaagcatcttga

SEQ ID NO: 11110 - RNA, 3594 nt, synthetic construct
  misc_feature 1..3594: note = derived and/or modified CDS sequence (opt3) from RVFV(73HB1449)__DQ380211.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctatttcgggaatccgcgaagtgaagacctcaagccaggagctatatcgagcactcaaagccattatcgcggctgacggtctgaataacataacatgtcacggcaaggatccagaggacaaaatcagtcttattaaggggccgccccataaaaagcgtgtcggaatcgtgagatgcgaaaggcggcgcgatgccaagcaaattggcagagagactatggcaggtatcgccatgaccgttctgcctgctttggcagtgtttgccctcgctccagtcgtgttcgccgaagacccccacctgaggaatcggcctgggaaaggacataactacatagatggcatgacacaggaggacgcgacctgtaagccagtaacttatgcaggcgcctgctcctcttttgatgttctgctcgaaaaagggaagttccccttatttcagagctacgctcaccatcgcacactgcttgaggccgtgcacgacaccattatcgcaaaagctgatcctccatcctgtgacttgcagtcagcccacggaaatccgtgcatgaaggagaagctggtcatgaaaacgcattgtcccaacgattatcaaagtgcgcactacctaaataacgacggtaagatggccagcgtgaaatgccctccaaagtatgaactcactgaggactgtaatttctgccgacagatgaccggcgcatctctgaaaaaggggtcctacccccttcaggatctgttttgccagtcaagcgaagacgatggaagtaaattgaagacaaagatgaaaggcgtgtgtgaggtcggtgttcaagctctcaagaaatgcgacgggcagctgtctactgcccatgaagtggtacctttcgctgtgtttaagaactccaaaaaggtctacttagataagctggacctcaaaaccgaggagaatcttctgccagatagcttcgtgtgttttgaacacaagggacagtataaaggcacaatggactcgggccagaccaagagagagttgaaatctttcgatatttcccaatgccccaagatcgggggacacggttcaaagaaatgtacgggcgacgccgcattttgcagtgcctacgaatgtactgctcagtatgcgaacgcatactgcagccatgccaatgggtccggaatcgttcagattcaagtgtctggcgtctggaagaaaccgctatgtgtgggttatgagagggtagttgtgaagcgggaactgagcgctaaacctatacagcgtgtcgagccctgcacaacctgtatcactaagtgcgagccacacgggctcgtggtccgctcaacaggcttcaagattagttccgccgtggcatgcgccagcggagtttgtgtgaccggctctcagaacccttcaacggaaatcaccctgaaataccccgggataagtcagagctccggaggtgatattggcgtacatatggctcacgacgaccaatctgtctcgagcaagatcgtggcccattgcccaccccaggatccttgtcttgttcacgggtgcatcgtgtgtgcacacggactgattaattatcagtgccatacagcgttgtccgctttcgtcgtggtatttgtgttctcaagtatcgccattatatgtctcgcaatcctgtacagagttttaaaatgcctgaagattgccccaaggaaagtcctaaacccgctcatgtggatcactgcttttatccggtgggtgtacaagaaaatggtggcccgagtcgcagacaacattaatcaggttaaccgcgagataggctggatggaaggtgggcaactggtgcttggcaatcccgctcctatcccaagacacgcccccattcctaggtattctacctacttgatgctgctcctgatcgtgagctatgcgtccgcctgttcagagcttattcaggctagctctcggatcacaacttgctccaccgagggagtaaacacaaagtgtcgcctgagtggcaccgcattgataagagccgggagcgtcggagctgaagcctgcctcatgctgaagggtgtgaaagatgaccagactaagttcttaaaaatcaagacggtttcttccgagctgtcatgcagggaaggccagagttactggacagggagcttttcgccaaaatgtctatcctctcgtcggtgccatctcgtgggagagtgtcacgtcaatcgatgcctgagctggagagataacgaaacctcagcagagttcagttttgtgggcgagtccactaccatgagggaaaataagtgtttcgagcaatgcggtgggtggggctgtggatgctttaacgttaatccctcttgtcttttcgtgcacacatatttgcagagcgtacgcaaggaagcgctgcgggtctttaactgcattgactgggtgcataaactcaccctggagatcactgatttcgacggctccgtgtcaacaattgatttaggggccagcagttctagatttacgaattggggatccgtcagcctgtcgcttgacgctgaaggcatctcaggttctaacagtttctccttcatagagagcccggggaagggatacgccattgttgatgagcctttttctgaaatcccaaggcagggcttcttgggtgagattcgctgtaatagcgaatcctcagtgctcagtgcacacgagagctgcctgcgagctcccaacctaatctcttataaacctatgatagaccagctggaatgcaccactaatctcatcgatccctttgtagtgttcgagcggggctccctgccacaaacacgtaacgagaagacctttgccgcatcaaaagggaacagaggagtccaggccttcagtaagggcagcgtgcaggctgaccttacattgatgtttgacaatttcgaagttgattttgtgggggcggccgtctcctgtgacgcagctttcctgaacttaactggatgctactcttgtaatgccggcgccagggtgtgcctctcgattaccagcacgggtaccgggacactgtcagctcataacaaggatggatcccttcacatcgttctgcctagtgagaatggcactaaagaccaatgtcagattttgcattttaccgtgcccgaagtcgaggaggagttcatgtactcttgcgatggtgacgagcgcccactcctggtaaagggcacactaatcgcaatagatccgtttgacgatcggagagaagccgggggagagagcactgtggttaaccctaaatccggctcatggaatttcttcgactggttttctgggctgatgagctggttcggaggccccctcaagaccattctgcttatctgtttgtatgtggcgctgagtatcggtttatttttcctcctgatttaccttgggaggacgggactgtccaaaatgtggctagctgccacaaagaaggcaagctga

SEQ ID NO: 11111 - RNA, 3594 nt, synthetic construct
  misc_feature 1..3594: note = derived and/or modified CDS sequence (opt3) from RVFV(ZH-548M12)__M25276.1__GP
  source 1..3594: mol_type = other RNA
atgtacgtgctgctcaccatccttacaagcgtcctggtttgcgaggccattataagagtgtccttgtcttcaactagggaagagacgtgtttcggcgacagtaccaaccccgaaatgatcgagggggcttgggatagcttacgggaagaggagatgcctgaggaactgtcctgctctatttcgggaatccgcgaagtaaagacatcaagccaggagctatatcgagcactcaaagccattatcgcggctgacggtctgaataacataacttgtcacggcaaggatccagaggacaaaatcagtcttattaaggggccgccccataaaaagcgtgtgggaatcgtcagatgcgaaaggcggcgcgatgccaagcaaattggcagaaaaaccatggcaggtatcgccatgacagtgctgcctgctttggcagtttttgccctcgctccagtggtcttcgccgaggacccccacctgaggaatcggcctgggaagggacataactacatagatggcatgacccaggaagacgcgacttgtaaaccagtgacatatgcaggcgcctgctcctcttttgatgtactgctcgagaaggggaaattccccttatttcagagctacgctcaccatcgcaccctgcttgaagccgttcacgacacgattatcgcaaaggctgatcctccatcctgtgacttgctgtcagcccacggaaatccgtgcatgaaggagaagctagtgatgaaaactcattgtcccaacgattatcagagtgcgcaccatctcaataacgacggtaaaatggccagcgtcaagtgccctccaaaatacgagctgaccgaagactgtaatttctgccgacaaatgacaggcgcatctcttaagaaagggtcctatcccctgcaggatttgttttgccagtcaagcgaggacgatggaagtaagctcaagactaaaatgaagggcgtgtgtgaagtgggtgtccaggctctgaaaaagtgcgacgggcaattatctaccgcccacgaggttgtgcctttcgctgtatttaaaaactccaagaaggtgtacctggataaactcgaccttaagacagaagagaatctgttgccagatagcttcgtctgttttgagcacaaaggacagtacaagggcaccatggactcgggccagacgaaaagagaactaaagtctttcgatatttcccagtgccccaagatcgggggacatggtagtaaaaagtgtactggcgacgccgcattttgcagtgcctatgagtgtacagctcaatacgcgaacgcatattgcagccacgccaatgggtccggaatcgtgcagattcaggtttctggcgtgtggaaaaagccgctgtgtgtcggttacgaaagggtggtagttaaacgggagctcagcgctaagcctatacaacgtgtggaaccctgcaccacttgtatcacaaagtgcgagccacatgggctggtcgtgcgctcaaccggcttcaaaattagttccgccgtcgcatgcgccagcggagtgtgtgttacgggctctcagtcacctagtaccgagatcacacttaagtatcccgggataagccagtcctctggaggtgatattggcgtgcacatggctcatgacgaccagtcggtaagctccaaaatcgtcgcccactgcccaccccaagatccttgtctggtgcacgactgcatcgtttgtgcacatgggttgattaactaccagtgccacactgcgctctcagctttcgtggtcgtgtttgtattcagttctatcgccattatatgtctggcaatcttatatagagtgctgaagtgcctaaaaattgccccaaggaaggttctcaatccgctgatgtggatcaccgcttttatccggtggatttacaaaaagatggtcgcccgagtggcagataacataaaccaggtgaatcgcgaaatcggatggatggagggcggtcagcttgtcttggggaaccccgctcctattccaagacatgcccccatccctaggtacagcacatatctgatgctcctgcttattgtttcctacgcgtcagcctgtagcgaactgatccaggcttcttcccggataactacctgcagtacagagggcgtgaataccaagtgtcgcttgagcggaactgcactcatcagagccggctctgtgggggctgaggcctgcctgatgttaaaaggagtaaaggaagaccaaacgaaattcctgaagctaaaaacagtctcctcagagctcagttgcagggaaggtcagagctattggaccggctcgttttccccaaagtgtctgtctagccgtcggtgccaccttgtgggggagtgtcacgttaaccgatgcttgtcatggagagataatgaaacttcagcagagttctcctttgtgggagagtctaccacaatgagggaaaacaagtgtttcgagcagtgcggcggttgggggtgtggctgctttaatgtcaaccccagctgtctgttcgtgcatacctacctccaatccgttcgcaaagaagcgctgcgggtgtttaattgcattgactgggtacacaagttaactctggagatcacagatttcgacggatcagtcagcacgattgatcttggcgccagttcttccagatttaccaactgggggagcgtgtcgttgtcactcgacgctgaaggaatctctggcagtaattccttcagcttcatagagtctccgggtaaagggtatgccattgtggatgagccttttagcgaaatcccaaggcagggattcctgggcgagattcgctgtaactccgaatcaagtgtcctaagcgcacatgagtcttgcctgcgagctcccaatctcatctcctacaagcctatgatagaccagctggaatgcactacaaaccttatcgatccctttgttgtgttcgagcggggttcattgccacagacccgtaatgacaaaacatttgccgcaagtaagggcaacagaggggtacaagccttcagcaagggatccgtgcaggctgacctgactttaatgtttgataacttcgaggtcgactttgtgggcgcggccgtttcttgtgatgcagctttcctcaatctgaccgggtgctattcgtgtaacgccggagccagggtgtgccttagcattacgtcaaccggcacaggttccctgagtgctcacaataaagacgggtctttgcatatcgtcctccctagcgaaaacggaactaaggatcagtgtcaaattctgcactttaccgtgcccgaggttgaagaggagttcatgtactcctgcgacggcgatgaacgcccactactggtgaaaggtacactcatcgcaatagacccgtttgatgaccggagagaggccggcggggaatcaactgtcgtaaatcctaagtctggaagctggaacttcttcgattggtttagtggcctgatgtcctggttcgggggaccccttaaaaccattttgctgatctgtttatacgtggcgctcagcatcggcctgtttttccttctgatttatctaggtgggacgggactctctaagatgtggctggctgccacaaagaaagcatcatga

SEQ ID NO: 11112 - RNA, 3594 nt, synthetic construct
  misc_feature 1..3594: note = derived and/or modified CDS sequence (opt3) from RVFV(ZINGA J83 R1)__KU978776.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctatttcgggaatccgcgaagtgaagacctcaagccaggagctatatcgagcactcaaagccattatcgcggctgacggtctgaataacataacatgtcacggcaaggatccagaggacaaaatcagtcttattaaggggccgccccataaaaagcgtgtcggaatcgtgagatgcgaaaggcggcgcgatgccaagcaaattggcagagagactatggcaggtatcgccatgaccgttctgcctgctttggcagtgtttgccctcgctccagtcgtgttcgccgaagacccccacctgaggaatcggcctgggaaaggacataactacatagatggcatgacacaggaggacgcgacctgtaagccagtaacttatgcaggcgcctgctcctcttttgatgttctgctcgaaaaagggaagttccccttatttcagagctacgctcaccatcgcacactgcttgaggccgtgcacgacaccattatcgcaaaagctgatcctccatcctgtgacttgcagtcagcccacggaaatccgtgcatgaaggagaagctggtcatgaaaacgcattgtcccaacgattatcaaagtgcgcactacctaaataacgacggtaagatggccagcgtgaaatgccctccaaagtatgaactcactgaggactgtaatttctgccgactgatgaccggcgcatctcttaaaaaggggtcctaccccctgcaggatttgttttgccagtcaagcgaagacgatggaagtaaactcaagacaaagatgaaaggcgtgtgtgaggtcggtgttcaggctctgaagaaatgcgacgggcaattatctactgcccatgaagtggtacctttcgctgtgtttaagaactccaaaaaggtctacctggataagctcgaccttaaaaccgaggagaatctgttgccagatagcttcgtgtgttttgaacacaagggacagtataaaggcacaatggactcgggccagaccaagagagagctaaaatctttcgatatttcccagtgccccaagatcgggggacacggttcaaagaaatgtacgggcgacgccgcattttgcagtgcctacgaatgtactgctcaatatgcgaacgcatactgcagccatgccaatgggtccggaatcgttcagattcaggtgtctggcgtctggaagaaaccgctgtgtgtgggttatgagagggtagttgtgaagcgggaactcagcgctaaacctatacaacgtgtcgagccctgcacaacctgtatcactaagtgcgagccacacgggctggtggtccgctcaacaggcttcaagattagttccgccgtggcatgcgccagcggagtttgtgtgaccggctctcagtcacctagtacggaaatcacccttaaataccccgggataagccagtcctctggaggtgatattggcgtacatatggctcacgacgaccagtcggtcagctccaagatcgtggcccattgcccaccccaagatccttgtctggttcacgggtgcatcgtgtgtgcacacggattgattaactatcagtgccatacagcgctctcagctttcgtcgtggtatttgtgttcagttctatcgccattatatgtctggcaatcttatacagagttctgaaatgcctaaagattgccccaaggaaagtcctcaatccgctgatgtggatcactgcttttatccggtgggtgtaccgaaagatggtggcccgcgtcgcagacaacattaaccaggttaatagagagataggctggatggaaggtgggcagcttgtgttgggcaaccccgctcctatcccaaggcacgtgcccattcctcggtatagcacctacctgatgctcctgcttatcgtatcctatgcctcagcgtgtagcgagctgattcaagcctcttcccgcatcacaacttgcagtaccgagggagtcaatacaaaatgtagattgagcggcaccgctctcataagggcagggtctgtgggagccgaggcttgcctgatgttaaagggtgttaaggaggatcagactaaattcctgaagatcaaaacggtgtcctcagaactaagttgccgtgagggccagagctactggacagggtcgttttccccaaagtgtctctctagccggcgatgccatctggtcggagaatgtcacgtgaacagatgcctttcatggagggacaatgagaccagtgccgagttctcctttgttggcgaatctactaccatgcgcgagaacaaatgtttcgaacagtgcggtgggtggggctgtggatgctttaatgtgaaccccagctgtttgttcgtacacacatatctgcaatccgtccggaaggaggcactcagagtgtttaattgcattgattgggtgcataagctgaccttagaaatcactgacttcgatggctcagtcagcacaattgacctgggggcgagttcttccaggtttacgaactggggaagcgtttcgctttcattggatgccgagggcatctctggtagtaattccttcagcttcatagagtctccggggaaaggatacgctattgtggacgaaccttttagcgagatcccacgccagggcttcctcggtgaaattcgatgtaactccgagtcaagtgtactgagcgcccacgaatcttgcctacgggcacccaatctgatctcctataagcctatgatagatcagctcgagtgcaccactaacctgatcgacccctttgtggtcttcgagcgtggctcacttccacagacaagaaatgataaaacctttgctgccagtaaggggaacaggggagtgcaagcattcagcaaaggctccgttcaggccgacttgacactgatgtttgacaacttcgaagtggattttgtcggggctgcggtgtcttgtgacgccgcattcttaaatctcactggatgctactcgtgtaacgctggcgcccgcgtttgcctgagcattacctcaacgggtaccgggacactttccgcccataataaggatggaagtctgcacatcgtgttgccttctgagaacggcactaaggaccagtgtcaaattctccattttaccgtccccgaagtagaggaggagttcatgtacagctgcgatggtgacgaacggccactgctagtgagaggcacactgatcgctatagatccgtttgacgataggcgagaagcagggggagagtccactgttgtgaatcctaaatcaggctcttggaacttcttcgactggtttagcgggctcatgagttggttcggaggccccctgaagaccattcttttgatctgtctgtatgtcgccttatccatcggtctctttttcctgcttatttacctggggcgcacgggactaagcaaaatgtggctcgcggctacaaagaaagcctcttga

SEQ ID NO: 11113 - RNA, 3594 nt, synthetic construct
  misc_feature 1..3594: note = derived and/or modified CDS sequence (opt3) from RVFV(Sudan 28-2010)__JQ820491.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctgtgtcgggtattcgcgaagtcaagacctcaagccaggagctatatcgagcactcaaagccatcattgcggctgacggactgaataacatcacatgtcacggcaagaatccagaggataaaataagtcttatcaaggggccgccccataaaaagcgtgtgggaattgttagatgcgaaaggcggcgcgacgccaagcaaatcggcagagagactatggcaggtattgccatgaccgtgctgcctgctttggcagtctttgccctcgctccagtggtattcgccgaagatccccacctgaggaaccggcctgggaaaggacataattacatcgacggcatgacacaggaggatgcgacctgtaagccagttacttatgcaggcgcctgctcctcttttgacgtgctgctcgaaaaagggaagttccccttatttcagagctacgctcaccatcgcacactgcttgaggccgtccacgataccataattgcaaaagctgaccctccatcctgtgatttgcagtcagcccacggaaacccgtgcatgaaggagaagctggtgatgaaaacgcattgtcccaatgactatcaaagtgcgcactacctaaacaatgatggtaagatggccagcgtgaaatgccctccaaagtatgaactcactgaggactgtaacttctgccgacagatgaccggcgcatctctgaaaaaggggtcctacccccttcaggacctgttttgccagtcaagcgaagatgacggaagtaaattgaagacaaagatgaaaggcgtctgtgaggttggtgtgcaagctctcaagaaatgcgatgggcagctgtctactgcccatgaagtagtgcctttcgctgtctttaaaaattccaagaaggtgtacttagacaagctggatctcaaaaccgaggagaaccttctgccagacagcttcgtttgttttgaacacaagggacagtataaaggcacaatggattcgggccagaccaagagagagttgaaatctttcgacatctcccaatgccccaagattgggggacacggttcaaagaaatgtacgggcgatgccgcattttgcagtgcctacgaatgtactgctcagtatgcgaatgcatactgcagccatgccaacgggtccggaatcgtgcagatccaagtctctggcgtgtggaagaaaccgctatgtgtaggttatgagagggttgtggtcaagcgggaactgagcgctaaacctattcagcgtgtggagccctgcacaacctgtataactaagtgcgagccacacgggctcgtcgtgcgctcaacaggcttcaagatcagttccgccgttgcatgcgccagcggagtgtgtgtaaccggctctcagtcacctagtacggaaattaccctgaaataccccgggatcagccagtcctctggaggtgacataggcgtccatatggctcacgatgaccaatcggtgagctccaagattgttgcccattgcccaccccaggacccttgtcttgtgcacgggtgcatcgtctgtgcacacggactgatcaattatcagtgccatacagcgttgtcagctttcgtggtagtgtttgttttcagttctattgccatcatttgtctcgcaatactgtacagagtcttaaaatgcctgaagatcgccccaaggaaagtgctaaacccgctcatgtggattactgcttttatccggtgggtgtacaagaaaatggtcgcccgagttgcagataacatcaatcaggtgaaccgcgagattggctggatggaaggtgggcaactggtgcttggcaatcccgctcctataccaagacacgcccccatccctaggtatagcacctacttgatgctgctcctgattgtatcctatgcgtcagcctgtagcgagcttatccaggcttcttcccggattacaacttgcagtaccgagggagtcaacacaaagtgtcgcctgagcggcaccgcattgatcagagccgggtctgtgggagctgaagcctgcctcatgctgaagggtgttaaagaggaccagactaagttcttaaaaataaagacggtgtcctcagaactgagttgcagggagggccagagctactggacagggtcgttttccccaaaatgtctatctagccgtcggtgccatctcgtcggagaatgtcacgtgaatcgatgcctgtcatggagagataacgagaccagtgcagagttctcctttgttggcgaatctactaccatgagggagaataagtgtttcgaacaatgcggtgggtggggctgtggatgctttaacgtgaatcccagctgtcttttcgtacacacatatttgcagtccgtccgcaaggaggcgctgcgggtgtttaactgcatcgactgggtgcataaactcaccctggaaattactgatttcgacggctcagtcagcacaatcgatttaggggccagttcttccagatttacgaattggggaagcgtttcgctgtcacttgacgctgagggcatttctggtagtaactccttcagcttcatcgagtctccggggaagggatacgccatagtggatgaaccttttagcgagattccaaggcagggcttcttgggtgaaatccgctgtaattccgagtcaagtgtactcagcgcacacgaatcttgcctgcgagctcccaacctaatttcctataaacctatgatcgaccagctggagtgcaccactaatctcatagatccctttgtggtcttcgagcggggctcactgccacaaacacgtaacgacaagacctttgccgcaagtaaagggaacagaggagtgcaggccttcagcaagggctccgttcaggctgatcttacattgatgtttgacaatttcgaagtggactttgtcggggcggccgtgtcttgtgatgcagctttcctgaacttaactggatgctactcgtgtaatgccggcgccagggtttgcctcagcatcacctcaacgggtaccgggacactgtccgctcataacaaggacggaagtcttcacattgtgctgccttctgagaatggcactaaagatcaatgtcagatcttgcattttaccgtccccgaagtagaggaggagttcatgtacagctgcgacggtgatgagcgcccactcctggtgaagggcacactaattgcaatcgacccgtttgatgaccggagagaagccgggggagagtccactgttgtgaaccctaaatcaggctcttggaatttcttcgattggtttagcgggctgatgagttggttcggaggccccctcaagaccatactgcttatttgtttgtatgtcgtgctgtccatcggtttatttttcctcctgatctaccttgggaggacgggactgagcaaaatgtggctagcggctacaaagaaggcctcttga

SEQ ID NO: 11114 - RNA, 3594 nt, synthetic construct
  misc_feature 1..3594: note = derived and/or modified CDS sequence (opt3) from RVFV(2007001292)__EU574046.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctgtgtcggggattcgcgaagtcaagacctcaagccaggagctatatcgagcactcaaagccatcattgcggctgacggtctgaataacatcacatgtcacggcaagaatccagaggataaaataagtcttatcaaggggccgccccataaaaagcgtgtgggaattgttagatgcgaaaggcggcgcgacgccaagcaaatcggcagagagactatggcaggtattgccatgaccgtgctgcctgctttggcagtctttgccctcgctccagtggtattcgccgaagatccccacctgaggaaccggcctgggaaaggacataattacatcgacggcatgacacaggaggatgcgacctgtaagccagttacttatgcaggcgcctgctcctcttttgacgtgctgctcgaaaaagggaagttccccttatttcagagctacgctcaccatcgcacactgcttgaggccgtccacgataccataattgcaaaagctgaccctccatcctgtgatttgcagtcagcccacggaaacccgtgcatgaaggagaagctggtgatgaaaacgcattgtcccaatgactatcaaagtgcgcactacctaaacaatgatggtaagatggccagcgtgaaatgccctccaaagtatgaactcactgaggactgtaacttctgccgacagatgaccggcgcatctctgaaaaaggggtcctacccccttcaggacctgttttgccagtcaagcgaagatgacggaagtaaattgaagacaaagatgaaaggcgtctgtgaggttggtgtgcaagctctcaagaaatgcgatgggcagctgtctactgcccatgaagtagtgcctttcgctgtctttaagaatagtaaaaaggtgtacttagacaagctggatctcaaaaccgaggagaaccttctgccagacagcttcgtttgttttgaacacaagggacagtataaaggcacaatggattcgggccagaccaagagagagttgaaatctttcgacatctcccaatgccccaagattgggggacacggttcaaagaaatgtacgggcgatgccgcattttgcagtgcctacgaatgtactgctcagtatgcgaatgcatactgcagccatgccaacgggtccggaatcgtgcagatccaagtctctggcgtgtggaagaaaccgctatgtgtaggttatgagagggttgtggtcaagcgggaactgagcgctaaacctattcagcgtgtggagccctgcacaacctgtataactaagtgcgagccacacgggctcgtcgtgcgctcaacaggcttcaagatcagttccgccgttgcatgcgccagcggagtgtgtgtaaccggctctcagtcacctagtacggaaattaccctgaaataccccgggatcagccagtcctctggaggtgacataggcgtccatatggctcacgatgaccaatcggtgagctccaagattgttgcccattgcccaccccaggacccttgtcttgtgcacgggtgcatcgtctgtgcacacggactgatcaattatcagtgccatacagcgttgtcagctttcgtggtaatttttgtgttcagttctactgccatcatttgtctcgcagttctgtacagagtcttaaaatgcctgaagatagccccaaggaaagtgctaaacccgctcatgtggatcaccgcttttattcggtgggtgtacaagaaaatggtcgcccgagttgcagataacatcaatcaggtgaaccgcgagatcggctggatggaaggtgggcaactggctcttggcaatcccgcccctattccaagacacgcgcccatacctaggtatagcacatacttgatgctgctcctgatcgtgtcctatgcctcagcttgtagcgagcttattcaggcatcttcccggatcactacctgcagtacagagggagtaaacaccaagtgtcgcctgagcggcactgccttgattagagctgggtctgtcggagccgaagcatgcctcatgctgaagggtgtgaaagaggaccagacgaagttcttaaaaatcaagacagtttcctcagaactgagttgcagggagggccagagctactggaccgggtcgttttccccaaaatgtctatctagccgtcggtgccatctcgtgggagaatgtcacgtcaatcgatgcctgtcatggagagataacgagacttccgcggagttctcctttgtgggcgaatctaccacaatgagggagaataagtgtttcgaacaatgcggtgggtggggctgtggatgctttaacgttaatcccagctgtcttttcgtgcacacctatttgcagtccgtacgcaaggaggccctgcgggtctttaactgcatagactgggtgcataaactcactctggaaatcacagatttcgacggctcagtgagcacgattgatttaggggctagttcttccagatttaccaattggggaagcgtctcgctgtcacttgacgccgagggcatctctggtagtaactccttcagcttcattgagtctccggggaagggatacgcaatcgttgatgaaccttttagcgagataccaaggcagggcttcttgggtgaaattcgctgtaattccgagtcaagtgtgctcagcgctcacgaatcttgcctgcgagcccccaacctagtatcctataaacctatgatcgaccagctggagtgcactacaaatctcattgatccctttgtggtcttcgagcggggctcactgccacaaacccgtaacgacaagacatttgcagccagtaaagggaacagaggagtgcaggctttcagcaagggctccgttcaggcggatcttactttgatgtttgacaatttcgaagtggactttgtcggggccgcagtgtcttgtgatgctgccttcctgaacttaaccggatgctactcgtgtaatgccggcgctagggtttgcctcagcatcacgtcaaccggtacagggactctgtccgcacataacaaggacggaagtcttcacatagtgctgccttctgagaatggcaccaaagatcaatgtcagatcttgcattttacagtccccgaagtagaggaggagttcatgtacagctgcgacggtgatgagcgcccactcctggtgaagggcactctaattgccatcgacccgtttgatgaccggagagaagcgggaggagagtccaccgttgtgaaccctaaatcaggctcttggaatctgttcgattggttcagcgggctcatgagttggtttggaggccccctgaagacgattcttttgatctgtctgtatgtcgctttatccataggtctcttctttctgcttatttacctggggaggacaggactaagcaaaatgtggctcgccgcaaccaagaaggcctcttga

SEQ ID NO: 11115 - RNA, 3594 nt, synthetic construct
  misc_feature 1..3594: note = derived and/or modified CDS sequence (opt3) from RVFV(Sudan 85-2010)__JQ820488.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaggaactgtcctgctctgtgtcgggtattcgcgaagtcaagacctcaagccaggagctatatcgagcactcaaagccatcattgcggctgacggactgaataacatcacatgtcacggcaagaatccagaggataaaataagtcttatcaaggggccgccccataaaaagcgtgtgggaattgttagatgcgaaaggcggcgcgacgccaagcaaatcggcagagagactatggcaggtattgccatgaccgtgctgcctgctttggcagtctttgccctcgctccagtggtattcgccgaagatccccacctgaggaaccggcctgggaaaggacataattacatcgacggcatgacacaggaggatgcgacctgtaagccagttacttatgcaggcgcctgctcctcttttgacgtgctgctcgaaaaagggaagttccccttatttcagagctacgctcaccatcgcacactgcttgaggccgtccacgataccataattgcaaaagctgaccctccatcctgtgatttgcagtcagcccacggaaacccgtgcatgaaggagaagctggtgatgaaaacgcattgtcccaatgactatcaaagtgcgcactacctaaacaatgatggtaagatggccagcgtgaaatgccctccaaagtatgaactcactgaggactgtaacttctgccgacagatgaccggcgcatctctgaaaaaggggtcctacccccttcaggacctgttttgccagtcaagcgaagatgacggaagtaaattgaagacaaagatgaaaggcgtctgtgaggttggtgtgcaagctctcaagaaatgcgatgggcagctgtctactgcccatgaagtagtgcctttcgctgtctttaaaaattccaagaaggtgtacttagacaagctggatctcaaaaccgaggagaaccttctgccagacagcttcgtttgttttgaacacaagggacagtataaaggcacaatggattcgggccagaccaagagagagttgaaatctttcgacatctcccaatgccccaagattgggggacacggttcaaagaaatgtacgggcgatgccgcattttgcagtgcctacgaatgtactgctcagtatgcgaatgcatactgcagccatgccaacgggtccggaatcgtgcagatccaagtctctggcgtgtggaagaaaccgctatgtgtaggttatgagagggttgtggtcaagcgggaactgagcgctaaacctattcagcgtgtggagccctgcacaacctgtataactaagtgcgagccacacgggctcgtcgtgcgctcaacaggcttcaagatcagttccgccgttgcatgcgccagcggagtgtgtgtaaccggctctcagtcacctagtacggaaattaccctgaaataccccgggatcagccagtcctctggaggtgacataggcgtccatatggctcacgatgaccaatcggtgagctccaagattgttgcccattgcccaccccaggacccttgtcttgtgcacgggtgcatcgtctgtgcacacggactgatcaattatcagtgccatacagcgttgtcagctttcgtggtagtgtttgttttcagttctattgccatcatttgtctcgcaatactgtacagagtcttaaaatgcctgaagatcgccccaaggaaagtgctaaacccgctcatgtggattactgcttttatccggtgggtgtacaagaaaatggtcgcccgagttgcagataacatcaatcaggtgaaccgcgagattggctggatggaaggtgggcaactggtgcttggcaatcccgctcctataccaagacacgcccccatccctaggtatagcacctacttgatgctgctcctgattgtatcctatgcgtcagcctgtagcgagcttatccaggcttcttcccggattacaacttgcagtaccgagggagtcaacacaaagtgtcgcctgagcggcaccgcattgatcagagccgggtctgtgggagctgaagcctgcctcatgctgaagggtgttaaagaggaccagactaagttcttaaaaataaagacggtgtcctcagaactgagttgcagggagggccagagctactggacagggtcgttttccccaaaatgtctatctagccgtcggtgccatctcgtcggagaatgtcacgtgaatcgatgcctgtcatggagagataacgagaccagtgcagagttctcctttgttggcgaatctactaccatgagggagaataagtgtttcgaacaatgcggtgggtggggctgtggatgctttaacgtgaatcccagctgtcttttcgtacacacatatttgcagtccgtccgcaaggaggcgctgcgggtgtttaactgcatcgactgggtgcataaactcaccctggaaattactgatttcgacggctcagtcagcacaatcgatttaggggccagttcttccagatttacgaattggggaagcgtttcgctgtcacttgacgctgagggcatttctggtagtaactccttcagcttcatcgagtctccggggaagggatacgccatagtggatgaaccttttagcgagattccaaggcagggcttcttgggtgaaatccgctgtaattccgagtcaagtgtactcagcgcacacgaatcttgcctgcgagctcccaacctaatttcctataaacctatgatcgaccagctggagtgcaccactaatctcatagatccctttgtggtcttcgagcggggctcactgccacaaacacgtaacgaaaagacctttgccgcaagtaaagggaacagaggagtgcaggccttcagcaagggctccgttcaggctgaccttacattgatgtttgataatttcgaggtggactttgtcggggcggccgtgtcttgtgacgcagctttcctgaacttaactggatgctactcgtgtaatgccggcgccagggtttgcctcagcatcacctcaacgggtaccgggacactgtccgctcataacaaggatggaagtcttcacattgtgctgccttctgaaaatggcactaaagaccaatgtcagatcttgcattttaccgtccccgaggtagaggaagagttcatgtacagctgcgatggtgacgaacgcccactcctggtgaagggcacactaattgcaatcgatccgtttgacgatcggagagaggccgggggagaatccactgttgtgaaccctaaatcaggctcttggaatttcttcgactggtttagcgggctgatgagttggttcggaggccccctcaagaccatactgcttatttgtttgtatgtcgcgctgtccatcggtttatttttcctcctgatctaccttgggaggacgggactgagcaaaatgtggctagctgccacaaagaaggcatcttga

SEQ ID NO: 11116 - RNA, 3594 nt, synthetic construct
  misc_feature 1..3594: note = derived and/or modified CDS sequence (opt3) from RVFV(2007002060)__EU574039.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctgtgtcggggattcgcgaagtcaagacctcaagccaggagctatatcgagcactcaaagccatcattgcggctgacggtctgaataacatcacatgtcacggcaagaatccagaggataaaataagtcttatcaaggggccgccccataaaaagcgtgtgggaattgttagatgcgaaaggcggaaggacgccaaacaaatcggccgcgagactatggcaggtattgccatgaccgtgctgcctgctttggcagtctttgccctcgctccagtggtattcgccgaagatccccacctgagaaacaggcctgggaagggacataattacatcgacggcatgacacaggaggatgcgacctgtaaaccagttacttatgcaggcgcctgctcctcttttgacgtgctgctcgaaaaggggaaattccccttatttcagagctacgctcaccatcggacactgcttgaggccgtccacgataccataattgcaaaggctgaccctccatcctgtgatttgcagtcagcccacggaaacccgtgcatgaaggagaaactggtgatgaagacgcattgtcccaatgactatcaaagtgcgcactacctaaacaatgatggtaaaatggccagcgtgaagtgccctccaaaatatgaactcactgaggactgtaacttctgccgccagatgaccggcgcatctctgaagaaagggtcctacccccttcaggacctgttttgccagtcaagcgaagatgacggaagtaagttgaagacaaaaatgaagggcgtctgtgaggttggtgtgcaagctctcaaaaagtgcgatgggcagctgtctactgcccatgaagtagtgcctttcgctgtctttaaaaattccaagaaggtgtacttagacaaactggatctcaagaccgaggagaaccttctgccagacagcttcgtttgttttgaacacaaaggacagtataagggcacaatggattcgggccagaccaaacgagagttgaagtctttcgacatctcccaatgccccaagattgggggacacggtagtaaaaagtgtacgggcgatgccgcattttgcagtgcctacgaatgtactgctcagtatgcgaatgcatactgcagccatgccaacgggtccggaatcgtgcagatccaagtctctggcgtgtggaaaaagccgctatgtgtaggttatgagagagttgtggtcaaaagggaactgagcgctaagcctattcagcgggtggagccctgcacaacctgtataactaagtgcgagccacacgggctcgtcgtgcgttcaacaggcttcaaaatcagttccgccgttgcatgcgccagcggagtgtgtgtaaccggctctcagtcacctagtacggaaattaccctgaagtaccccgggatcagccagtcctctggaggtgacataggcgtccatatggctcacgatgaccaatcggtgagctccaaaattgttgcccattgcccaccccaggacccttgtcttgtgcacgggtgcatcgtctgtgcacacggactgatcaattatcagtgccatacagcgttgtcagctttcgtggtaatttttgtgttcagttctactgccatcatttgtctcgcagttctgtaccgcgtcttaaagtgcctgaaaatagccccaagaaaggtgctaaacccgctcatgtggatcaccgcttttattaggtgggtgtacaaaaagatggtcgcccgggttgcagataacatcaatcaggtgaaccgagagatcggctggatggaaggtgggcaactggctcttggcaatcccgcccctattccacgccacgcgcccatacctagatatagcacatacttgatgctgctcctgatcgtgtcctatgcctcagcttgtagcgagcttattcaggcatcttccaggatcactacctgcagtacagagggagtaaacaccaagtgtcggctgagcggcactgccttgattcgcgctgggtctgtcggagccgaagcatgcctcatgctgaaaggtgtgaaggaggaccagacgaaattcttaaagatcaaaacagtttcctcagaactgagttgcagagagggccagagctactggaccgggtcgttttccccaaagtgtctatctagcaggcgttgccatctcgtgggagaatgtcacgtcaatcggtgcctgtcatggcgagataacgagacttcagcggagttctcctttgtgggcgaatctaccacaatgagagagaataagtgtttcgaacaatgcggtgggtggggctgtggatgctttaacgttaatcccagctgtcttttcgtgcacacctatttgcagtccgtaaggaaagaggccctgcgcgtctttaactgcatagactgggtgcataagctcactctggaaatcacagatttcgacggctcagtgagcacgattgatttaggggctagttcttcccggtttaccaattggggaagcgtctcgctgtcacttgacgccgagggcatctctggtagtaactccttcagcttcattgagtctccggggaaaggatacgcaatcgttgatgaaccttttagcgagataccaagacagggcttcttgggtgaaattaggtgtaattccgagtcaagtgtgctcagcgctcacgaatcttgcctgcgcgcccccaacctagtatcctataagcctatgatcgaccagctggagtgcactacaaatctcattgatccctttgtggtcttcgagcgaggctcactgccacaaacccggaacgacaaaacatttgcagccagtaaggggaaccgtggagtgcaggctttcagcaagggctccgttcaggcggatcttactttgatgtttgacaatttcgaagtggactttgtcggggccgcagtgtcttgtgatgctgccttcctgaacttaaccggatgctactcgtgtaatgccggcgctagagtttgcctcagcatcacgtcaaccggtacagggactctgtccgcacataacaaagacggaagtcttcacatagtgctgccttctgagaatggcaccaaggatcaatgtcagatcttgcattttacagtccccgaagtagaggaggagttcatgtacagctgcgacggtgatgagaggccactcctggtgaaaggcactctaattgccatcgacccgtttgatgaccgccgggaagcgggaggagagtccaccgttgtgaaccctaagtcaggctcttggaatttcttcgattggtttagcgggctgatgagttggttcggaggccccctcaaaacgattctgcttatctgtttgtatgtcgctctgtccataggtttatttttcctcctgatttaccttgggagaacaggactgagcaagatgtggctagccgcaaccaagaaagcctcttga

SEQ ID NO: 11117 - RNA, 3594 nt, synthetic construct
  misc_feature 1..3594: note = derived and/or modified CDS sequence (opt3) from RVFV(2007002476)__EU574036.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctgtgtcggggattcgcgaagtcaagacctcaagccaggagctatatcgagcactcaaagccatcattgcggctgacggtctgaataacatcacatgtcacggcaagaatccagaggataaaataagtcttatcaaggggccgccccataaaaagcgtgtgggaattgttagatgcgaaaggcggcgcgacgccaagcaaatcggcagagagactatggcaggtattgccatgaccgtgctgcctgctttggcagtctttgccctcgctccagtggtattcgccgaagatccccacctgaggaaccggcctgggaaaggacataattacatcgacggcatgacacaggaggatgcgacctgtaagccagttacttatgcaggcgcctgctcctcttttgacgtgctgctcgaaaaagggaagttccccttatttcagagctacgctcaccatcgcacactgcttgaggccgtccacgataccataattgcaaaagctgaccctccatcctgtgatttgcagtcagcccacggaaacccgtgcatgaaggagaagctggtgatgaaaacgcattgtcccaatgactatcaaagtgcgcactacctaaacaatgatggtaagatggccagcgtgaaatgccctccaaagtatgaactcactgaggactgtaacttctgccgacagatgaccggcgcatctctgaaaaaggggtcctacccccttcaggacctgttttgccagtcaagcgaagatgacggaagtaaattgaagacaaagatgaaaggcgtctgtgaggttggtgtgcaagctctcaagaaatgcgatgggcagctgtctactgcccatgaagtagtgcctttcgctgtctttaagaatagtaaaaaggtgtacttagacaagctggatctcaaaaccgaggagaaccttctgccagacagcttcgtttgttttgaacacaagggacagtataaaggcacaatggattcgggccagaccaagagagagttgaaatctttcgacatctcccaatgccccaagattgggggacacggttcaaagaaatgtacgggcgatgccgcattttgcagtgcctacgaatgtactgctcagtatgcgaatgcatactgcagccatgccaacgggtccggaatcgtgcagatccaagtctctggcgtgtggaagaaaccgctatgtgtaggttatgagagggttgtggtcaagcgggaactgagcgctaaacctattcagcgtgtggagccctgcacaacctgtataactaagtgcgagccacacgggctcgtcgtgcgctcaacaggcttcaagatcagttccgccgttgcatgcgccagcggagtgtgtgtaaccggctctcagtcacctagtacggaaattaccctgaaataccccgggatcagccagtcctctggaggtgacataggcgtccatatggctcacgatgaccaatcggtgagctccaagattgttgcccattgcccaccccaggacccttgtcttgtgcacgggtgcatcgtctgtgcacacggactgatcaattatcagtgccatacagcgttgtcagctttcgtggtaatttttgtgttcagttctactgccatcatttgtctcgcagttctgtacagagtcttaaaatgcctgaagatagccccaaggaaagtgctaaacccgctcatgtggatcaccgcttttattaagtgggtgtacaaaaagatggtcgcccgggttgcagataacatcaatcaggtgaaccgagagatcggctggatggaaggtgggcaactggctcttggcaatcccgcccctattccacgccacgcgcccatacctagatatagcacatacttgatgctgctcctgatcgtgtcctatgcctcagcttgtagcgagcttattcaggcatcttccaggatcactacctgcagtacagagggagtaaacaccaagtgtcggctgagcggcactgccttgattcgcgctgggtctgtcggagccgaagcatgcctcatgctgaaaggtgtgaaggaggaccagacgaaattcttaaagatcaaaacagtttcctcagaactgagttgcagagagggccagagctactggaccgggtcgttttccccaaagtgtctatctagcaggcgttgccatctcgtgggagaatgtcacgtcaatcggtgcctgtcatggcgagataacgagacttccgcggagttctcctttgtgggcgaatctaccacaatgagagagaataagtgtttcgaacaatgcggtgggtggggctgtggatgctttaacgttaatcccagctgtcttttcgtgcacacctatttgcagtccgtaaggaaagaggccctgcgcgtctttaactgcatagactgggtgcataagctcactctggaaatcacagatttcgacggctcagtgagcacgattgatttaggggctagttcttcccggtttaccaattggggaagcgtctcgctgtcacttgacgccgagggcatctctggtagtaactccttcagcttcattgagtctccggggaaaggatacgcaatcgttgatgaaccttttagcgagataccaagacagggcttcttgggtgaaattaggtgtaattccgagtcaagtgtgctcagcgctcacgaatcttgcctgcgcgcccccaacctagtatcctataagcctatgatcgaccagctggagtgcactacaaatctcattgatccctttgtggtcttcgagcgaggctcactgccacaaacccggaacgacaaaacatttgcagccagtaaggggaaccgtggagtgcaggctttcagcaagggctccgttcaggcggatcttactttgatgtttgacaatttcgaagtggactttgtcggggccgcagtgtcttgtgatgctgccttcctgaacttaaccggatgctactcgtgtaatgccggcgctagagtttgcctcagcatcacgtcaaccggtacagggactctgtccgcacataacaaagacggaagtcttcacatagtgctgccttctgagaatggcaccaaggatcaatgtcagatcttgcattttacagtccccgaagtagaggaggagttcatgtacagctgcgacggtgatgagaggccactcctggtgaaaggcactctaattgccatcgacccgtttgatgaccgccgggaagcgggaggagagtccaccgttgtgaaccctaagtcaggctcttggaatttcttcgattggtttagcgggctgatgagttggttcggaggccccctcaaaacgattctgcttatctgtttgtatgtcgctctgtccataggtttatttttcctcctgatttaccttgggagaacaggactgagcaagatgtggctagccgcaaccaagaaagcctcttga

SEQ ID NO: 11118 - RNA, 3594 nt, synthetic construct
  misc_feature 1..3594: note = derived and/or modified CDS sequence (opt3) from RVFV(2269/74)__DQ380222.1__GP
  source 1..3594: mol_type = other RNA
atgtacgtgctgctcacaatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctatttcgggaatccgcgaagtgaagacctcaagccaggagctatatcgagcactcaaagccattatcgcggctgacggtctgaataacataacatgtcacggcaaggatccagaggacaaaatcagtcttattaaggggccgccccataaaaagcgtgtcggaatcgtgagatgcgaaaggcggcgcgatgccaagcaaattggcagagagactatggcaggtatcgccatgaccgttctgcctgctttggcagtgtttgccctcgctccagtcgtgttcgccgaagacccccacctgaggaatcggcctgggaaaggacataactacatagatggcatgacacaggaggacgcgacctgtaagccagtaacttatgcaggcgcctgctcctcttttgatgttctgctcgaaaaagggaagttccccttatttcagagctacgctcaccatcgcacactgcttgaggccgtgcacgacaccattatcgcaaaagctgatcctccatcctgtgacttgcagtcagcccacggaaatccgtgcatgaaggagaagctggtcatgaaaacgcattgtcccaacgattatcaaagtgcgcactacctaaataacgacggtaagatggccagcgtgaaatgccctccaaagtatgaactcactgaggactgtaatttctgccgacagatgaccggcgcatctctgaaaaaggggtcctacccccttcaggatctgttttgccagtcaagcgaagacgatggaagtaaattgaagacaaagatgaaaggcgtgtgtgaggtcggtgttcaagctctcaagaaatgcgacgggcagctgtctactgcccatgaagtggtacctttcgctgtgtttaagaactccaaaaaggtctacttagataagctggacctcaaaaccgaggagaatcttctgccagatagcttcgtgtgttttgaacacaagggacagcacaaaggcacaatggactcgggccagaccaagagagagttgaaatctttcgatatttcccaatgccccaagatcgggggacatggttcaaagaaatgtacgggcgacgccgcattttgcagtgcctatgaatgtactgctcagtacgcgaacgcatattgcagccacgccaatgggtccggaatcgttcagattcaagtgtctggcgtctggaagaaaccgctatgtgtgggttacgagagggtagttgtgaagcgggaactgagcgctaaacctatacagcgtgtcgagccctgcacaacctgtatcactaagtgcgagccacatgggctcgtggtccgctcaacaggcttcaagattagttccgccgtggcatgcgccagcggagtttgtgtgaccggctctcagtcacctagtacggaaatcaccctgaaatatcccgggataagccagtcctctggaggtgatattggcgtacacatggctcatgacgaccaatcggtcagctccaagatcgtggcccactgcccaccccaggatccttgtcttgttcacgggtgcatcgtgtgtgcacatggactgattaactaccagtgccacacagcgttgtcagctttcgtcgtggtatttgtgttcagttctgttgccatcatttgtctcgcaatactgtataaagtcttaaagtgcctgaaaatcgccccaaagaaagtgctaaatccgctcatgtggattactgcttttatcagatgggtgtacaagaagatggtcgccagggttgcagacaacatcaaccaggtgaatcgggagattggctggatggaaggtgggcaactggctcttggcaaccccgcccctataccacgacatgcgcccatccctcgctacagcacctatttgatgctgctcctgattgtgtcctacgcctcagcttgtagcgagcttatccaggcatcttccagaattacaacttgcagtaccgagggagtaaatacaaaatgtaggctgagcggcaccgccttgatccgggctgggtctgtcggagccgaagcatgcctcatgctgaagggtgtgaaagaggatcagactaagttcttaaaaataaagacggtttcctcagaactgagttgccgcgagggccagagctattggacagggtcgttttccccaaagtgtctatctagcagaaggtgccacctcgtgggagaatgtcacgtcaaccgttgcctgtcatggcgggacaatgagaccagtgcggagttctcctttgtgggcgaatctactaccatgcgagagaacaaatgtttcgaacaatgcggtgggtggggctgtggatgctttaatgttaaccccagctgtcttttcgtgcatacatacttgcagtccgtaagaaaggaggccctgagggtctttaattgcatcgattgggtgcacaaactcaccctggaaattactgacttcgatggctcagtgagcacaatcgacttaggggctagttcttcccgctttacgaactggggaagcgtctcgctgtcacttgatgccgagggcatttctggtagtaattccttcagcttcatcgagtctccggggaagggatatgcaatagttgacgaaccttttagcgagattccacggcagggcttcttgggtgaaatcagatgtaactccgagtcaagtgtgctcagcgctcatgaatcttgcctgagggcccccaatctaatttcctacaaacctatgatcgatcagctggagtgcaccactaacctcatagacccctttgtagtgttcgagcgcggctcactgccacaaacacgaaatgataagacctttgcagccagtaaggggaaccggggagtccaggctttcagcaaaggctccgtgcaggcggaccttacattgatgtttgacaacttcgaagttgattttgtgggggccgcagtctcttgtgacgctgccttcctgaatttaactggatgctattcgtgtaacgccggcgctcgtgtgtgcctcagcatcacctcaacgggtaccgggacactgtccgcacacaataaggatggaagtcttcatattgttctgccttctgagaacggcactaaagaccaatgtcagatcttgcactttaccgtgcccgaagtcgaggaggagttcatgtacagctgcgatggtgacgagagaccactcctggtaaagggcacactaattgccatcgatccgtttgacgataggcgcgaagctgggggagagtccactgtggttaatcctaaatcaggctcttggaacttcttcgactggtttagcgggctgatgagttggttcggaggccccctcaagaccatactgcttatttgtttgtacgtggcgctgtccatcggtttatttttcctcctgatctatcttgggcggacgggactgagcaagatgtggctagccgcaaccaaaaaggcctcttga

SEQ ID NO: 11119 - RNA, 3594 nt, synthetic construct
  misc_feature 1..3594: note = derived and/or modified CDS sequence (opt3) from RVFV(SA-51 (Van Wyck))__DQ380195.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctatttcgggaatccgcgaagtgaagacctcaagccaggagctatatcgagcactcaaagccattatcgcggctgacggtctgaataacataacatgtcacggcaaggatccagaggacaaaatcagtcttattaaggggccgccccataaaaagcgtgtcggaatcgtgagatgcgaaaggcggcgcgatgccaagcaaattggcagagagactatggcaggtatcgccatgaccgttctgcctgctttggcagtgtttgccctcgctccagtcgtgttcgccgaagacccccacctgaggaatcggcctgggaaaggacataactacatagatggcatgacacaggaggacgcgacctgtaagccagtaacttatgcaggcgcctgctcctcttttgatgttctgctcgaaaaagggaagttccccttatttcagagctacgctcaccatcgcacactgcttgaggccgtgcacgacaccattatcgcaaaagctgatcctccatcctgtgacttgcagtcagcccacggaaatccgtgcatgaaggagaagctggtcatgaaaacgcattgtcccaacgattatcaaagtgcgcactacctaaataacgacggtaagatggccagcgtgaaatgccctccaaagtatgaactcactgaggactgtaatttctgccgacagatgaccggcgcatctctgaaaaaggggtcctacccccttcaggatctgttttgccagtcaagcgaagacgatggaagtaaattgaagacaaagatgaaaggcgtgtgtgaggtcggtgttcaagctctcaagaaatgcgacgggcagctgtctactgcccatgaagtggtacctttcgctgtgtttaagaactccaaaaaggtctacttagataagctggacctcaaaaccgaggagaatcttctgccagatagcttcgtgtgttttgaacacaagggacagtataaaggcacaatggactcgggccagaccaagagagagttgaaatctttcgatatttcccaatgccccaagatcgggggaaggggttcaaagaaatgtacgggcgacgccgcattttgcagtgcctacgaatgtactgctcagtatgcgaacgcatactgcagccacgccaatgggtccggaatcgttcagattcaagtgtctggcgtctggaagaaaccgctatgtgtgggttatgagcgggtagttgtgaagcgtgaactgagcgctaaacctatacagcgcgtcgagccctgcacaacctgtatcactaagtgcgagccacatgggctcgtggtcagatcaacaggcttcaagattagttccgccgtggcatgcgccagcggagtttgtgtgaccggctctcagtcacctagtacggaaatcaccctgaaataccccgggataagccagtcctctggaggtgatattggcgtacacatggctcatgacgaccaatcggtcagctccaagatcgtggcccactgcccaccccaggatccttgtcttgttcatgggtgcatcgtgtgtgcacacggactgattaactatcagtgccacacagcgttgtcagctttcgtcgtggtatttgtgttcagttctgttgccatcatttgtctcgcaatactgtacaaagtcttaaagtgcctgaaaatcgccccaaggaaggtgctaaatccgctcatgtggattactgcttttatccggtgggtgtacaaaaagatggtcgcccgagttgcagacaacatcaaccaggtgaatcgcgagattggctggatggaaggtgggcaactggctcttggcaaccccgcccctataccaagacatgcgcccatccctaggtatagcacctacttgatgctgctcctgattgtgtcctatgcctcagcttgtagcgagcttatccaggcatcttcccggattacaacttgcagtaccgagggagtaaatacaaagtgtcgcctgagcggcaccgccttgatcagagctgggtctgtcggagccgaagcatgcctcatgctgaaaggtgtgaaggaggatcagactaaattcttaaagataaaaacggtttcctcagaactgagttgcagggagggccagagctactggacagggtcgttttccccaaagtgtctatctagccgtcggtgccacctcgtgggagaatgtcatgtcaaccgatgcctgtcatggagagacaatgagaccagtgcggagttctcctttgtgggcgaatctactaccatgagggagaacaagtgtttcgaacaatgcggtgggtggggctgtggatgctttaatgttaaccccagctgtcttttcgtgcacacatatttgcagtccgtacgcaaagaggccctgcgggtctttaattgcatcgattgggtgcacaagctcaccctggaagtgactgacttcgatggctcagtcagcacaattgacttaggggctagttcttccagatttacgaactggggaagcgtttcgctgtcacttgatgccgagggcatctctggtagtaattccttcagcttcattgagtctccggggaaaggatacgcaatcgtggacgaaccttttagcgagataccaaggcagggcttcttgggtgaaattcgctgtaactccgagtcaagtgtactcagcgctcatgaatcttgcctgcgagcccccaatctaatctcctataagcctatgattgatcagctggagtgcaccactaacctcatcgacccctttgtggtcttcgagcggggctcactgccacaaacacgtaatgataaaacctttgcagccagtaaggggaacagaggagtgcaggctttcagcaagggctccgttcaggcggaccttacattgatgtttgacaacttcgaagtggattttgtcggggccgcagtgtcttgtgacgctgccttcctgaatttaactggatgctactcgtgtaacgccggcgctagggtttgcctcagcataacctcaacgggtaccgggacactgtccgcacacaataaagatggaagtcttcatatcgtgctgccttctgagaacggcactaaggaccaatgtcagattttgcactttaccgtccccgaagtagaggaggagttcatgtacagctgcgatggtgacgagcgcccactcctggtgaaaggcacactaatcgccattgatccgtttgacgatcggagagaagctgggggagagtccactgttgtgaatcctaagtcaggctcttggaacttcttcgactggtttagcgggctgatgagttggttcggaggccccctcaaaaccatcctgcttatatgtttgtatgtcgcgctgtccattggtttatttttcctcctgatctaccttgggaggacgggactgagcaagatgtggctagccgcaacaaagaaagcctcttga

SEQ ID NO: 11120 - RNA, 3594 nt, synthetic construct
  misc_feature 1..3594: note = derived and/or modified CDS sequence (opt3) from RVFV(OS-8)__DQ380185.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctatttcgggaatccgcgaagtgaagacctcaagccaggagctatatcgagcactcaaagccattatcgcggctgacggtctgaataacataacatgtcacggcaaggatccagaggacaaaatcagtcttattaaggggccgccccataaaaagcgtgtcggaatcgtgagatgcgaaaggcggcgcgatgccaagcaaattggcagagagactatggcaggtatcgccatgaccgttctgcctgctttggcagtgtttgccctcgctccagtcgtgttcgccgaagacccccacctgaggaatcggcctgggaaaggacataactacatagatggcatgacacaggaggacgcgacctgtaagccagtaacttatgcaggcgcctgctcctcttttgatgttctgctcgaaaaagggaagttccccttatttcagagctacgctcaccatcgcacactgcttgaggccgtgcacgacaccattatcgcaaaagctgatcctccatcctgtgacttgcagtcagcccacggaaatccgtgcatgaaggagaagctggtcatgaaaacgcattgtcccaacgattatcaaagtgcgcactacctaaataacgacggtaagatggccagcgtgaaatgccctccaaagtatgaactcactgaggactgtaatttctgccgacagatgaccggcgcatctctgaaaaaggggtcctacccccttcaggatctgttttgccagtcaagcgaagacgatggaagtaaattgaagacaaagatgaaaggcgtgtgtgaggtcggtgttcaagctctcaagaaatgcgacgggcagctgtctactgcccatgaagtggtacctttcgctgtgtttaagaactccaaaaaggtctacttagataagctggacctcaaaaccgaggagaatcttctgccagatagcttcgtgtgttttgaacacaagggacagtataaaggcacaatggactcgggccagaccaagagagagttgaaatctttcgatatttcccaatgccccaagatcgggggacacggttcaaagaaatgtacgggcgacgccgcattttgcagtgcctacgaatgtactgctcagtatgcgaacgcatactgcagccatgccaatgggtccggagttgtgcagatccaagtctctggcgtgtggaagaaaccgctatgtgtaggttatgagagggttgtggtcaagcgggaactgagcgctaaacctattcagcgtgtggagccctgcacaacctgtataactaagtgcgagccacacgggctcgtcgtgcgctcaacaggcttcaagatcagttccgccgttgcatgcgccagcggagtgtgtgtaaccggctctcagtcacctagtacggaaattaccctgaaataccccgggatcagccagtcctctggaggtgatataggcgtccatatggctcacgacgaccaatcggtgagctccaagattgttgcccattgcccaccccaggatccttgtcttgtgcacgggtgcatcgtctgtgcacacggactgatcaactatcagtgccatacagcgttgtcagctttcgtggtagtgtttgttttcagttctgtcgccattatctgtctcgcaattctgtacaaagtgttaaagtgcctgaaaatagccccaagaaaggtgctaaatccgctcatgtggatcactgcttttattaggtgggtctacaaaaagatggttgcccgggtggcagacaacatcaaccaggtgaatcgagagatcggctggatggaaggtgggcaactggctcttggcaaccccgcccctattccacgccacgcgcccatacctagatatagcacctacttgatgctgctcctgatcgtatcctatgcctcagcttgtagcgagcttattcaggcatcttccaggatcacaacttgcagtaccgagggagtcaatacaaagtgtcggctgagcggcaccgccttgattcgcgctgggtctgtgggagccgaagcatgcctcatgctgaaaggtgttaaggaggatcagactaaattcttaagaatcaagacggtgtcctcagaactgagttgcagggagggccagagctactggacagggtcgttttccccaaaatgtctatctagccgtcggtgccatctcgtcggagaatgtcacgtgaaccgatgcctgtcatggagagacaatgagaccagtgcggagttctcctttgttggcgaatctactaccatgagggagaacaagtgtttcgaacaatgcggtgggtggggctgtggatgctttaatgtgaaccccagctgtcttttcgtacacacatatttgcagtccgtccgcaaggaggccctgcgggtgtttaattgcatagattgggtgcataaactcaccctggaaatcactgacttcgatggctcagtcagcacaattgacttaggggctagttcttccagatttacgaactggggaagcgtttcgctgtcacttgatgccgagggcatctctggtagtaattccttcagcttcattgagtctccggggaagggatacgcaatcgtggacgaaccttttagcgagataccaaggcagggcttcttgggtgaaattcgctgtaactccgagtcaagtgtactcagcgctcacgaatcttgcctgcgagcccccaatctaatctcctataaacctatgattgatcagctggagtgcaccactaacctcatcgacccctttgtggtcttcgagcggggctcactgccacaaacacgtaatgataagacctttgcagccagtaaagggaacagaggagtgcaggctttcagcaagggctccgttcaggcggaccttacattgatgtttgacaacttcgaagtggattttgtcggggccgcagtgtcttgtgacgctgccttcctgaatttatcgggatgctacagctgtaacgccggcgctagggtttgcctctcaataacttccaccggtacggggaccctgagtgcacataataaggatggatctcttcacatcgtgctgcctagcgagaacggcacaaaagaccaatgtcagattttgcattttactgtccccgaagtagaggaggagttcatgtactcctgcgatggtgacgagcgcccactcctggtgaagggcaccctaatcgccattgatccgtttgacgatcggagagaagctgggggagagtcaacagttgtgaatcctaaatctggcagctggaacttcttcgactggtttagtgggctgatgtcctggttcggaggccccctcaagactatcctgcttatatgtttgtatgtcgcgctgagcattggtttatttttcctcctgatctaccttgggaggaccggactgtctaaaatgtggctagccgcaacgaagaaggcctcatga

SEQ ID NO: 11121 - RNA, 3594 nt, synthetic construct
  misc_feature 1..3594: note = derived and/or modified CDS sequence (opt3) from RVFV(BIME-01)__KX609032.1__GP
  source 1..3594: mol_type = other RNA
atgtacgtgctgctcaccatccttattagcgtcctggtttgcgaggccataatcagagtgtccttgtcttcaacaagggaagagacttgtttcggcgacagtacgaaccccgaaatgattgagggggcttgggatagcttacgggaagaggagatgcctgaagaactgtcctgctctatctcggggattcgcgaagtaaagacctcaagccaggagctatatcgagcactcaaagccatcatagcggctgacggtctgaataacatcacatgtcacggcaaggatccagaggacaaaattagtcttatcaaggggccgccccataaaaagcgtgtgggaattgtcagatgcgaaaggcggcgcgatgccaagcaaatcggcagagagactatggcaggtatagccatgaccgtgctgcctgctttggcagtttttgccctcgctccagtggtcttcgccgaagacccccacctgaggaatcggcctgggaaaggacataactacattgatggcatgacacaggaggacgcgacctgtaagccagtgacttatgcaggcgcctgctcctcttttgatgtactgctcgaaaaagggaagttccccttatttcagagctacgctcaccatcgcacactgcttgaggccgttcacgacaccatcattgcaaaagctgatcctccatcctgtgacttgcagtcagcccacggaaatccgtgcatgaaggagaagctggtgatgaaaacgcattgtcccaacgattatcaaagtgcgcactacctaaataacgacggtaagatggccagcgtcaaatgccctccaaagtatgaactcactgaggactgtaatttctgccgacagatgaccggcgcatctctgaaaaaggggtcctacccccttcaggatctgttttgccagtcaagcgaagacgatggaagtaaattgaagacaaagatgaaaggcgtgtgtgaggtgggtgtccaagctctcaagaaatgcgacgggcagctgtctactgcccatgaagttgtgcctttcgctgtatttaagaactccaaaaaggtgtacttagataagctggacctcaaaaccgaggagaatcttctgccagatagcttcgtctgttttgaacacaagggacagtataaaggcacaatggactcgggccagaccaagagagagttgaaatctttcgatatctcccaatgccccaagatcgggggacacggttcaaagaaatgtacgggcgacgccgcattttgcagtgcctacgaatgtactgctcagtatgcgaacgcatactgcagccatgccaatgggtccggaattgtgcagatacaagtttctggcgtgtggaagaaaccgctatgtgtcggttatgagagggtggtagttaagcgggaactgagcgctaaacctatccagcgtgtggagccctgcacaacctgtattactaagtgcgagccacacgggctcgtcgtgcgctcaacaggcttcaagatcagttccgccgtcgcatgcgccagcggagtgtgtgttaccggctctcagtcacctagtacggaaataaccctgaaataccccgggattagccagtcctctggaggtgatatcggcgtgcatatggctcacgacgaccaatcggtaagctccaagatcgtcgcccattgcccaccccaggatccttgtcttgtgcacgggtgcattgtttgtgcacacggactgatcaactatcagtgccatacagcgttgtcagctttcgtggtcgtgtttgtattcagttctgtggccattatatgtctcgcaatcctgtacaaagttttaagatgcctgaagattgccccgaaaaaggtcctaaatccactcatgtggatcactgcttttatcaggtgggtgtacaaaaagatggtggcccgggtcgcagacaacattaaccaggttaatcgagagataggctggatggaaggtgggcaactggctcttggcaaccccgcccctatcccacgccacgcgcccattcctagatatagcacctacttgatgctgctcctgatcatttcctatgcctcagcttgtagcgagcttatccaggcatcttccaggataacaacttgcagtaccgagggagtgaatacaaagtgtcggctgagcggcaccgccttgatccgcgctgggtctgtgggagccgaagcatgcctcatgctgaaaggtgtaaaggaggatcagactaaattcttaaagattaaaacggtctcctcagaactgagttgcagagagggccagagctactggacagggtcgttttccccaaagtgtctatctagcaggcgttgccatctcgtgggagaatgtcacgttaaccggtgcctgtcatggcgagacaatgagaccagtgcggagttctcctttgtgggcgaatctactaccatgagagagaacaagtgtttcgaacaatgcggtgggtggggctgtggatgctttaatgtcaaccccagctgtcttttcgtgcacacatatttgcagtccgttaggaaagaggccctgcgcgtgtttaattgcatcgattgggtacataagctcaccctggaaattactgacttcgatggctcagtcagcacaatcgacttaggggctagttcttcccggtttacgaactggggaagcgtgtcgctgtcacttgatgccgagggcatatctggtagtaattccttcagcttcattgagtctccggggaaaggatacgcaatcgtggacgaaccttttagcgagattccaagacagggcttcttgggtgaaatcaggtgtaactccgagtcaagtgtcctcagcgctcacgaatcttgcctgcgcgcccccaatctaatatcctataagcctatgatcgatcagctggagtgcaccactaacctcattgacccctttgttgtgttcgagcgaggctcactgccacaaacacggaatgataaaacctttgcagccagtaaggggaaccgtggagtacaggctttcagcaagggctccgtgcaggcggaccttacattgatgtttgacaacttcgaagtcgattttgtgggggccgcagtttcttgtgacgctgccttcctgaatttaactggatgctactcgtgtaacgccggcgctagagtgtgcctcagcatcacctcaacgggtaccgggacactgtccgcacataataaagatggaagtcttcacattgtcctgccttctgagaacggcactaaggaccaatgtcagatcttgcattttaccgtgcccgaagttgaggaggagttcatgtacagctgcgatggtgacgagaggccactcctggtgaaaggcacactaatagccattgatccgtttgacgatcgccgggaagcgggaggagagtccactgtcgtaaatcctaagtcaggctcttggaacttcttcgactggtttagcgggctgatgagttggttcggaggccccctcaaaaccatcctgcttatctgtttgtatgtggctctgtccattggtttatttttcctcctgatctaccttgggagaacgggactgagcaagatgtggctagccgcaacaaagaaagcctcttga

SEQ ID NO: 11122 - RNA, 3594 nt, synthetic construct
  misc_feature 1..3594: note = derived and/or modified CDS sequence (opt3) from RVFV(Kenya 83 (21445))__DQ380198.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctatttcgggaatccgcgaagtgaagacctcaagccaggagctatatcgagcactcaaagccattatcgcggctgacggtctgaataacataacatgtcacggcaagaatccagagaacaaaatcagtcttattaaggggccgccccataaaaagcgtgtcggaatcgtgagatgcgaaaggcggcgcgatgccaagcaaattggcagagagactatggcaggtatcgccatgaccgttctgcctgctttggcagtgtttgccctcgctccagtcgtgttcgccgaagacccccacctgaggaatcggcctgggaaaggacataactacatagatggcatgacacaggaggacgcgacctgtaagccagtaacttatgcaggcgcctgctcctcttttgatgttctgctcgaaaaagggaagttccccttatttcagagctacgctcaccatcgcacactgcttgaggccgtgcacgacaccattatcgcaaaagctgatcctccatcctgtgacttgcagtcagcccacggaaatccgtgcatgaaggagaagctggtcatgaaaacgcattgtcccaacgattatcaaagtgcgcactacctaaataacgacggtaagatggccagcgtgaaatgccctccaaagtatgaactcactgaggattgtaatttctgccgacagatgaccggcgcatctctgaaaaaggggtcctacccccttcaggacctgttttgccagtcaagcgaagacgatggaagtaaattgaagacaaagatgaaaggcgtgtgtgaggtcggtgttcaagctctcaagaaatgcgacgggcagctgtctactgcccatgaagtggtacctttcgctgtgtttaagaactccaaaaaggtctacttagataagctggacctcaaaaccgaggagaatcttctgccagatagcttcgtgtgttttgaacacaagggacagtataaaggcacaatggactcgggccagaccaagagagagttgaaatctttcgatatttcccaatgccccaagatcgggggacacggttcaaagaaatgtacgggcgacgccgcattttgcagtgcctacgaatgtactgctcagtatgcgaacgcatactgcagccatgccaatgggtccggaatcgttcagattcaagtgtctggcgtctggaagaaaccgctatgtgtgggttatgagagggtagttgtgaagcgggaactgagcgctaaacctatacagcgtgtcgagccctgcacaacctgtatcactaagtgcgagccacacgggctcgtggtccgctcaacaggcttcaagattagttccgccgtggcatgcgccagcggagtttgtgtgaccggctctcagtcacctagtacggaaatcaccctgaaataccccgggataagccagtcctctggaggtgatattggcgtacatatggctcacgacgatcaatcggtcagctccaagatcgtggcccattgcccaccccaggacccttgtcttgttcacgggtgcatcgtgtgtgcacacggactgattaactatcagtgccatacagcgttgtcagctttcgtcgtggtatttgtgttcagttctatcgccattatatgtctcgcaatcctgtacagagttttaaaatgcctgaagattgccccaaggaaagtcctaaacccgctcatgtggatcactgcttttatccggtgggtgtacaagaaaatggtggcccgagtcgcagacaatattaaccaggttaatcgcgagataggctggatggaaggtgggcaactggctcttggcaaccccgcccctatcccaagacacgcgcccattcctaggtatagcacctacttgatgctgctcctgatcgtgtcctatgcctcagcttgtagcgagcttattcaggcatcttcccggatcacaacttgcagtaccgagggagtgaatacaaagtgtcgcctgagcggcaccgccttgataagagctgggtctgtaggagccgaagcatgcctcatgctgaagggtgtcaaagaggatcagactaagttcttaaaaatcaagacggtgtcctcagaactgagttgcagggagggccagagctactggacagggtcgttttccccaaaatgtctatctagccgtcggtgccatctcgttggagaatgtcacgtgaaccgatgcctgtcatggagagacaatgagaccagtgcggagttctcctttgtcggcgaatctactaccatgagggagaacaagtgtttcgaacaatgcggtgggtggggctgtggatgctttaatgtgaaccccagctgtcttttcgttcacacatatttgcagtccgtgcgcaaggaggccctgcgggtatttaattgcattgattgggtccataaactcaccctggaaatcactgacttcgatggctcagtgagcacaattgacttaggggctagttcttccagatttacgaactggggaagcgtgtcgctgtcacttgatgccgagggcatctctggtagtaattccttcagcttcatagagtctccggggaagggatacgcaattgtcgacgaaccttttagcgagatcccaaggcagggcttcttgggtgaaattcgctgtaactccgagtcaagtgttctcagcgctcacgaatcttgcctgcgagcccccaatctaatctcctataaacctatgatagatcagctggagtgcaccactaacctcatcgacccctttgtggtattcgagcggggctcactgccacaaacacgtaacgataagacctttgcagccagtaaagggaatagaggagtgcaggctttcagcaagggctccgtccaggcggaccttacattgatgtttgataacttcgaagtggactttgttggggccgcagtgtcttgtgacgctgccttcctgaatttaactggatgctactcgtgtaacgccggcgctagggtctgcctcagcattacctcaacgggtaccgggacactgtccgcacataataaggatggaagtcttcacatcgtgctgccttctgagaacggcactaaagaccaatgtcagattttgcattttaccgttcccgaagtggaggaggagttcatgtacagctgcgatggtgacgagcgcccactcctggtcaagggcacactaatcgccatagatccgtttgacgatcggagagaagctgggggagagtccactgtagtgaatcctaaatcaggctcttggaacttcttcgactggtttagcgggctgatgagttggttcggaggccccctcaagaccattctgcttatctgtttgtatgttgcgctgtccatcggtttatttttcctcctgatttaccttgggaggacgggactgagcaaaatgtggctagccgcaacaaagaaggcctcttga

SEQ ID NO: 11123 - RNA, 3594 nt, synthetic construct
  misc_feature 1..3594: note = derived and/or modified CDS sequence (opt3) from RVFV(2007000253)__JF326192.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctgtgtcgggtattcgcgaagtcaagacctcaagccaggagctatatcgagcactcaaagccatcattgcggctgacggactgaataacatcacatgtcacggcaagaatccagaggataaaataagtcttatcaaggggccgccccataaaaagcgtgtgggaattgttagatgcgaaaggcggcgcgacgccaagcaaatcggcagagagactatggcaggtattgccatgaccgtgctgcctgctttggcagtctttgccctcgctccagtggtattcgccgaagatccccacctgaggaaccggcctgggaaaggacataattacatcgacggcatgacacaggaggatgcgacctgtaagccagttacttatgcaggcgcctgctcctcttttgacgtgctgctcgaaaaagggaagttccccttatttcagagctacgctcaccatcgcacactgcttgaggccgtccacgataccataattgcaaaagctgaccctccatcctgtgatttgcagtcagcccacggaaacccgtgcatgaaggagaagctggtgatgaaaacgcattgtcccaatgactatcaaagtgcgcactacctaaacaatgatggtaagatggccagcgtgaaatgccctccaaagtatgaactcactgaggactgtaacttctgccgacagatgaccggcgcatctctgaaaaaggggtcctacccccttcaggacctgttttgccagtcaagcgaagatgacggaagtaaattgaagacaaagatgaaaggcgtctgtgaggttggtgtgcaagctctcaagaaatgcgatgggcagctgtctactgcccatgaagtagtgcctttcgctgtctttaagaatagtaaaaaggtgtacttagacaagctggatctcaaaaccgaggagaaccttctgccagacagcttcgtttgttttgaacacaagggacagtataaaggcacaatggattcgggccagaccaagagagagttgaaatctttcgacatctcccaatgccccaagattgggggacacggttcaaagaaatgtacgggcgatgccgcattttgcagtgcctacgaatgtactgctcagtatgcgaatgcatactgcagccatgccaacgggtccggaatcgtgcagatccaagtctctggcgtgtggaagaaaccgctatgtgtaggttatgagagggttgtggtcaagcgggaactgagcgctaaacctattcagcgtgtggagccctgcacaacctgtataactaagtgcgagccacacgggctcgtcgtgcgctcaacaggcttcaagatcagttccgccgttgcatgcgccagcggagtgtgtgtaaccggctctcagtcacctagtacggaaattaccctgaaataccccgggatcagccagtcctctggaggtgacataggcgtccatatggctcacgatgaccaatcggtgagctccaagattgttgcccattgcccaccccaggacccttgtcttgtgcacgggtgcatcgtctgtgcacacggactgatcaattatcagtgccatacagcgttgtcagctttcgtggtaatttttgtgttcagttctactgccatcatttgtctcgcagttctgtacagagtcttaaaatgcctgaagatagccccaaggaaagtgctaaacccgctcatgtggatcaccgcttttattcggtgggtgtacaagaaaatggtcgcccgagttgcagataacatcaatcaggtgaaccgcgagatcggctggatggaaggtgggcaactggctcttggcaatcccgcccctattccaagacacgcgcccatacctaggtatagcacatacttgatgctgctcctgatcgtgtcctatgcctcagcttgtagcgagcttattcaggcatcttcccggatcactacctgcagtacagagggagtaaacaccaagtgtcgcctgagcggcactgccttgattagagctgggtctgccggagcagaagcgtgcctcatgctgaagggtgtcaaagaggaccagacgaagttcttaaaaatcaagacagtgtcctcagaactgagttgcagggagggccagagctactggaccgggtcgttttccccaaaatgtctatctagccgtcggtgccatctcgttggagaatgtcacgtgaatcgatgcctgtcatggagagataacgagacttccgccgagttctcctttgtcggcgaatctaccacaatgagggagaataagtgtttcgaacaatgcggtgggtggggctgtggatgctttaacgtgaatcccagctgtcttttcgttcacacctatttgcagtccgtgcgcaaggaggctctgcgggtatttaactgcatagactgggtccataaactcactctggaaatcacagatttcgacggctcagtgagcacgattgatttaggggccagttcttccagatttaccaattggggaagcgtgtcgctgtcacttgacgcagagggcatctctggtagtaactccttcagcttcattgagtctccggggaagggatacgctatcgtcgatgaaccttttagcgagataccaaggcagggcttcttgggtgaaattcgctgtaattccgagtcaagtgttctcagcgcccacgaatcttgcctgcgagcacccaacctagtgtcctataaacctatgatcgaccagctggagtgcactacaaatctcattgatccctttgtagtgttcgagcggggctcactgccacaaacccgtaacgacaagacatttgccgctagtaaagggaacagaggagtccaggcgttcagcaagggctccgtgcaggccgatcttactttgatgtttgacaatttcgaagttgactttgtgggggcagctgtctcttgtgatgccgccttcctgaacttaaccggatgctactcgtgtaatgctggcgcaagggtgtgcctcagcatcacgtcaaccggtacagggactctgtccgcccataacaaggacggaagtcttcacatagttctgccttctgagaatggcaccaaagatcaatgtcagatcttgcattttacagtgcccgaagtcgaggaggagttcatgtacagctgcgacggtgatgagcgcccactcctggtaaagggcactctaattgcgatcgacccgtttgatgaccggagagaagctgggggagagtccaccgtggttaaccctaaatcaggctcttggaatttcttcgattggtttagcgggctgatgagttggttcggaggccccctcaagacgattctgcttatctgtttgtatgtggccctgtccataggtttatttttcctcctgatttaccttgggaggacaggactgagcaaaatgtggctagcagccaccaagaaggcttcttga

SEQ ID NO: 11124 - RNA, 3594 nt, synthetic construct
  misc_feature 1..3594: note = derived and/or modified CDS sequence (opt3) from RVFV(200803166)__JF311381.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaggaactgtcctgctctgtgtcgggtattcgcgaagtcaagacctcaagccaggagctatatcgagcactcaaagccatcattgcggctgacggactgaataacatcacatgtcacggcaagaatccagaggataaaataagtcttatcaaggggccgccccataaaaagcgtgtgggaattgttagatgcgaaaggcggcgcgacgccaagcaaatcggcagagagactatggcaggtattgccatgaccgtgctgcctgctttggcagtctttgccctcgctccagtggtattcgccgaagatccccacctgaggaaccggcctgggaaaggacataattacatcgacggcatgacacaggaggatgcgacctgtaagccagttacttatgcaggcgcctgctcctcttttgacgtgctgctcaaaaaggggaaattccccttatttcagagctacgctcaccatcgcacactgcttgaagccgtccacgataccataattgcaaaggctgaccctccatcctgtgatttgcagtcagcccacggaaacccgtgcatgaaggagaaactggtgatgaagacgcattgtcccaatgactatcaaagtgcgcactacctaaacaatgatggtaaaatggccagcgtgaagtgccctccaaaatatgagctcactgaagactgtaacttctgccgacagatgaccggcgcatctctgaagaaagggtcctacccccttcaggacctgttttgccagtcaagcgaggatgacggaagtaagttgaagacaaaaatgaagggcgtctgtgaagttggtgtgcaagctctcaaaaagtgcgatgggcagctgtctactgcccatgaggtagtgcctttcgctgtctttaaaaattccaagaaggtgtacttagacaaactggatctcaagaccgaagagaaccttctgccagacagcttcgtttgttttgagcacaaaggacagtataagggcacaatggattcgggccagaccaaaagagaattgaagtctttcgacatctcccaatgccccaagattgggggacacggtagtaaaaagtgtacgggcgatgccgcattttgctcagcctacgagtgtactgctcagtatgcgaatgcatactgcagccatgccaacgggtccggaatcgtgcagatccaagtctctggcgtgtggaaaaagccgctatgtgtaggttatgaaagggttgtggtcaaacgggagctgagcgctaagcctattcagcgtgtggaaccctgcacaacctgtataactaagtgcgagccacacgggctcgtcgtgcgctcaacaggcttcaaaatcagttccgccgttgcatgcgccagcggagtgtgtgtaaccggctctcagtcacctagtacggagattaccctgaagtaccccgggatcagccagtcctctggaggtgacataggcgtccatatggctcacgatgaccaatcggtgagctccaaaattgttgcccattgcccaccccaggacccttgtcttgtgcacgggtgcatcgtctgtgcacacggactgatcaattatcagtgccatacagcgttgtcagctttcgtggtagtgtttgttttcagttctattgccatcatttgtctcgcaatactgtacagagtcttaaagtgcctgaaaatcgccccaaggaaggtgctaaacccgctcatgtggattactgcttttatccggtgggtgtacaaaaagatggtcgcccgagttgcagataacatcaatcaggtgaaccgcgaaattggctggatggagggtgggcaactggtgcttggcaatcccgctcctataccaagacacgcccccatccctaggtatagcacctacttgatgctgctcctgattgtatcctatgcgacagcctgttcagaacttatccaggctagctctcggattactacctgctccacagagggagtcaacaccaagtgtcgcctgagtggcactgcattgatcagagccgggagcgtgggagctgaggcctgcctcatgctgaaaggtgttaaggaagaccagacgaaattcttaaagataaaaacagtgtcttccgagctgtcatgcagggaaggccagagttactggaccgggagcttttcgccaaagtgtctatcctctcgtcggtgccatctcgtcggagagtgtcacgtgaatcgatgcctgagctggagagataacgaaacttcagcagagttcagttttgttggcgagtccaccacaatgagggaaaataagtgtttcgagcaatgcggtgggtggggctgtggatgctttaacgtgaatccctcttgtcttttcgtacacacctatttgcagagcgtccgcaaagaagcgctgcgggtgtttaactgcatcgactgggtgcataagctcactctggagattacagatttcgacggctccgtctcaacgatcgatttaggggccagcagttctagatttaccaattggggatccgttagcctgtcgcttgacgctgaaggcatttcaggttctaacagtttctccttcatcgagagcccggggaaaggatacgccatagtggatgagcctttttctgaaattccaaggcagggcttcttgggtgagatccgctgtaatagcgaatcctcagtactcagtgcacacgagagctgcctgcgagctcccaacctaatttcttataagcctatgatcgaccagctggaatgcactacaaatctcatagatccctttgtggtcttcgagcggggctccctgccacaaacccgtaacgacaaaacatttgccgcatcaaaggggaacagaggagtgcaggccttcagtaagggcagcgttcaggctgatcttactttgatgtttgacaatttcgaggtggactttgtcggggcggccgtgtcctgtgatgcagctttcctgaacttaaccggatgctactcttgtaatgccggcgccagggtttgcctctcgatcacgagcaccggtacagggactctgtcagctcataacaaagacggatcccttcacgtggtcctgcctagtgaaaatggcaccaaggatcaatgtcagattttgcattttacagtacccgaggtggaagaggagttcatgtactcttgcgacggtgatgaacgcccactcctggttaaaggcactctaatcgcaattgacccgtttgatgaccggagagaggccgggggagaaagcaccgtggtcaaccctaagtccggctcatggaatttcttcgattggttttctgggctgatgagctggttcggaggccccctcaaaacgatcctgcttatatgtttgtatgtggcgctgagtattggtttatttttcctcctgatctaccttgggaggacaggactgtccaagatgtggctagctgccaccaagaaagcaagctga

SEQ ID NO: 11125 - RNA, 3594 nt, synthetic construct
  misc_feature 1..3594: note = derived and/or modified CDS sequence (opt3) from RVFV(2007001107)__EU574047.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctgtgtcggggattcgcgaagtcaagacctcaaatcaggagctatatcgagcactcaaagccatcattgcggctgacggtctgaacaatatcacatgtcacggcaagaacccagaggataaaataagccttatcaaggggccgccccataaaaagcgtgtgggaattgttagatgcgaaaggcggcgcgacgccaagcaaatcggcagagagactatggcaggtattgccatgaccgtgctgcctgctttggcagtctttgccctcgctccagtggtattcgccgaagatccccacctgaggaatcggcctgggaaaggacataactacatcgacggcatgacacaggaggatgcgacctgtaagccagttacttatgcaggcgcctgcagttcctttgacgtgctgctcgaaaaagggaagttccccttatttcagtcttacgctcaccatcgcacactgcttgaggccgtccacgataccataattgcaaaagctgaccctccaagctgtgatttgcagtccgcccacggaaatccgtgcatgaaggagaagctggtgatgaaaacgcattgtcccaacgactatcaatcagcgcactacctaaataacgatggtaagatggccagtgtgaaatgccctccaaagtatgaactcactgaggactgtaatttctgccgacagatgaccggcgcaagcctgaaaaaggggtcttacccccttcaggacctgttttgccagtcctcagaagatgacggaagcaaattgaagacaaagatgaaaggcgtctgtgaggttggtgtgcaagctctcaagaaatgcgatgggcagctgagtactgcccatgaagtagtgcctttcgctgtctttaagaactctaaaaaggtgtacttagacaagctggatctcaaaaccgaggagaatcttctgccagactccttcgtttgttttgaacacaagggacagtataaaggcacaatggatagcggccagaccaagagagagttgaaatcgttcgacatctctcaatgccccaagattgggggacacggttccaagaaatgtacgggcgatgccgcattttgctcagcctacgaatgtactgctcagtatgcgaacgcatactgcagtcatgccaatgggagcggaatcgtgcagatccaagtctccggcgtgtggaagaaaccgctatgtgtaggttatgagagggttgtggtcaagcgggaactgtctgctaaacctattcagcgtgtggagccctgcacaacctgtataactaagtgcgagccacacgggctcgtcgtgcgcagcacaggcttcaagatctcaagtgccgttgcatgcgcctccggagtgtgtgtaaccggcagccagtctccttcaacggaaattaccctgaaataccccgggatcagtcagagctccggaggtgacataggcgtccatatggctcacgatgaccaatctgtgtcgagcaagattgttgcccattgcccaccccaggacccttgtcttgtgcacgggtgcatcgtctgtgcacacggactgatcaactatcagtgccatacagcgttgtccgctttcgtggtaatttttgtgttctcaagtactgccatcatttgtctcgcagttctgtacagagtcttaaaatgcctgaagatagccccaaggaaagtgctaaacccgctcatgtggatcaccgcttttattcggtgggtgtacaagaaaatggtcgcccgagttgcagataatatcaaccaggtgaatcgcgagatcggctggatggaaggtgggcaactggctcttggcaaccccgcccctattccaagacacgcgcccatacctaggtattctacatacttgatgctgctcctgatcgtgagctatgcctccgcttgttcagagcttattcaggcaagctctcggatcactacctgctccacagagggagtaaataccaagtgtcgcctgagtggcactgccttgattagagctgggagcgtcggagccgaagcatgcctcatgctgaagggtgtgaaagaggaccagacgaagttcttaaaaatcaagacagtttcttccgaactgtcatgcagggagggccagagttactggaccgggagcttttcgccaaaatgtctatcctctcgtcggtgccatctcgtgggagaatgtcacgtcaaccgatgcctgagctggagagataatgagacttcagcggagttcagttttgtgggcgaatccaccacaatgagggagaacaagtgtttcgaacaatgcggtgggtggggctgtggatgctttaatgttaacccctcttgtcttttcgtgcacacctatttgcagagcgtacgcaaggaggccctgcgggtctttaattgcatagactgggtgcataaactcactctggaaatcacagatttcgacggctccgtgtcaacgattgatttaggggctagcagttctagatttaccaactggggatccgtcagcctgtcgcttgacgccgagggcatctcaggttctaatagtttctccttcattgagagcccggggaagggatacgcaatcgttgatgaacctttttctgagataccaaggcagggcttcttgggtgaaattcgctgtaacagcgagtcctcagtgctcagtgctcacgaaagctgcctgcgagcccccaatctagtatcttataaacctatgatcgaccagctggagtgcactacaaacctcattgatccctttgtggtcttcgagcggggctccctgccacaaacccgtaacgacaagacatttgcagcctcaaaagggaatagaggagtgcaggctttcagtaagggcagcgttcaggcggatcttactttgatgtttgacaacttcgaagtggactttgtcggggccgcagtgtcctgtgatgctgccttcctgaatttaaccggatgctactcttgtaacgccggcgctagggtttgcctctcgatcacgagcaccggtacagggactctgtcagcacataataaggacggatcccttcacatagtgctgcctagtgagaacggcaccaaagatcaatgtcagatcttgcattttacagtccccgaagtagaggaggagttcatgtactcttgcgacggtgatgagcgcccactcctggtgaagggcactctaattgccatcgacccgtttgatgaccggagagaagcgggaggagagagcaccgttgtgaatcctaaatccggctcatggaacttcttcgattggttttctgggctgatgagctggttcggaggccccctcaagacgattctgcttatctgtttgtatgtcgctctgagtataggtttatttttcctcctgatttaccttgggaggacaggactgtccaaaatgtggctagccgcaaccaagaaggccagctga

SEQ ID NO: 11126 - RNA, 3594 nt, synthetic construct
  misc_feature 1..3594: note = derived and/or modified CDS sequence (opt3) from RVFV(ANK-3837)__DQ380215.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctatttcgggaatccgcgaagtgaagacctcaagccaggagctatatcgagcactcaaagccattatcgcggctgacggtctgaataacataacatgtcacggcaaggatccagaggacaaaatcagtcttattaaggggccgccccataaaaagcgtgtcggaatcgtgagatgcgaaaggcggcgcgatgccaagcaaattggcagagagactatggcaggtatcgccatgaccgttctgcctgctttggcagtgtttgccctcgctccagtcgtgttcgccgaagacccccacctgaggaatcggcctgggaaaggacataactacatagatggcatgacacaggaggacgcgacctgtaagccagtaacttatgcaggcgcctgctcctcttttgatgttctgctcgaaaaagggaagttccccttatttcagagctacgctcaccatcgcacactgcttgaggccgtgcacgacaccattatcgcaaaagctgatcctccatcctgtgacttgcagtcagcccacggaaatccgtgcatgaaggagaagctggtcatgaaaacgcattgtcccaacgattatcaaagtgcgcactacctaaataacgacggtaagatggccagcgtgaaatgccctccaaagtatgaactcactgaggactgtaatttctgccgacagatgaccggcgcatctctgaaaaaggggtcctacccccttcaggatctgttttgccagtcaagcgaagacgatggaagtaaattgaagacaaagatgaaaggcgtgtgtgaggtcggtgttcaagctctcaagaaatgcgacgggcagctgtctactgcccatgaagtggtacctttcgctgtgtttaagaactccaaaaaggtctacttagataagctggacctcaaaaccgaggagaatcttctgccagatagcttcgtgtgttttgaacacaagggacagtataaaggcaagttggactcgggccagacaaaaagagagctaaagtctttcgatatttcccaatgccccaagatcgggggacacggtagtaaaaagtgtaccggcgacgccgcattttgctcagcctacgaatgtacggctcagtatgcgaacgcatactgcagccatgccaatgggtccggaatcgttcagattcaagtgtctggcgtctggaaaaagccgctgtgtgtgggttatgagagggtagttgtgaaacgggaactcagcgctaagcctatacagcgtgtcgagccctgcactacatgtatcaccaagtgcgagccacacgggctggtggtccgctcaactggcttcaaaattagttccgccgtggcatgcgccagcggagtttgtgtgacaggctctcagtcacctagtaccgaaatcacgcttaagtaccccgggataagccagtcctctggaggtgatattggcgtacatatggctcacgacgaccaatcggtcagctccaaaatcgtggcccattgcccaccccaggatccttgtctggttcacgggtgcatcgtgtgtgcacacggattgattaactatcagtgccataccgcgctctcagctttcgtcgtggtatttgtgttcagttctatcgccattatatgtctggcaatcttatacagagttctgaagtgcctaaaaattgccccaaggaaggtcctcaatccgctgatgtggatcacagcttttatccggtgggtgtaccgaaaaatggtggcccgcgtcgcagacaacattaaccaggttaatagagagataggctggatggaaggtgggcaacttgtgttgggcaaccccgctcctatcccaaggcacgtgcccattcctcggtatagcacttacctgatgctcctgcttatcgtatcctatgcctcagcgtgtagcgagctgattcaggcctcttcccgcatcaccacatgcagtactgagggagtcaataccaagtgtagattgagcggcacagctctcataagggcagggtctgtgggagccgaggcttgcctgatgttaaagggtgttaaagaggatcagaccaagttcctgaaaatcaagactgtgtcctcagaactaagttgccgtgagggccagagctactggacggggtcgttttccccaaaatgtctctctagccggcgatgccatctggtcggagaatgtcacgtgaacagatgcctttcatggagggacaatgagacaagtgccgagttctcctttgttggcgaatctaccactatgcgcgagaacaagtgtttcgaacaatgcggtgggtggggctgtggatgctttaatgtgaaccccagctgtttgttcgtacacacctatctgcagtccgtccggaaggaggcactcagagtgtttaattgcattgattgggtgcataaactgacattagaaatcaccgacttcgatggctcagtcagcactattgacctgggggcgagttcttccaggtttacaaactggggaagcgtttcgctttcattggatgccgagggcatctctggtagtaattccttcagcttcatagagtctccggggaagggatacgctattgtggacgaaccttttagcgagatcccacgccagggcttcctcggtgaaattcgatgtaactccgagtcaagtgtactgagcgcccacgaatcttgcctacgggcacccaatctgatctcctataaacctatgatagatcagctcgagtgcacgaccaacctgatcgacccctttgtggtcttcgagcgtggctcacttccacaaactagaaatgataagacatttgctgccagtaaagggaacaggggagtgcaggcattcagcaagggctccgttcaggccgacttgaccctgatgtttgacaacttcgaagtggattttgtcggggctgcggtgtcttgtgacgccgcattcttaaatctcacaggatgctactcgtgtaacgctggcgcccgcgtttgcctgagcattacttcaaccggtacggggaccctttccgcccataataaggatggaagtctgcacatcgtgttgccttctgagaacggcacaaaagaccaatgtcagattctccattttactgtccccgaagtagaggaggagttcatgtacagctgcgatggtgacgaacggccactgctagtgagaggcaccctgatcgctatagatccgtttgacgataggcgagaagcagggggagagtccacagttgtgaatcctaagtcaggctcttggaacttcttcgactggtttagcgggctcatgagttggttcggaggccccctgaaaactattcttttgatctgtctgtatgtcgccttatccatcggtctctttttcctgcttatttacctggggcgcaccggactaagcaagatgtggctcgcggctacgaaaaaggcctcttga

SEQ ID NO: 11127 - RNA, 3594 nt, synthetic construct
  misc_feature 1..3594: note = derived and/or modified CDS sequence (opt3) from RVFV(OS-1)__DQ380186.1__GP
  source 1..3594: mol_type = other RNA
atgtacgtgctgctcacaatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctatttcgggaatccgcgaagtgaagacctcaagccaggagctatatcgagcactcaaagccattatcgcggctgacggtctgaataacataacatgtcacggcaaggatccagaggacaaaatcagtcttattaaggggccgccccataaaaagcgtgtcggaatcgtgagatgcgaaaggcaacgggatgccaagcagattggccgcgagactatggcaggtatcgccatgaccgttctgcctgctttggcagtgtttgccctcgctccagtcgtgttcgccgaagacccccacctgagaaataggcctgggaaaggacataactacatagatggcatgacacaggaggacgcgacctgtaagccagtaacttatgcaggcgcctgctcctcttttgatgttctgctcgaaaaagggaagttccccttatttcagagctacgctcaccatcggacactgcttgaggccgtgcacgacaccattatcgcaaaagctgatcctccatcctgtgacttgcaatcagcccacggaaatccgtgcatgaaggagaagctggtcatgaaaacgcattgtcccaacgattatcagagtgcgcactacctaaataacgacggtaagatggccagcgtgaaatgccctccaaagtatgaactcactgaggactgtaatttctgccgccagatgaccggcgcatctctgaaaaaggggtcctacccccttcaggatctgttttgccaatcaagcgaagacgatggaagtaaattgaagacaaagatgaaaggcgtgtgtgaggtcggtgttcaggctctcaagaaatgcgacgggcagctgtctactgcccatgaagtggtacctttcgctgtgtttaagaactccaaaaaggtctacttagataagctggacctcaaaaccgaggagaatcttctgccagatagcttcgtgtgttttgaacacaagggacagtataaaggcacaatggactcgggccaaaccaagcgagagttgaaatctttcgatatttcccagtgccccaagatcgggggacacggttcaaagaaatgtacgggcgacgccgcattttgcagtgcctacgaatgtactgctcagtatgcgaacgcatactgcagccatgccaatgggtccggagttgtgcaaatccaggtctctggcgtgtggaagaaaccgctatgtgtaggttatgagagagttgtggtcaagagggaactgagcgctaaacctattcagcgggtggagccctgcacaacctgtataactaagtgcgagccacacgggctcgtcgtgcgttcaacaggcttcaagatcagttccgccgttgcatgcgccagcggagtgtgtgtaaccggctctcagtcacctagtacggaaattaccctgaaataccccgggatcagccaatcctctggaggtgatataggcgtccatatggctcacgacgaccagtcggtgagctccaagattgttgcccattgcccaccccaggatccttgtcttgtgcacgggtgcatcgtctgtgcacacggactgatcaactatcagtgccatacagcgttgtcagctttcgtggtagtgtttgttttcagttctgtcgccattatctgtctcgcaattctgtacaaagtgttaaagtgcctgaaaatagccccacgcaaggtgctaaatccgctcatgtggatcactgcttttattagatgggtctacaaaaagatggttgccagggtggcagacaacatcaaccaagtgaatcgggagatcggctggatggaaggtgggcagctggctcttggcaaccccgcccctattccacgacacgcgcccatacctcgctatagcacctacttgatgctgctcctgatcgtatcctatgcctcagcttgtagcgagcttattcaggcatcttccagaatcacaacttgcagtaccgagggagtcaatacaaagtgtaggctgagcggcaccgccttgattcgggctgggtctgtgggagccgaagcatgcctcatgctgaaaggtgttaaggaggatcagactaaattcttaaagatcaaaacggtgtcctcagaactgagttgccgcgagggccaaagctactggacagggtcgttttccccaaagtgtctatctagcagaaggtgccatctcgtcggagaatgtcacgtgaaccgttgcctgtcatggcgggacaatgagaccagtgcggagttctcctttgttggcgaatctactaccatgcgagagaacaagtgtttcgaacagtgcggtgggtggggctgtggatgctttaatgtgaaccccagctgtcttttcgtacacacatatttgcagtccgtcagaaaagaggccctgaaggtgtttaattgcatagattgggtgcataaactcaccctggaaatcactgacttcgatggctcagtcagcacaattgacttaggggctagttcttccaggtttacgaactggggaagcgtttcgctgtcacttgatgccgagggcatctctggtagtaattccttcagcttcattgagtctccggggaagggatacgcaatcgtggacgaaccttttagcgagataccacgccagggcttcttgggtgaaattcggtgtaactccgagtcaagtgtactcagcgctcacgaatcttgcctgagagcccccaatctaatctcctataaacctatgattgatcaactggagtgcaccactaacctcatcgacccctttgtggtcttcgagaggggctcactgccacagacacgcaatgataagacctttgcagccagtaaggggaaccgaggagtgcaggctttcagcaaaggctccgttcaagcggaccttacattgatgtttgacaacttcgaagtggattttgtcggggccgcagtgtcttgtgacgctgccttcctgaatttaactggatgctactcgtgtaacgccggcgctcgggtttgcctcagcataacctcaacgggtaccgggacactgtccgcacataataaggatggaagtcttcacatcgtgctgccttctgagaacggcactaaagaccagtgtcagattttgcattttaccgtccccgaagtagaggaggagttcatgtacagctgcgatggtgacgagcgtccactcctggtgaagggcacactaatcgccattgatccgtttgacgatagaagggaagctgggggagagtccactgttgtgaatcctaaatcaggctcttggaacttcttcgactggtttagcgggctgatgagttggttcggaggccccctcaagaccatcctgcttatatgtttgtatgtcgcgctgtccattggtttatttttcctcctgatctaccttgggcgcacgggactgagcaagatgtggctagccgcaaccaaaaaggcctcttga

SEQ ID NO: 11128 - RNA, 3594 nt, synthetic construct
  misc_feature 1..3594: note = derived and/or modified CDS sequence (opt3) from RVFV(Sudan 2V-2007)__JQ820490.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctgtgtcgggtattcgcgaagtcaagacctcaagccaggagctatatcgagcactcaaagccatcattgcggctgacggactgaataacatcacatgtcacggcaagaatccagaggataaaataagtcttatcaaggggccgccccataaaaagcgtgtgggaattgttagatgcgaaaggcggcgcgacgccaagcaaatcggcagagagactatggcaggtattgccatgaccgtgctgcctgctttggcagtctttgccctcgctccagtggtattcgccgaagatccccacctgaggaaccggcctgggaaaggacataattacatcgacggcatgacacaggaggatgcgacctgtaagccagttacttatgcaggcgcctgctcctcttttgacgtgctgctcgaaaaagggaagttccccttatttcagagctacgctcaccatcgcacactgcttgaggccgtccacgataccataattgcaaaagctgaccctccatcctgtgatttgcagtcagcccacggaaacccgtgcatgaaggagaagctggtgatgaaaacgcattgtcccaatgactatcaaagtgcgcactacctaaacaatgatggtaagatggccagcgtgaaatgccctccaaagtatgaactcactgaggactgtaacttctgccgacagatgaccggcgcatctctgaaaaaggggtcctacccccttcaggacctgttttgccagtcaagcgaagatgacggaagtaaattgaagacaaagatgaaaggcgtctgtgaggttggtgtgcaagctctcaagaaatgcgatgggcagctgtctactgcccatgaagtagtgcctttcgctgtctttaaaaattccaagaaggtgtacttagacaagctggatctcaaaaccgaggagaaccttctgccagacagcttcgtttgttttgaacacaagggacagtataaaggcacaatggattcgggccagaccaagagagagttgaaatctttcgacatctcccaatgccccaagattgggggacacggttcaaagaaatgtacgggcgatgccgcattttgcagtgcctacgaatgtactgctcagtatgcgaatgcatactgcagccatgccaacgggtccggaatcgtgcagatccaagtctctggcgtgtggaagaaaccgctatgtgtaggttatgagagggttgtggtcaagcgggaactgagcgctaaacctattcagcgtgtggagccctgcacaacctgtataactaagtgcgagccacacgggctcgtcgtgcgctcaacaggcttcaagatcagttccgccgttgcatgcgccagcggagtgtgtgtaaccggctctcagtcacctagtacggaaattaccctgaaataccccgggatcagccagtcctctggaggtgacataggcgtccatatggctcacgatgaccaatcggtgagctccaagattgttgcccattgcccaccccaggacccttgttcagtgcacgggtgcatcgtctgtgcacacggacttatcaattatcagtgccatacagcgctgagtgctttcgtggtagtgtttgttttctctagcattgccatcatttgtttggcaatactctacagagtcctgaaatgcttaaagatcgccccaaggaaagtgctgaacccgctaatgtggattactgcttttatccggtgggtgtacaagaaaatggtcgcccgagttgcagataacatcaatcaggtgaaccgcgagattggctggatggaaggtgggcaactcgtgctgggcaatcccgctcctataccaagacacgcccccatccctaggtattccacctaccttatgttgctgctcattgtatcacatgcgagcgcctgttctgagctgatccaggcttccagtcggattacaacttgcagcaccgagggagtcaacacaaagtgtcgcctttctggcaccgcactgatcagagccgggtccgtgggagctgaagcctgcttgatgctcaagggtgttaaagaggaccagactaagttcctgaaaataaagacggtgtcaagtgaattaagctgcagggagggccagtcgtattggacagggtccttttctccaaaatgtctgagctcacgtcggtgccacctagtcggagaatgtcacgtgaatcgatgcctcagttggagagataacgagacctccgcagagttctcttttgttggcgaaagcactaccatgagggagaataagtgtttcgaacaatgcggtgggtggggctgtggatgctttaacgtgaatccctcctgtctgttcgtacatacataccttcagtcagtccgcaaggaggcgttgcgggtgtttaactgcatcgactgggtgcacaaactgaccctcgaaattactgatttcgacggcagcgtcagtacaatcgatctgggggcctcttccagcagatttacgaattggggatcggtttcattatctctggacgctgagggcattagtggttccaacagcttctctttcatcgagagcccggggaagggatatgccatagtggatgaacctttttccgagattccaaggcagggcttccttggtgaaatccgctgtaattcagagagtagcgtattgtctgcacatgaatcctgcctccgagctcccaacctgatttcatacaaacctatgatcgaccagctagagtgcaccactaatctgatagatccctttgtggtcttcgagcggggcagtctcccacaaacacgtaacgacaagacctttgccgcaagcaaagggaacagaggagtgcaggccttctccaagggctctgttcaggctgatctgacacttatgtttgacaatttcgaagtggactttgtcggggcggccgtgtcgtgtgatgcagctttcttgaacctgactggatgctatagctgtaatgccggcgccagggtttgcttatcaatcacctccacgggtaccgggacactcagtgctcacaacaaggacggatctctgcatattgtgcttcctagcgagaatggcactaaagatcaatgtcagatcctgcactttaccgtccccgaagtagaggaggagttcatgtactcctgcgacggtgatgagcgcccattgctcgtgaagggcacactgatggcaattgacccgtttgatgaccggagagaagccgggggagagtcaactgttgtgaaccctaaatctggcagctggaatttcttcgattggtttagtgggctaatgtcctggttcggaggccccctgaagaccatcctcctgatatgtctttacgtcgcgttgagcattggtctgtttttcttactcatctatctggggaggacgggactttctaaaatgtggctggctgccacaaagaaggcatcatga

SEQ ID NO: 11129 - RNA, 3594 nt, synthetic construct
  misc_feature 1..3594: note = derived and/or modified CDS sequence (opt3) from RVFV(200803162)__JF311377.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctgtgtcgggtattcgcgaagtcaagacctcaagccaggagctatatcgagcactcaaagccatcattgcggctgacggactgaataacatcacatgtcacggcaagaatccagaggataaaataagtcttatcaaggggccgccccataaaaagcgtgtgggaattgttagatgcgaaaggcggcgcgacgccaagcaaatcggcagagagactatggcaggtattgccatgaccgtgctgcctgctttggcagtctttgccctcgctccagtggtattcgccgaagatccccacctgaggaaccggcctgggaaaggacataattacatcgacggcatgacacaggaggatgcgacctgtaagccagttacttatgcaggcgcctgctcctcttttgacgtgctgctcgaaaaagggaagttccccttatttcagagctacgctcaccatcgcacactgcttgaggccgtccacgataccataattgcaaaagctgaccctccatcctgtgatttgcagtcagcccacggaaacccgtgcatgaaggagaagctggtgatgaaaacgcattgtcccaatgactatcaaagtgcgcactacctaaacaatgatggtaagatggccagcgtgaaatgccctccaaagtatgaactcactgaggactgtaacttctgccgacagatgaccggcgcatctctgaaaaaggggtcctacccccttcaggacctgttttgccagtcaagcgaagatgacggaagtaaattgaagacaaagatgaaaggcgtctgtgaggttggtgtgcaagctctcaagaaatgcgatgggcagctgtctactgcccatgaagtagtgcctttcgctgtctttaaaaattccaagaaggtgtacttagacaagctggatctcaaaaccgaggagaaccttctgccagacagcttcgtttgttttgaacacaagggacagtataaaggcacaatggattcgggccagaccaagagagagttgaaatctttcgacatctcccaatgccccaagattgggggacacggttcaaagaaatgtacgggcgatgccgcattttgcagtgcctacgaatgtactgctcagtatgcgaatgcatactgcagccatgccaacgggtccggaatcgtgcagatccaagtctctggcgtgtggaagaaaccgctatgtgtaggttatgagagggttgtggtcaagcgggaactgagcgctaaacctattcagcgtgtggagccctgcacaacctgtatagccaagtgcgagccacacgggctcgtcgtgcgctcaactggcttcaagatcagttccgcagttgcctgcgctagcggagtgtgtgtaacaggctctcagtcacctagtaccgaaattacgctgaaataccccgggatcagccagtcctctggaggtgacataggcgtccatatggcccacgatgaccaatcggtgagctccaagattgttgcacattgcccaccccaggacccttgtcttgtgcacgattgcatcgtctgtgcgcacgggctgatcaattatcagtgccataccgctttgtcagccttcgtggtaatttttgtgttcagttctacagcaatcatttgtctcgccgttctgtacagagtcttaaaatgcctgaagatagctccaaggaaagtgctaaacccgctcatgtggatcactgcctttattcggtgggtgtacaagaaaatggtcgcacgagttgctgacaacatcaatcaggtgaaccgcgagatcggatggatggaaggcggtcaactggcccttagaaatcccgcgcctattccaaggcacgcccccatacctcggtatagcacctacttgatgctgctcctgatcgtgtcctatgcttcagcatgtagcgagcttattcaggcctcttcccgcatcacaacttgcagtaccgagggggtaaacacaaagtgtagactgagcggcaccgctttgattagggccggatctgtcggcgcagaagcgtgcctcatgctgaagggggtgaaagaggatcagactaagttcttaaaaatcaagacggtttcctcagaactgagttgccgtgagggacagagctactggacaggttcgttttccccaaaatgtctatctagccggcgatgccatctcgtgggcgaatgtcacgtcaatagatgcctgtcatggagggacaacgagaccagtgccgagttctcctttgtgggggaatctactaccatgcgcgagaataagtgtttcgaacaatgcggaggctggggttgtgggtgctttaacgttaatcccagctgtcttttcgtgcacacatatttgcagtccgtacggaaggaggctctgagagtctttaactgcatagattgggtgcataaactcaccctggaaatcactgacttcgatggctcagtgagcacaattgacttaggagccagttcttccaggtttacgaattggggcagcgtctcgctgtcacttgatgcagaggggatctctggaagtaactccttcagcttcattgagtctccgggcaagggttacgctatcgttgacgaaccttttagcgagataccacgccaggggttcttgggagaaattcgatgtaattccgagtcaagtgtgctcagcgcccacgaatcttgcctgcgggcacccaacctagtatcctataaacctatgatcgatcagctggagtgcaccactaatctcattgacccctttgtggtcttcgagcgtggctcactgccacaaacaagaaacgataagacctttgccgctagtaaaggtaacaggggcgtgcaggcgttcagcaaggggtccgttcaggccgaccttacattgatgtttgacaatttcgaagtggattttgtcggagcagctgtgtcttgtgacgccgccttcctgaacttaactggctgctactcgtgtaatgctggggcacgcgtttgcctcagcatcacctcaacgggaaccggcacactgtccgcccataacaaggatggtagtcttcacatagtgctgccttctgagaatgggactaaagaccaatgtcagatcttgcattttaccgtccccgaagtagaggaggagttcatgtacagctgcgatggagacgagcggccactcctggtgaagggcacactaattgcgatcgatccgtttgacgatagaagggaagctggtggcgagtccactgttgtgaaccctaaatcagggtcttggaatttcttcgactggtttagcggactgatgagttggttcggcgggcccctcaagaccattctgcttatctgtttgtatgtcgccctgtccataggattatttttcctcctgatttaccttggccgaacgggtctgagcaaaatgtggctagcagccacaaagaaggcttcttga

SEQ ID NO: 11130 - RNA, 3594 nt, synthetic construct
  misc_feature 1..3594: note = derived and/or modified CDS sequence (opt3) from RVFV(2007001811)__EU574040.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctgtgtcgggtattcgcgaagtcaagacctcaagccaggagctatatcgagcactcaaagccatcattgcggctgacggactgaataacatcacatgtcacggcaagaatccagaggataaaataagtcttatcaaggggccgccccataaaaagcgtgtgggaattgttagatgcgaaaggcggcgcgacgccaagcaaatcggcagagagactatggcaggtattgccatgaccgtgctgcctgctttggcagtctttgccctcgctccagtggtattcgccgaagatccccacctgaggaaccggcctgggaaaggacataattacatcgacggcatgacacaggaggatgcgacctgtaagccagttacttatgcaggcgcctgctcctcttttgacgtgctgctcgaaaaagggaagttccccttatttcagagctacgctcaccatcgcacactgcttgaggccgtccacgataccataattgcaaaagctgaccctccatcctgtgatttgcagtcagcccacggaaacccgtgcatgaaggagaagctggtgatgaaaacgcattgtcccaatgactatcaaagtgcgcactacctaaacaatgatggtaagatggccagcgtgaaatgccctccaaagtatgaactcactgaggactgtaacttctgccgacagatgaccggcgcatctctgaaaaaggggtcctacccccttcaggacctgttttgccagtcaagcgaagatgacggaagtaaattgaagacaaagatgaaaggcgtctgtgaggttggtgtgcaagctctcaagaaatgcgatgggcagctgtctactgcccatgaagtagtgcctttcgctgtctttaaaaattccaaaaaggtgtacttagacaagctggatctcaaaaccgaggagaaccttctgccagacagcttcgtttgttttgaacacaagggacagtataaaggcacaatggattcgggccagaccaagagagagttgaaatctttcgacatctcccaatgccccaagattgggggacacggttcaaagaaatgtacgggcgatgccgcattttgcagtgcctacgaatgtactgctcagtatgcgaatgcatactgcagccatgccaacgggtccggaatcgtgcagatccaagtctctggcgtgtggaagaaaccgctatgtgtaggttatgagagggttgtggtcaagcgggaactgagcgctaaacctattcagcgtgtggagccctgcacaacctgtataactaagtgcgagccacacgggctcgtcgtgcgctcaacaggcttcaagatcagttccgccgttgcatgcgccagcggagtgtgtgtaaccggctctcagtcacctagtacggaaattaccctgaaataccccgggatcagccagtcctctggaggtgacataggcgtccatatggctcacgatgaccaatcggtgagctccaagattgttgcccattgcccaccccaggacccttgtcttgtgcacgggtgcatcgtctgtgcacacggactgatcaattatcagtgccatacagcgttgtcagctttcgtggtagtgtttgttttcagttctattgccatcatttgtctcgcaatactgtacagagtcttaaaatgcctgaagatcgccccaaggaaagtgctaaacccgctcatgtggattactgcttttatccggtgggtgtacaagaaaatggtcgcccgagttgcagataacatcaatcaggtgaaccgcgagattggctggatggaaggtgggcaactggtgcttggcaatcccgctcctataccaagacacgcccccatccctaggtatagcacctacttgatgctgctcctgattgtatcctatgcgtcagcctgtagcgagcttatccaggcttcttcccggattacaacttgcagtaccgagggagtcaacacaaagtgtcgcctgagcggcaccgcattgatcagagccgggtctgtgggagctgaagcctgcctcatgctgaagggtgttaaagaggaccagactaagttcttaatgataaaaacggtgtcctcagaactgagttgcagggagggccagagctactggacagggtcgttttccccaaagtgtctatctagccgtcggtgccatctcgtcggagaatgtcacgtgaatcgatgcctgtcatggagagataacgagaccagtgcagagttctcctttgttggcgaatctactaccatgagggagaataaatgtttcgaacaatgcggtgggtggggctgtggatgctttaacgtgaatcccagctgtcttttcgtacacacatatttgcagtccgtccgcaaggaggcgctgcgggtgtttaactgcatcgactgggtgcataagctcaccctggaaattactgatttcgacggctcagtcagcacaatcgatttaggggccagttcttccagatttacgaattggggaagcgtttcgctgtcacttgacgctgagggcatttctggtagtaactccttcagcttcatcgagtctccggggaaaggatacgccatagtggatgaaccttttagcgagattccaaggcagggcttcttgggtgaaatccgctgtaattccgagtcaagtgtactcagcgcacacgaatcttgcctgcgagctcccaacctaatttcctataagcctatgatcgaccagctggagtgcaccactaatctcatagatccctttgtggtcttcgagcggggctcactgccacaaacacgtaacgagaaaacctttgccgcaagtaaggggaacagaggagtgcaggccttcagcaaaggctccgttcaggctgaccttacattgatgtttgataatttcgaggtggactttgtcggggcggccgtgtcttgtgacgcagctttcctgaacttaactggatgctactcgtgtaatgccggcgccagggtttgcctcagcatcacctcaacgggtaccgggacactgtccgctcataacaaggatggaagtcttcacattgtgctgccttctgaaaatggcactaaggaccaatgtcagatcttgcattttaccgtccccgaggtagaggaagagttcatgtacagctgcgatggtgacgaacgcccactcctggtgaaaggcacactaattgcaatcgatccgtttgacgatcggagagaggccgggggagaatccactgttgtgaaccctaagtcaggctcttggaatttcttcgactggtttagcgggctgatgagttggttcggaggccccctcaaaaccatactgcttatttgtttgtatgtcgcgctgtccatcggtttatttttcctcctgatctaccttgggaggacgggactgagcaagatgtggctagctgccacaaagaaggcatcttga

SEQ ID NO: 11131 - RNA, 3594 nt, synthetic construct
  misc_feature 1..3594: note = derived and/or modified CDS sequence (opt3) from RVFV(clone 13)__DQ380213.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctatttcgggaatccgcgaagtgaagacctcaagccaggagctatatcgagcactcaaagccattatcgcggctgacggtctgaataacataacatgtcacggcaaggatccagaggacaaaatcagtcttattaaggggccgccccataaaaagcgtgtcggaatcgtgagatgcgaaaggcggcgcgatgccaagcaaattggcagagagactatggcaggtatcgccatgaccgttctgcctgctttggcagtgtttgccctcgctccagtcgtgttcgccgaagacccccacctgaggaatcggcctgggaaaggacataactacatagatggcatgacacaggaggacgcgacctgtaagccagtaacttatgcaggcgcctgctcctcttttgatgttctgctcgaaaaagggaagttccccttatttcagagctacgctcaccatcgcacactgcttgaggccgtgcacgacaccattatcgcaaaagctgatcctccatcctgtgacttgcagtcagcccacggaaatccgtgcatgaaggagaagctggtcatgaaaacgcattgtcccaacgattatcaaagtgcgcactacctaaataacgacggtaagatggccagcgtgaaatgccctccaaagcatgaactcactgaggactgtaatttctgccgacagatgaccggcgcatctctgaaaaaggggtcctatccccttcaggatctgttttgccagtcaagcgaagacgatggaagtaaattgaagacaaagatgaaaggcgtgtgtgaggtcggtgttcaagctctcaagaaatgcgacgggcagctgtctactgcccacgaagtggtacctttcgctgtgtttaagaactccaaaaaggtctacttagataagctggacctcaaaaccgaggagaatcttctgccagatagcttcgtgtgttttgaacacaagggacagtacaaaggcacaatggactcgggccagaccaagagagagttgaaatctttcgatatttcccaatgccccaagatcgggggacatggttcaaagaaatgtacgggcgacgccgcattttgcagtgcctatgaatgtactgctcagtacgcgaacgcatattgcagccacgccaatgggtccggaatcgttcagattcaagtgtctggcgtctggaagaaaccgctatgtgtgggttacgagagggtagttgtgaagcgggaactgagcgctaaacctatacagcgtgtcgagccctgcacaacctgtatcactaagtgcgagccacatgggctcgtggtccgctcaacaggcttcaagattagttccgccgtggcatgcgccagcggagtttgtgtgaccggctctcagaacccttcaacggaaatcaccctgaaatatcccgggataagtcagagctccggaggtgatattggcgtacacatggctcatgacgaccaatctgtctcgagcaagatcgtggcccactgcccaccccaggatccttgtcttgttcacgggtgcatcgtgtgtgcacatggactgattaattaccagtgccacacagcgttgtccgctttcgtcgtggtatttgtgttctcaagtatcgccattatatgtctcgcaatcctgtatagagttttaaaatgcctgaagattgccccaaggaaagtcctaaacccgctcatgtggatcactgcttttatccggtgggtgtacaagaaaatggtggcccgagtcgcagacaacattaatcaggttaaccgcgagataggctggatggaaggtgggcaactggtgcttggcaatcccgctcctatcccaagacatgcccccattcctaggtactctacctatttgatgctgctcctgatcgtgagctacgcgtccgcctgttcagagcttattcaggctagctctcggatcacaacttgctccaccgagggagtaaacacaaagtgtcgcctgagtggcaccgcattgataagagccgggagcgtcggagctgaagcctgcctcatgctgaagggtgtgaaagatgaccagactaagttcttaaaaatcaagacggtttcttccgagctgtcatgcagggaaggccagagttattggacagggagcttttcgccaaaatgtctatcctctcgtcggtgccacctcgtgggagagtgtcacgtcaatcgatgcctgagctggagagataacgaaacctcagcagagttcagttttgtgggcgagtccactaccatgagggaaaataagtgtttcgagcaatgcggtgggtggggctgtggatgctttaacgttaatccctcttgtcttttcgtgcatacatacttgcagagcgtacgcaaggaagcgctgcgggtctttaactgcattgactgggtgcacaaactcaccctggagatcactgatttcgacggctccgtgtcaacaattgatttaggggccagcagttctagatttacgaattggggatccgtcagcctgtcgcttgacgctgaaggcatctcaggttctaacagtttctccttcatagagagcccggggaagggatatgccattgttgatgagcctttttctgaaatcccaaggcagggcttcttgggtgagattcgctgtaatagcgaatcctcagtgctcagtgcacatgagagctgcctgcgagctcccaacctaatctcttacaaacctatgatagaccagctggaatgcaccactaatctcatcgatccctttgtagtgttcgagcggggctccctgccacaaacacgtaacgagaagacctttgccgcatcaaaagggaacagaggagtccaggccttcagtaagggcagcgtgcaggctgaccttacattgatgtttgacaatttcgaagttgattttgtgggggcggccgtctcctgtgacgcagctttcctgaacttaactggatgctattcttgtaatgccggcgccagggtgtgcctctcgattaccagcacgggtaccgggacactgtcagctcacaacaaggatggatcccttcatatcgttctgcctagtgagaatggcactaaagaccaatgtcagattttgcactttaccgtgcccgaagtcgaggaggagttcatgtactcttgcgatggtgacgagcgcccactcctggtaaagggcacactaatcgcaatagatccgtttgacgatcggagagaagccgggggagagagcactgtggttaaccctaaatccggctcatggaatttcttcgactggttttctgggctgatgagctggttcggaggccccctcaagaccattctgcttatctgtttgtacgtggcgctgagtatcggtttatttttcctcctgatttatcttgggaggacgggactgtccaaaatgtggctagctgccacaaagaaggcaagctga

SEQ ID NO: 11132 - RNA, 3594 nt, synthetic construct
  misc_feature 1..3594: note = derived and/or modified CDS sequence (opt3) from RVFV(MP12)__Z30318.1__GP
  source 1..3594: mol_type = other RNA
atgtacgtgctgctcaccatccttacaagcgtcctggtttgcgaggccattataagagtgtccttgtcttcaactagggaagagacgtgtttcggcgacagtaccaaccccgaaatgatcgagggggcttgggatagcttacgggaagaggagatgcctgaggaactgtcctgctctatttcgggaatccgcgaagtaaagacatcaagccaggagctatatcgagcactcaaagccattatcgcggctgacggtctgaataacataacttgtcacggcaaggatccagaggacaaaatcagtcttattaaggggccgccccataaaaagcgtgtgggaatcgtcagatgcgaaaggcggcgcgatgccaagcaaattggcagaaaaaccatggcaggtatcgccatgacagtgctgcctgctttggcagtttttgccctcgctccagtggtcttcgccgaggacccccacctgaggaatcggcctgggaagggacataactacatagatggcatgacccaggaagacgcgacttgtaaaccagtgacatatgcaggcgcctgctcctcttttgatgtactgctcgagaaggggaaattccccttatttcagagctacgctcaccatcgcaccctgcttgaagccgttcacgacacgattatcgcaaaggctgatcctccatcctgtgacttgctgtcagcccacggaaatccgtgcatgaaggagaagctagtgatgaaaactcattgtcccaacgattatcagagtgcgcaccatctcaataacgacggtaaaatggccagcgtcaagtgccctccaaaatacgagctgaccgaagactgtaatttctgccgacaaatgacaggcgcatctcttaagaaagggtcctatcccctgcaggatttgttttgccagtcaagcgaggacgatggaagtaagctcaagactaaaatgaagggcgtgtgtgaagtgggtgtccaggctctgaaaaagtgcgacgggcaattatctaccgcccacgaggttgtgcctttcgctgtatttaaaaactccaagaaggtgtacctggataaactcgaccttaagacagaagagaatctgttgccagatagcttcgtctgttttgagcacaaaggacagtacaagggcaccatggactcgggccagacgaaaagagaactaaagtctttcgatatttcccagtgccccaagatcgggggacatggtagtaaaaagtgtactggcgacgccgcattttgcagtgcctatgagtgtacagctcaatacgcgaacgcatattgcagccacgccaatgggtccggaatcgtgcagattcaggtttctggcgtgtggaaaaagccgctgtgtgtcggttacgaaagggtggtagttaaacgggagctcagcgctaagcctatacaacgtgtggaaccctgcaccacttgtatcacaaagtgcgagccacatgggctggtcgtgcgctcaaccggcttcaaaattagttccgccgtcgcatgcgccagcggagtgtgtgttacgggctctcagtcacctagtaccgagatcacacttaagtatcccgggataagccagtcctctggaggtgatattggcgtgcacatggctcatgacgaccagtcggtaagctccaaaatcgtcgcccactgcccaccccaagatccttgtctggtgcacgactgcatcgtttgtgcacatgggttgattaactaccagtgccacactgcgctctcagctttcgtggtcgtgtttgtattcagttctatcgccattatatgtctggcaatcttatatagagtgctgaagtgcctaaaaattgccccaaggaaggttctcaatccgctgatgtggatcaccgcttttatccggtggatttacaaaaagatggtcgcccgagtggcacataacataaaccaggtgaatcgcgaaatcggatggatggagggcggtcagcttgtcttggggaaccccgctcctattccaagacacgcccccatccctaggtacagcacatatctgatgctcctgcttattgtttcctacgcgtcagcctgtagcgaactgatccaggcttcttcccggataactacctgcagtacagagggcgtgaataccaagtgtcgcttgagcggaactgcactcatcagagccggctctgtgggggctgaggcctgcctgatgttaaaaggagtaaaggaagatcaaacgaaattcctgaagctaaaaacagtctcctcagagctcagttgcagggaaggtcagagctattggaccggctcgttttccccaaagtgtctgtctagccgtcggtgccaccttgtgggggagtgtcatgttaaccgatgcttgtcatggagagacaatgaaacttcagcagagttctcctttgtgggagagtctaccacaatgagggaaaacaagtgtttcgagcagtgcggcggttgggggtgtggctgctttaatgtcaaccccagctgtctgttcgtgcacacctacctccaatccgttcgcaaagaagcgctgcgggtgtttaattgcattgattgggtacataagttaactctggagatcacagacttcgatggatcagtcagcacgattgaccttggcgccagttcttccagatttaccaactgggggagcgtgtcgttgtcactcgatgctgaaggaatctctggcagtaattccttcagcttcatagagtctccgggtaaagggtatgccattgtggacgagccttttagcgaaatcccaaggcagggattcctgggcgagattcgctgtaactccgaatcaagtgtcctaagcgcacacgagtcttgcctgcgagctcccaatctcatctcctacaagcctatgatagatcagctggaatgcactacaaaccttatcgacccctttgttgtgttcgagcggggttcattgccacagacccgtaatgataaaacatttgccgcaagtaagggcaacagaggggtacaagccttcagcaagggatccgtgcaggctgacctgactttaatgtttgacaacttcgaggtcgattttgtgggcgcggccgtttcttgtgacgcagctttcctcaatctgaccgggtgctattcgtgtaacgccggagccagggtgtgccttagcattacgtcaaccggcacaggttccctgagtgctcataataaagatgggtctttgcacatcgtcctccctagcgaaaacggaactaaggaccagtgtcaaattctgcactttaccgtgcccgaggttgaagaggagttcatgtactcctgcgatggcgacgaacgcccactactggtgaaaggtacactcatcgcaatagatccgtttgacgatcggagagaggccggcggggaatcaactgtcgtaaatcctaagtctggaagctggaacttcttcgactggtttagtggcctgatgtcctggttcgggggaccccttaaaaccattttgctgatctgtttatacgtggcgctcagcatcggcctgtttttccttctgatttatctaggtgggacgggactctctaagatgtggctggctgccacaaagaaagcatcatga

SEQ ID NO: 11133 - RNA, 3594 nt, synthetic construct
  misc_feature 1..3594: note = derived and/or modified CDS sequence (opt3) from RVFV__JQ068143.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctatttcgggaatccgcgaagtgaagacctcaagccaggagctatatcgagcactcaaagccattatcgcggctgacggtctgaataacataacatgtcacggcaaggatccagaggacaaaatcagtcttattaaggggccgccccataaaaagcgtgtcggaatcgtgagatgcgaaaggcggcgcgatgccaagcaaattggcagagagactatggcaggtatcgccatgaccgttctgcctgctttggcagtgtttgccctcgctccagtcgtgttcgccgaagacccccacctgaggaatcggcctgggaaaggacataactacatagatggcatgacacaggaggacgcgacctgtaagccagtaacttatgcaggcgcctgctcctcttttgatgttctgctcgaaaaagggaagttccccttatttcagagctacgctcaccatcgcacactgcttgaggccgtgcacgacaccattatcgcaaaagctgatcctccatcctgtgacttgcagtcagcccacggaaatccgtgcatgaaggagaagctggtcatgaaaacgcattgtcccaacgattatcaaagtgcgcactacctaaataacgacggtaagatggccagcgtgaaatgccctccaaagtatgaactcactgaggactgtaatttctgccgacagatgaccggcgcatctctgaaaaaggggtcctacccccttcaggatctgttttgccagtcaagcgaagacgatggaagtaaattgaagacaaagatgaaaggcgtgtgtgaggtcggtgttcaagctctcaagaaatgcgacgggcagctgtctactgcccatgaagtggtacctttcgctgtgtttaagaactccaaaaaggtctacttagataagctggacctcaaaaccgaggagaatcttctgccagatagcttcgtgtgttttgaacacaagggacagtataaaggcacaattgactcgggccagaccaagagagagttgaaatctttcgatatctcccaatgccccaagatcgggggacacggttcaaagaaatgtacgggcgacgccgcattttgcagtgcctacgaatgtactgctcagtatgcgaacgcatactgcagccatgccaatgggtccggaattgttcagatacaagtgtctggcgtctggaagaaaccgctatgtgtgggttatgagagggtagttgtgaagcgggaactgagcgctaaacctatccagcgtgtcgagccctgcacaacctgtattactaagtgcgagccacacgggctcgtggtccgctcaacaggcttcaagatcagttccgccgtggcatgcgccagcggagtttgtgtgaccggctctcagtcacctagtacggaaataaccctgaaataccccgggattagccagtcctctggaggtgatatcggcgtacatatggctcacgacgaccaatcggtcagctccaagatcgtggcccattgcccaccccaggatccttgtcttgttcacgggtgcattgtgtgtgcacacggactgatcaactatcagtgccatacagcgttgtcagctttcgtcgtggtatttgtgttcagttctgttgccattatatgtctcgcaatcctgtacaaagtcttaagatgcctgaagattgccccgaaaaaggtgctaaatccactcatgtggatcactgcttttatcaggtgggtgtacaaaaagatggtcgcccgggttgcagacaacattaaccaggtgaatcgagagataggctggatggaaggtgggcaactggctcttggcaaccccgcccctatcccacgccacgcgcccattcctagatatagcacctacttgatgctgctcctgatcatttcctatgcctcagcttgtagcgagcttatccaggcatcttccaggataacaacttgcagtaccgagggagtgaatacaaagtgtcggctgagcggcaccgccttgatccgcgctgggtctgtaggagccgaagcatgcctcatgctgaaaggtgtcaaggaggatcagactaaattcttaaagattaaaacggtgtcctcagaactgagttgcagagagggccagagctactggacagggtcgttttccccaaagtgtctatctagcaggcgttgccatctcgttggagaatgtcacgtgaaccggtgcctgtcatggcgagacaatgagaccagtgcggagttctcctttgtcggcgaatctactaccatgagagagaacaagtgtttcgaacaatgcggtgggtggggctgtggatgctttaatgtgaaccccagctgtcttttcgttcacacatatttgcagtccgtgaggaaagaggccctgcgcgtatttaattgcatcgattgggtccataagctcaccctggaaattactgacttcgatggctcagtgagcacaatcgacttaggggctagttcttcccggtttacgaactggggaagcgtgtcgctgtcacttgatgccgagggcatatctggtagtaattccttcagcttcattgagtctccggggaaaggatacgcaatcgtcgacgaaccttttagcgagattccaagacagggcttcttgggtgaaatcaggtgtaactccgagtcaagtgttctcagcgctcacgaatcttgcctgcgcgcccccaatctaatatcctataagcctatgatcgatcagctggagtgcaccactaacctcattgacccctttgtggtattcgagcgaggctcactgccacaaacacggaatgataaaacctttgcagccagtaaggggaaccgtggagtgcaggctttcagcaagggctccgtccaggcggaccttacattgatgtttgacaacttcgaagtggattttgttggggccgcagtgtcttgtgacgctgccttcctgaatttaactggatgctactcgtgtaacgccggcgctagagtctgcctcagcatcacctcaacgggtaccgggacactgtccgcacataataaagatggaagtcttcacattgtgctgccttctgagaacggcactaaggaccaatgtcagatcttgcattttaccgttcccgaagtggaggaggagttcatgtacagctgcgatggtgacgagaggccactcctggtcaaaggcacactaatagccattgatccgtttgacgatcgccgggaagctgggggagagtccactgtagtgaatcctaagtcaggctcttggaacttcttcgactggtttagcgggctgatgagttggttcggaggccccctcaaaaccatcctgcttatctgtttgtatgttgcgctgtccattggtttatttttcctcctgatctaccttgggagaacgggactgagcaagatgtggctagccgcaacaaagaaagcctcttga

SEQ ID NO: 11134 - RNA, 3594 nt, synthetic construct
  misc_feature 1..3594: note = derived and/or modified CDS sequence (opt3) from RVFV(2007002445)__EU574037.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaggaactgtcctgctctgtgtcggggattcgcgaagtcaagacctcaagccaggagctatatcgagcactcaaagccatcattgcggctgacggtctgaataacatcacatgtcacggcaagaatccagaggataaaataagtcttatcaaggggccgccccataaaaagcgtgtgggaattgttagatgcgaaaggcggcgcgacgccaagcaaatcggcagagagactatggcaggtattgccatgaccgtgctgcctgctttggcagtctttgccctcgctccagtggtattcgccgaagatccccacctgaggaaccggcctgggaaaggacataattacatcgacggcatgacacaggaggatgcgacctgtaagccagttacttatgcaggcgcctgctcctcttttgacgtgctgctcgaaaaagggaagttccccttatttcagagctacgctcaccatcgcacactgcttgaggccgtccacgataccataattgcaaaagctgaccctccatcctgtgatttgcagtcagcccacggaaacccgtgcatgaaggagaagctggtgatgaaaacgcattgtcccaatgactatcaaagtgcgcactacctaaacaatgatggtaagatggccagcgtgaaatgccctccaaagtatgaactcactgaggactgtaacttctgccgacagatgaccggcgcatctctgaaaaaggggtcctacccccttcaggacctgttttgccagtcaagcgaagatgacggaagtaaattgaagacaaagatgaaaggcgtctgtgaggttggtgtgcaagctctcaagaaatgcgatgggcagctgtctactgcccatgaagtagtgcctttcgctgtctttaagaatagtaaaaaggtgtacttagacaagctggatctcaaaaccgaggagaaccttctgccagacagcttcgtttgttttgaacacaagggacagtataaaggcacaatggattcgggccagaccaagagagagttgaaatctttcgacatctcccaatgccccaagattgggggacacggttcaaagaaatgtacgggcgatgccgcattttgcagtgcctacgaatgtactgctcagtatgcgaatgcatactgcagccatgccaacgggtccggaatcgtgcagatccaagtctctggcgtgtggaagaaaccgctatgtgtaggttatgagagggttgtggtcaagcgggaactgagcgctaaacctattcagcgtgtggagccctgcacaacctgtataactaagtgcgagccacacgggctcgtcgtgcgctcaacaggcttcaagatcagttccgccgttgcatgcgccagcggagtgtgtgtaaccggctctcagtcacctagtacggaaattaccctgaaataccccgggatcagccagtcctctggaggtgacataggcgtccatatggctcacgatgaccaatcggtgagctccaagattgttgcccattgcccaccccaggacccttgtcttgtgcacgggtgcatcgtctgtgcacacggactgatcaattatcagtgccatacagcgttgtcagctttcgtggtaatttttgtgttcagttctactgccatcatttgtctcgcagttctgtacagagtcttaaaatgcctgaagatagccccaaggaaagtgctaaacccgctcatgtggatcaccgcttttattcggtgggtgtacaagaaaatggtcgcccgagttgcagataacatcaatcaggtgaaccgcgagatcggctggatggaaggtgggcaactggctcttggcaatcccgcccctattccaagacacgcgcccatacctaggtatagcacatacttgatgctgctcctgatcgtgtcctatgcctcagcttgtagcgagcttattcaggcatcttcccggatcactacctgcagtacagagggagtaaacaccaagtgtcgcctgagcggcactgccttgattagagctgggtctgtcggagccgaagcatgcctcatgctgaagggtgtgaaagaggaccagacgaagttcttaaaaatcaagacagtttcctcagaactgagttgcagggagggccagagctactggaccgggtcgttttccccaaaatgtctatctagccgtcggtgccatctcgtgggagaatgtcacgtcaatcgatgcctgtcatggagagataacgagacttccgcggagttctcctttgtgggcgaatctaccacaatgagggagaataagtgtttcgaacaatgcggtgggtggggctgtggatgctttaacgttaatcccagctgtcttttcgtgcacacctatttgcagtccgtacgcaaggaggccctgcgggtctttaactgcatagactgggtgcataaactcactctggaaatcacagatttcgacggctcagtgagcacgattgatttaggggctagttcttccagatttaccaattggggaagcgtctcgctgtcacttgacgccgagggcatctctggtagtaactccttcagcttcattgagtctccggggaagggatacgcaatcgttgatgaaccttttagcgagataccaaggcagggcttcttgggtgaaattcgctgtaattccgagtcaagtgtgctcagcgctcacgaatcttgcctgcgagcccccaacctagtatcctataaacctatgatcgaccagctggagtgcactacaaatctcattgatccctttgtggtcttcgagcggggctcactgccacaaacccgtaacgaaaagacatttgcagccagtaaagggaacagaggagtgcaggctttcagcaagggctccatccaggcggaccttactttgatgtttgataatttcgaggttgactttgtgggggccgcagtctcttgtgacgctgccttcctgaacttaaccggatgctactcgtgtaatgccggcgctagggtgtgcctcagcataacgtcaaccggtacagggactctgtccgcacataacaaggatggaagtcttcacatcgttctgccttctgaaaatggcaccaaagaccaatgtcagattttgcattttacagtgcccgaggtcgaggaagagttcatgtacagctgcgatggtgacgaacgcccactcctggtaaagggcactctaatcgccattgatccgtttgacgatcggagagaggcgggaggagaatccaccgtggttaaccctaaatcaggctcttggaatttcttcgactggtttagcgggctgatgagttggttcggaggccccctcaagacgatcctgcttatatgtttgtatgtggctctgtccattggtttatttttcctcctgatctaccttgggaggacaggactgagcaaaatgtggctagccgcaaccaagaaggcctcttga

SEQ ID NO: 11135 - RNA, 3594 nt, synthetic construct
  misc_feature 1..3594: note = derived and/or modified CDS sequence (opt3) from RVFV(2008/00101)__HE687306.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctgtgtcggggattcgcgaagtcaagacctcaagccaggagctatatcgagcactcaaagccatcattgcggctgacggtctgaataacatcacatgtcacggcaagaatccagaggataaaataagtcttatcaaggggccgccccataaaaagcgtgtgggaattgttagatgcgaaaggcggcgcgacgccaagcaaatcggcagagagactatggcaggtattgccatgaccgtgctgcctgctttggcagtctttgccctcgctccagtggtattcgccgaagatccccacctgaggaaccggcctgggaaaggacataattacatcgacggcatgacacaggaggatgcgacctgtaagccagttacttatgcaggcgcctgctcctcttttgacgtgctgctcgaaaaagggaagttccccttatttcagagctacgctcaccatcgcacactgcttgaggccgtccacgataccataattgcaaaagctgaccctccatcctgtgatttgcagtcagcccacggaaacccgtgcatgaaggagaagctggtgatgaaaacgcattgtcccaatgactatcaaagtgcgcactacctaaacaatgatggtaagatggccagcgtgaaatgccctccaaagtatgaactcactgaggactgtaacttctgccgacagatgaccggcgcatctctgaaaaaggggtcctacccccttcaggacctgttttgccagtcaagcgaagatgacggaagtaaattgaagacaaagatgaaaggcgtctgtgaggttggtgtgcaagctctcaagaaatgcgatgggcagctgtctactgcccatgaagtagtgcctttcgctgtctttaagaatagtaaaaaggtgtacttagacaagctggatctcaaaaccgaggagaaccttctgccagacagcttcgtttgttttgaacacaagggacagtataaaggcacaatggattcgggccagaccaagagagagttgaaatctttcgacatctcccaatgccccaagattgggggacacggttcaaagaaatgtacgggcgatgccgcattttgcagtgcctacgaatgtactgctcagtatgcgaatgcatactgcagccatgccaacgggtccggaatcgtgcagatccaagtctctggcgtgtggaagaaaccgctatgtgtaggttatgagagggttgtggtcaagcgggaactgagcgctaaacctattcagcgtgtggagccctgcacaacctgtataactaagtgcgagccacacgggctcgtcgtgcgctcaacaggcttcaagatcagttccgccgttgcatgcgccagcggagtgtgtgtaaccggctctcagtcacctagtacggaaattaccctgaaataccccgggatcagccagtcctctggaggtgacataggcgtccatatggctcacgatgaccaatcggtgagctccaagattgttgcccattgcccaccccaggacccttgtcttgtgcacgggtgcatcgtctgtgcacacggactgatcaattatcagtgccatacagcgttgtcagctttcgtggtaatttttgtgttcagttctactgccatcatttgtctcgcagttctgtacagagtcttaaaatgcctgaagatagccccaaggaaagtgctaaacccgctcatgtggatcaccgcttttattcggtgggtgtacaagaaaatggtcgcccgagttgcagataacatcaatcaggtgaaccgcgagatcggctggatggaaggtgggcaactggctcttggcaatcccgcccctattccaagacacgcgcccatacctaggtatagcacatacttgatgctgctcctgatcgtgtcctatgcctcagcttgtagcgagcttattcaggcatcttcccggatcactacctgcagtacagagggagtaaacaccaagtgtcgcctgagcggcactgccttgattagagctgggtctgtcggagccgaagcatgcctcatgctgaagggtgtgaaagaggaccagacgaagttcttaaaaatcaagacagtttcctcagaactgagttgcagggagggccagagctactggaccgggtcgttttccccaaaatgtctatctagccgtcggtgccatctcgtgggagaatgtcacgtcaatcgatgcctgtcatggagagataacgagacttccgcggagttctcctttgtgggcgaatctaccacaatgagggagaataagtgtttcgaacaatgcggtgggtggggctgtggatgctttaacgttaatcccagctgtcttttcgtgcacacctatttgcagtccgtacgcaaggaggccctgcgggtctttaactgcatagactgggtgcataaactcactctggaaatcacagatttcgacggctcagtgagcacgattgatttaggggctagttcttccagatttaccaattggggaagcgtctcgctgtcacttgacgccgagggcatctctggtagtaactccttcagcttcattgagtctccggggaagggatacgcaatcgttgatgaaccttttagcgagataccaaggcagggcttcttgggtgaaattcgctgtaattccgagtcaagtgtgctcagcgctcacgaatcttgcctgcgagcccccaacctagtatcctataaacctatgatcgaccagctggagtgcactacaaatctcattgatccctttgtggtcttcgagcggggctcactgccacaaacccgtaacgacaagacatttgcagccagtaaagggaacagaggagtgcaggctttcagcaagggctccgttcaggcggatcttactttgatgtttgacaatttcgaagtggactttgtcggggccgcagtgtcttgtgatgctgccttcctgaacttaaccggatgctactcgtgtaatgccggcgctagggtttgcctcagcatcacgtcaaccggtacagggactctgtccgcacataacaaggacggaagtcttcacatagtgctgccttctgagaatggcaccaaagatcaatgtcagatcttgcattttacagtccccgaagtagaggaggagttcatgtacagctgcgacggtgatgagcgcccactcctggtgaagggcactctaattgccatcgacccgtttgatgaccggagagaagcgggaggagagtccaccgttgtgaaccctaaatcaggctcttggaatttcttcgattggtttagcgggctgatgagttggttcggaggccccctcaagacgacactgcttatttgtttgtatgtcgctctgtccatcggtttatttttcctcctgatataccttgggaggaccggactgagcaaaatgtggctagccgcaactaagaaggcctcttga

SEQ ID NO: 11136 - RNA, 3594 nt, synthetic construct
  misc_feature 1..3594: note = derived and/or modified CDS sequence (opt3) from RVFV(Hv-B375)__DQ380218.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaaggagagatgcctgaggaactgtcctgctctatttcgggtatccgcgaggtgaagacctcaagccaggaactatatcgagcactcaaagccattatcgcggctgacggcctgaataacataacatgtcacgggaaggatccagaggacaaaatcagtcttattaagggaccgccccataaaaagcgtgtcggcatcgtgagatgcgagaggcggcgcgatgccaagcaaattggtagagaaactatggcagggatcgccatgaccgttctgcctgctttggcagtgtttgccctcgctccagtcgtgttcgccgaggacccccacctgaggaatcggcctggaaaaggccataactacatagatggcatgacacaggaagacgcgacctgtaagccagtaacttatgcaggggcctgctcctcttttgatgttctgctcgagaaaggaaagttccccttatttcagagctacgctcaccatcgcacactgcttgaagccgtgcacgacaccattatcgcaaaagctgatcctccatcctgtgacttgcagtcagcccacggtaatccgtgcatgaaggagaagctggtcatgaaaacgcattgtcccaacgattatcaaagtgcgcactacctaaataacgacggcaagatggccagcgtgaaatgccctccaaagaatgagctcactgaagactgtaacttctgccgacagatgaccggggcatctctgaaaaagggatcctatccccttcaggatctgttttgccagtcaagcgaggacgatggcagtaaattgaagacaaagatgaaaggtgtgtgtgaagtcggggttcaagctctcaagaaatgcgacggacagctgtctactgcccatgaggtggtacctttcgctgtgtttaaaaattccaagaaggtctacttagataagctggacctcaaaaccgaagagaaccttctgccagatagcttcgtgtgttttgagcacaagggccagtacaaaggcacaatggactcggggcagaccaagagagaattgaaatctttcgatatttcccaatgccccaagatcggaggtcacggctcaaagaaatgtacgggggacgccgcattttgcagtgcctatgagtgtactgctcagtacgcgaatgcatattgcagccatgccaacggatccggcatcgttcagattcaagtgtctggtgtctggaagaaaccgctatgtgtggggtacgaaagggtagttgtgaagcgggagctgagcgctaaacctatacagcgtgtcgaaccctgcacaacctgtatcactaagtgcgagccacacggcctcgtggtccgctcaacaggattcaagattagttccgccgtggcatgcgccagcggcgtttgtgtgaccgggtctcagtcacctagtacggagatcaccctgaaatatcccggaataagccagtcctctggtggcgatattggggtacatatggctcacgacgaccaatcggtcagctccaagatcgtggcccattgcccaccccaggatccttgtcttgttcacggatgcatcgtgtgtgcacacggcctgattaattaccagtgccatacagcgttgtcagctttcgtcgtggtatttgtgttcagttctatcgccattatatgtctcgcaatcctgtatagagttttaaaatgcctgaagattgccccaaggaaagtcctaaacccgctcatgtggatcactgcttttatccggtgggtgtacaagaaaatggtggcccgagtcgcagacaacattaatcaggttaaccgcgaaataggttggatggaagggggccaactggtgcttggaaatcccgctcctatcccaagacacgcccccattcctaggtacagcacctatttgatgctgctcctgatcgtgtcctacgcgtcagcctgtagcgagcttattcaggcttcttcccggatcacaacttgcagtaccgagggcgtaaacacaaagtgtcgcctgagcgggaccgcattgataagagccggatctgtcggtgctgaggcctgcctcatgctgaagggcgtgaaagaagatcagactaagttcttaaaaatcaagacggtttcctcagagctgagttgcagggaagggcagagctattggacaggatcgttttccccaaaatgtctatctagccgtcggtgccatctcgtgggcgagtgtcacgtcaatcgatgcctgtcatggagagacaacgaaaccagtgcagagttctcctttgtgggtgagtctactaccatgagggaaaataagtgtttcgagcaatgcgggggctggggatgtggctgctttaacgttaatcccagctgtcttttcgtgcacacatacttgcagtccgtacgcaaggaagcgctgcgggtctttaactgcattgattgggtgcataaactcaccctggagatcactgacttcgatgggtcagtgagcacaattgacttaggagccagttcttccagatttacgaattggggcagcgtctcgctgtcacttgatgctgaaggtatctctgggagtaactccttcagcttcatagagtctccgggaaagggctatgccattgttgacgagccttttagcgaaatcccaaggcagggtttcttgggcgagattcgctgtaattccgaatcaagtgtgctcagcgcacacgagtcttgcctgcgagctcccaacctaatctcctacaaacctatgatagatcagctggaatgcaccactaatctcatcgacccctttgtagtgttcgagcgggggtcactgccacaaacacgtaacgataagacctttgccgcaagtaaaggaaacagaggcgtccaggccttcagcaaggggtccgtgcaggctgaccttacattgatgtttgacaatttcgaggttgattttgtgggagcggccgtctcttgtgacgcagctttcctgaacttaactggctgctattcgtgtaatgccggtgccagggtgtgcctcagcattacctcaacggggaccggaacactgtccgctcataacaaggatggcagtcttcacatcgttctgccttctgaaaatggtactaaagaccaatgtcagattttgcattttaccgtgcccgaggtcgaagaggagttcatgtacagctgcgatggcgacgaacgcccactcctggtaaaggggacactaatcgcaatagatccgtttgacgatcggagagaggccggaggcgaatccactgtggttaaccctaaatcagggtcttggaatttcttcgactggtttagcggactgatgagttggttcggcggtcccctcaagaccattctgcttatctgtttgtacgtggcgctgtccatcgggttatttttcctcctgatttatcttggaaggacgggcctgagcaaaatgtggctagctgccacaaagaaggcatcttga

SEQ ID NO: 11137 - RNA, 3594 nt, synthetic construct
  misc_feature 1..3594: note = derived and/or modified CDS sequence (opt3) from RVFV(763/70)__DQ380188.1__GP
  source 1..3594: mol_type = other RNA
atgtacgtgctgctcaccatccttattacagtcctggtttgcgaggccgtgataagagtaagcctgtcctctactagggaagagacgtgtttcggcgactcaaccaaccccgaaatgatcgagggggcttgggatagtttacgggaagaggagatgcctgaagagttgagctgctccatttctggaatccgcgaagtgaagacatcgtcacaggagctatatcgagcactcaaagccattatcgcggctgacggtctgaataacataacttgtcacggcaaggatccagaggacaaaatcagccttgtcaaggggccgccccataaaaagcgtgtgggaattgttagatgcgaaaggcggcgcgatgccaagcaaatcggcagagagaccatggcaggtattgccatgacagtgctgcctgctttggcagtctttgccctcgctccagtggtattcgccgaagacccccacctgaggaatcggcctgggaaaggacataactacatcgatggcatgacccaggaggacgcgacttgtaagccagttacatatgcaggcgcctgcagttcctttgatgtgctgctcgaaaaagggaagttccccttatttcagtcttacgctcaccatcgcaccctgcttgaggccgtccacgacacgataattgcaaaagctgatcctccaagctgtgacttgcagtccgcccacggaaatccgtgcatgaaggagaagctggtgatgaaaactcattgtcccaacgattatcaatcagcgcactacctaaataacgacggtaagatggccagtgtgaaatgccctccaaagtatggcctcaccgaagactgtaatttctgccgacagatgacaggggcaagcctgaaaaagggatcttacccccttcaggatctgttttgccagtcctcagaggacgatggcagcaaattgaagactaagatgaaaggtgtctgtgaagttggggtgcaagctctcaagaaatgcgacggacagctgagtaccgcccatgaggtagtgcctttcgctgtctttaagaactctaaaaaggtgtacttagataagctggacctcaaaacagaagagaatcttctgccagattccttcgtttgttttgagcacaagggccagtataaaggcaccatggacagcgggcagacgaagagagaattgaaatcgttcgatatctctcaatgccccaagattggaggtcacggctccaagaaatgtactggggacgccgcattttgctcagcctacgagtgtacagctcagtatgcgaacgcatactgcagtcatgccaatggaagcggcatcgtgcagatccaagtctccggtgtgtggaagaaaccgctatgtgtagggtatgaaagggttgtggtcaagcgggagctgtctgctaaacctattcagcgtgtggaaccctgcaccacttgtataacaaagtgcgagccacacggcctcgtcgtgcgcagcaccggattcaagatctcaagtgccgttgcatgcgcctccggcgtgtgtgtaacggggagccagtctccttcaaccgagattacactgaaataccccggaatcagtcagagctccggtggcgatataggggtccatatggctcacgacgaccaatctgtgtcgagcaagattgttgcccattgcccaccccaggatccttgtcttgtgcacggatgcatcgtctgtgcacacggcctgatcaactatcagtgccatactgcgttgtccgctttcgtggtagtgtttgttttctcaagtgtcgccattatctgtctcgcaattctgtacaaagtgttaaagtgcctgaaaatagccccaagaaaggtgctaaatccgctcatgtggatcaccgcttttattaggtgggtctacaaaaagatggttgcccgggtggcagacaacatcaaccaggtgaatcgagaaatcggttggatggagggaggccaactggctcttggaaaccccgcccctattccacgccacgcgcccatacctagatattctacatacttgatgctgctcctgatcgtaagctatgcctccgcttgttcagaacttattcaggcaagctctaggatcactacctgctccacagagggcgtcaataccaagtgtcggctgagtgggactgccttgattcgcgctggaagcgtgggtgccgaggcatgcctcatgctgaaaggcgttaaggaagatcagacgaaattcttaaagatcaaaacagtgtcttccgagctgtcatgcagagaagggcagagttactggaccgggagcttttcgccaaagtgtctatcctctaggcgttgccatctcgtcggcgagtgtcacgtgaaccggtgcctgagctggcgagacaatgaaacttcagcggagttcagttttgttggtgagtccaccacaatgagagaaaacaagtgtttcgagcaatgcgggggctggggatgtggctgctttaatgtgaacccctcttgtcttttcgtacacacctatttgcagagcgtcaggaaagaagccctgcgcgtgtttaattgcatagattgggtgcataagctcactctggagatcacagacttcgatgggtccgtctcaacgattgacttaggagctagcagttctcggtttaccaactggggctccgttagcctgtcgcttgatgccgaaggtatctcagggtctaatagtttctccttcattgagagcccgggaaaaggctacgcaatcgtggacgagcctttttctgaaataccaagacagggtttcttgggcgagattaggtgtaacagcgaatcctcagtactcagtgctcacgagagctgcctgcgcgcccccaatctaatctcttataagcctatgattgatcagctggaatgcactacaaacctcatcgacccctttgtggtcttcgagcgagggtccctgccacaaacccggaatgataaaacatttgcagcctcaaagggaaaccgtggcgtgcaggctttcagtaaggggagcgttcaggcggaccttactttgatgtttgacaacttcgaggtggattttgtcggagccgcagtgtcctgtgacgctgccttcctgaatttaaccggctgctactcttgtaacgccggtgctagagtttgcctctcgataacgagcaccgggacaggaactctgtcagcacataataaagatggctcccttcacatcgtgctgcctagtgaaaacggtaccaaggaccaatgtcagattttgcattttacagtccccgaggtagaagaggagttcatgtactcttgcgatggcgacgaaaggccactcctggtgaaagggactctaatcgccattgatccgtttgacgatcgccgggaggcgggaggcgaaagcaccgttgtgaatcctaagtccgggtcatggaacttcttcgactggttttctggactgatgagctggttcggcggtcccctcaaaacgatcctgcttatatgtttgtatgtcgctctgagtattgggttatttttcctcctgatctaccttggaagaacaggcctgtccaagatgtggctagccgcaaccaagaaagccagctga

SEQ ID NO: 11138 - RNA, 3594 nt, synthetic construct
  misc_feature 1..3594: note = derived and/or modified CDS sequence (opt3) from RVFV(RVFBJ01/2016)__KX785331.1__GP
  source 1..3594: mol_type = other RNA
atgtacgtgctgctcaccatccttattagcgtcctggtttgcgaggccataatcagagtgtccttgtcttcaacaagggaagagacttgtttcggcgacagtacgaaccccgaaatgattgagggggcttgggatagcttacgggaagaggagatgcctgaagaactgtcctgctctatctcggggattcgcgaagtaaagacctcaagccaggagctatatcgagcactcaaagccatcatagcggctgacggtctgaataacatcacatgtcacggcaaggatccagaggacaaaattagtcttatcaaggggccgccccataaaaagcgtgtgggaattgtcagatgcgaaaggcggcgcgatgccaagcaaatcggcagagagactatggcaggtatagccatgaccgtgctgcctgctttggcagtttttgccctcgctccagtggtcttcgccgaagacccccacctgaggaatcggcctgggaaaggacataactacattgatggcatgacacaggaggacgcgacctgtaagccagtgacttatgcaggcgcctgctcctcttttgatgtactgctcgaaaaagggaagttccccttatttcagagctacgctcaccatcgcacactgcttgaggccgttcacgacaccatcattgcaaaagctgatcctccatcctgtgacttgcagtcagcccacggaaatccgtgcatgaaggagaagctggtgatgaaaacgcattgtcccaacgattatcaaagtgcgcactacctaaataacgacggtaagatggccagcgtcaaatgccctccaaagcatgaactcactgaggactgtaatttctgccgacagatgaccggcgcatctctgaaaaaggggtcctatccccttcaggatctgttttgccagtcaagcgaagacgatggaagtaaattgaagacaaagatgaaaggcgtgtgtgaggtgggtgtccaagctctcaagaaatgcgacgggcagctgtctactgcccacgaagttgtgcctttcgctgtatttaagaactccaaaaaggtgtacttagataagctggacctcaaaaccgaggagaatcttctgccagatagcttcgtctgttttgaacacaagggacagtacaaaggcacaatggactcgggccagaccaagagagagttgaaatctttcgatatctcccaatgccccaagatcgggggacatggttcaaagaaatgtacgggcgacgccgcattttgcagtgcctatgaatgtactgctcagtacgcgaacgcatattgcagccacgccaatgggtccggaattgtgcagatacaagtttctggcgtgtggaagaaaccgctatgtgtcggttacgagagggtggtagttaagcgggaactgagcgctaaacctatccagcgtgtggagccctgcacaacctgtattactaagtgcgagccacatgggctcgtcgtgcgctcaacaggcttcaagatcagttccgccgtcgcatgcgccagcggagtgtgtgttaccggctctcagtcacctagtacggaaataaccctgaaatatcccgggattagccagtcctctggaggtgatatcggcgtgcacatggctcatgacgaccaatcggtaagctccaagatcgtcgcccactgcccaccccaggatccttgtcttgtgcacgggtgcattgtttgtgcacatggactgatcaactaccagtgccacacagcgttgtcagctttcgtggtcgtgtttgtattcagttctgtggccattatatgtctcgcaatcctgtataaagttttaagatgcctgaagattgccccgaaaaaggtcctaaatccactcatgtggatcactgcttttatcaggtgggtgtacaaaaagatggtggcccgggtcgcagacaacattaaccaggttaatcgagagataggctggatggaaggtgggcaactggctcttggcaaccccgcccctatcccacgccatgcgcccattcctagatacagcacctatttgatgctgctcctgatcatttcctacgcctcagcttgtagcgagcttatccaggcatcttccaggataacaacttgcagtaccgagggagtgaatacaaagtgtcggctgagcggcaccgccttgatccgcgctgggtctgtgggagccgaagcatgcctcatgctgaaaggtgtaaaggaggatcagactaaattcttaaagattaaaacggtctcctcagaactgagttgcagagagggccagagctattggacagggtcgttttccccaaagtgtctatctagcaggcgttgccacctcgtgggagaatgtcacgttaaccggtgcctgtcatggcgagacaatgagaccagtgcggagttctcctttgtgggcgaatctactaccatgagagagaacaagtgtttcgaacaatgcggtgggtggggctgtggatgctttaatgtcaaccccagctgtcttttcgtgcatacatacttgcagtccgttaggaaagaggccctgcgcgtgtttaattgcatcgattgggtacacaagctcaccctggaaattactgacttcgatggctcagtcagcacaatcgacttaggggctagttcttcccggtttacgaactggggaagcgtgtcgctgtcacttgatgccgagggcatatctggtagtaattccttcagcttcattgagtctccggggaaaggatatgcaatcgtggacgaaccttttagcgagattccaagacagggcttcttgggtgaaatcaggtgtaactccgagtcaagtgtcctcagcgctcatgaatcttgcctgcgcgcccccaatctaatatcctacaagcctatgatcgatcagctggagtgcaccactaacctcattgacccctttgttgtgttcgagcgaggctcactgccacaaacacggaatgataaaacctttgcagccagtaaggggaaccgtggagtacaggctttcagcaagggctccgtgcaggcggaccttacattgatgtttgacaacttcgaagtcgattttgtgggggccgcagtttcttgtgacgctgccttcctgaatttaactggatgctattcgtgtaacgccggcgctagagtgtgcctcagcatcacctcaacgggtaccgggacactgtccgcacacaataaagatggaagtcttcatattgtcctgccttctgagaacggcactaaggaccaatgtcagatcttgcactttaccgtgcccgaagttgaggaggagttcatgtacagctgcgatggtgacgagaggccactcctggtgaaaggcacactaatagccattgatccgtttgacgatcgccgggaagcgggaggagagtccactgtcgtaaatcctaagtcaggctcttggaacttcttcgactggtttagcgggctgatgagttggttcggaggccccctcaaaaccatcctgcttatctgtttgtacgtggctctgtccattggtttatttttcctcctgatctatcttgggagaacgggactgagcaagatgtggctagccgcaacaaagaaagcctcttga

SEQ ID NO: 11139 - RNA, 3594 nt, synthetic construct
  misc_feature 1..3594: note = derived and/or modified CDS sequence (opt3) from RVFV(Lunyo)__KU167026.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctatttcgggaatccgcgaagtgaagacctcaagccaggagctatatcgagcactcaaagccattatcgcggctgacggtctgaataacataacatgtcacggcaaggatccagaggacaaaatcagtcttattaaggggccgccccataaaaagcgtgtcggaatcgtgagatgcgaaaggcggcgcgatgccaagcaaattggcagagagactatggcaggtatcgccatgaccgttctgcctgctttggcagtgtttgccctcgctccagtcgtgttcgccgaagacccccacctgaggaatcggcctgggaaaggacataactacatagatggcatgacacaggaggacgcgacctgtaagccagtaacttatgcaggcgcctgctcctcttttgatgttctgctcgaaaaagggaagttccccttatttcagagctacgctcaccatcgcacactgcttgaggccgtgcacgacaccattatcgcaaaagctgatcctccatcctgtgacttgcagtcagcccacggaaatccgtgcatgaaggagaagctggtcatgaaaacgcattgtcccaacgattatcaaagtgcgcactacctaaataacgacggtaagatggccagcgtgaaatgccctccaaagtatgaactcactgaggactgtaatttctgccgacagatgaccggcgcatctctgaaaaaggggtcctacccccttcaggatctgttttgccagtcaagcgaagacgatggaagtaaattgaagacaaagatgaaaggcgtgtgtgaggtcggtgttcaagctctcaagaaatgcgacgggcagctgtctactgcccatgaagtggtacctttcgctgtgtttaagaactccaaaaaggtctacttagataagctggacctcaaaaccgaggagaatcttctgccagatagcttcgtgtgttttgaacacaagggacagtataaaggcacaatggtttcgggccagaccaagagagagttgaaatctttcgacatttcccaatgccccaagatcgggggacacggttcaaagaaatgtacgggcgatgccgcattttgcagtgcctacgaatgtactgctcagtatgcgaacgcatactgcagccatgccaatgggtccggaatcgtgcagattcaagtctctggcgtgtggaagaaaccgctatgtgtaggttatgagagggttgtggtcaagcgggaactgagcgctaaacctatacagcgtgtggagccctgcacaacctgtatcactaagtgcgagccacacgggctcgtcgtgcgctcaacaggcttcaagattagttccgccgttgcatgcgccagcggagtgtgtgtaaccggctctcagtcacctagtacggaaatcaccctgaaataccccgggataagccagtcctctggaggtgacattggcgtccatatggctcacgatgaccaatcggtgagctccaagatcgttgcccattgcccaccccaggacccttgtcttgtgcacgggtgcatcgtctgtgcacacggactgattaactatcagtgccatacagcgttgtcagctttcgtggtagtgtttgttttcagttctgtcgccatcatttgtctcgcaatactgtacaaagtgttaaagtgcctgaaaatcgccccaagaaaggtgctaaatccgctcatgtggattactgcttttatcaggtgggtctacaaaaagatggttgcccgggtggcagataacatcaaccaggtgaatcgagagattggctggatggaaggtgggcaactggctcttggcaaccccgcccctataccacgccacgcgcccatccctagatatagcacctacttgatgctgctcctgattgtatcctatgcctcagcttgtagcgagcttatccaggcatcttccaggattacaacttgcagtaccgagggagtcaatacacggtgtcgcctgagcggcaccgccttgatcagagctgggtctgtgggagccgaagcatgcctcatgctgaagggtgttaaagaggaccagactaagttcttaaaaataaagacggtgtcctcagaactgagttgcagggagggccagagctactggacagggtcgttttccccaaaatgtctatctagccgtcggtgccatctcgtcggagaatgtcacgtgaaccgatgcctgtcatggagagataatgagaccagtgcggagttctcctttgttggcgaatctactaccatgagggagaacaagtgtttcgaacaatgcggtgggtggggctgtggatgctttaatgtgaaccccagctgtcttttcgtacacacatatttgcagtccgtccgcaaggaggccctgcgggtgtttaattgcatcgactgggtgcataaactcaccctggaaattactgatttcgacggctcagtcagcacaatcgatttaggggctagttcttccagatttacgaactggggaagcgtttcgctgtcacttgacgccgagggcatttctggtagtaattccttcagcttcatcgagtctccggggaagggatacgcaatagtggatgaaccttttagcgagattccaaggcagggcttcttgggtgaaatccgctgtaactccgagtcaagtgtactcagcgctcacgaatcttgcctgcgagcccccaatctaatttcctataaacctatgatcgaccagctggagtgcaccactaacctcatagatccctttgtggtcttcgagcggggctcactgccacaaacacgtaatgacaagacctttgcagccagtaaagggaacagaggagtgcaggctttcagcaagggctccgttcaggcggatcttacattgatgtttgacaacttcgaagtggactttgtcggggccgcagtgtcttgtgatgctgccttcctgaatttaactggatgctactcgtgtaacgccggcgctagggtttgcctcagcatcacctcaacgggtaccgggacactgtccgcacataataaggacggaagtcttcacattgtgctgccttctgagaacggcactaaagatcaatgtcagatcttgcattttaccgtccccgaagtagaggaggagttcatgtacagctgcgacggtgatgagcgcccactcctggtgaagggcacactaattgccatcgacccgtttgatgaccggagagaagctgggggagagtccactgttgtgaatcctaaatcaggctcttggaacttcttcgattggtttagcgggctgatgagttggttcggaggccccctcaagaccatactgcttatttgtttgtatgtcgcgctgtccatcggtttatttttcctcctgatctaccttgggaggacgggactgagcaaaatgtggctagccgcaacaaagaaggcctcttga

SEQ ID NO: 11140 - RNA, 3594 nt, synthetic construct
  misc_feature 1..3594: note = derived and/or modified CDS sequence (opt3) from RVFV(2007000234)__JF326191.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctgtgtcggggattcgcgaagtcaagacctcaagccaggagctatatcgagcactcaaagccatcattgcggctgacggtctgaataacatcacatgtcacggcaagaatccagaggataaaataagtcttatcaaggggccgccccataaaaagcgtgtgggaattgttagatgcgaaaggcggcgcgacgccaagcaaatcagaagggagactatggcaggcattgccatgaccgtgctgcctgctttggcagtctttgccctcgctccagtggtattcgccgaagatccccatctgcggaaccgccctggtaaagggcacaattacatcgacggaatgacacaggaggatgcgacctgtaagccagttacttatgcaggcgcctgctcctcttttgacgtgctgctcgaaaaaggcaagttccccttatttcagagctacgctcaccatcgaacactgcttgaggccgtccacgataccataattgcaaaagctgaccctccatcctgtgatttgcagtcagcccacgggaacccgtgcatgaaggagaagctggtgatgaaaacgcattgtcccaatgactatcaaagtgcgcactacctaaacaatgatggaaagatggccagcgtgaaatgccctccaaagtatgaactcactgaggactgtaacttctgcagacagatgaccggtgcatctctgaaaaagggctcctacccccttcaggacctgttttgccagtcaagcgaagatgacgggagtaaattgaagacaaagatgaaaggagtctgtgaggttggcgtgcaagctctcaagaaatgcgatggtcagctgtctactgcccatgaagtagtgcctttcgctgtctttaagaatagtaaaaaggtgtacttagacaagctggatctcaaaaccgaggagaaccttctgccagacagcttcgtttgttttgaacacaaggggcagtataaaggaacaatggattcgggccagaccaagagggagttgaaatctttcgacatctcccaatgccccaagattggcgggcacggatcaaagaaatgtacgggtgatgccgcattttgcagtgcctacgaatgtactgctcagtatgcgaatgcatactgcagccatgccaacggctccgggatcgtgcagatccaagtctctggagtgtggaagaaaccgctatgtgtaggctatgagcgggttgtggtcaagcgtgaactgagcgctaaacctattcagcgcgtggagccctgcacaacctgtataactaagtgcgagccacacggtctcgtcgtgagatcaacagggttcaagatcagttccgccgttgcatgcgccagcggcgtgtgtgtaaccggatctcagtcacctagtacggaaattaccctgaaataccccggcatcagccagtcctctgggggagacataggtgtccatatggctcacgatgaccaatcggtgagctccaagattgttgcccattgcccaccccaggacccttgtcttgtgcacggctgcatcgtctgtgcacacgggctgatcaattatcagtgccatacagcgttgtcagctttcgtggtaatttttgtgttcagttctactgccatcatttgtctcgcagttctgtacagggtcttaaaatgcctgaagatagccccacggaaagtgctaaacccgctcatgtggatcaccgcttttattcgatgggtgtacaagaaaatggtcgcccgcgttgcagataacatcaatcaggtgaacagagagatcggatggatggaaggcggtcaactggctcttgggaatcccgcccctattccaaggcacgcgcccatacctcggtatagcacatacttgatgctgctcctgatcgtgtcctatgcctcagcttgtagcgagcttattcaggcatcttcccgcatcactacctgcagtacagagggcgtaaacaccaagtgtagactgagcggaactgccttgattagggctggctctgtcggggccgaagcatgcctcatgctgaagggagtgaaagaggaccagacgaagttcttaaaaatcaagacagtttcctcagaactgagttgccgtgagggtcagagctactggaccggctcgttttccccaaaatgtctatctagccggcgatgccatctcgtgggggaatgtcacgtcaatagatgcctgtcatggagggataacgagacttccgcggagttctcctttgtgggagaatctaccacaatgcgcgagaataagtgtttcgaacaatgcggcggttgggggtgtggctgctttaacgttaatcccagctgtcttttcgtgcacacctatttgcagtccgtacggaaggaggccctgagagtctttaactgcatagactgggtgcataaactcactctggaaatcacagatttcgacggatcagtgagcacgattgatttaggcgctagttcttccaggtttaccaattgggggagcgtctcgctgtcacttgacgccgagggaatctctggcagtaactccttcagcttcattgagtctccgggtaaggggtacgcaatcgttgatgaaccttttagcgagataccacgccagggattcttgggcgaaattcgatgtaattccgagtcaagtgtgctcagcgctcacgaatcttgcctgcgggcccccaacctagtatcctataaacctatgatcgaccagctggagtgcactacaaatctcattgatccctttgtggtcttcgagcgtggttcactgccacaaaccagaaacgacaagacatttgcagccagtaaaggcaacaggggagtgcaggctttcagcaagggatccgttcaggcggatcttactttgatgtttgacaatttcgaagtggactttgtcggcgccgcagtgtcttgtgatgctgccttcctgaacttaaccgggtgctactcgtgtaatgccggagctcgcgtttgcctcagcatcacgtcaaccggcacaggtactctgtccgcacataacaaggacgggagtcttcacatagtgctgccttctgagaatggaaccaaagatcaatgtcagatcttgcattttacagtccccgaagtagaggaggagttcatgtacagctgcgacggcgatgagcggccactcctggtgaagggtactctaattgccatcgacccgtttgatgacagaagggaagcgggcggggagtccaccgttgtgaaccctaaatcaggatcttggaatttcttcgattggtttagcggcctgatgagttggttcgggggacccctcaagacgattctgcttatctgtttgtatgtcgctctgtccataggcttatttttcctcctgatttaccttggtcgaacagggctgagcaaaatgtggctagccgcaaccaagaaggcctcttga

SEQ ID NO: 11141 - RNA, 3594 nt, synthetic construct
  misc_feature 1..3594: note = derived and/or modified CDS sequence (opt3) from RVFV(KEN07-KUR340)__EF460404.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctgtgtcggggattcgcgaagtcaagacctcaagccaggagctatatcgagcactcaaagccatcattgcggctgacggtctgaataacatcacatgtcacggcaagaatccagaggataaaataagtcttatcaaggggccgccccataaaaagcgtgtgggaattgttagatgcgaaaggcggcgcgacgccaagcaaatcggcagagagactatggcaggtattgccatgaccgtgctgcctgctttggcagtctttgccctcgctccagtggtattcgccgaagatccccacctgaggaaccggcctgggaaaggacataattacatcgacggcatgacacaggaggatgcgacctgtaagccagttacttatgcaggcgcctgctcctcttttgacgtgctgctcgaaaaagggaagttccccttatttcagagctacgctcaccatcgcacactgcttgaggccgtccacgataccataattgcaaaagctgaccctccatcctgtgatttgcagtcagcccacggaaacccgtgcatgaaggagaagctggtgatgaaaacgcattgtcccaatgactatcaaagtgcgcactacctaaacaatgatggtaagatggccagcgtgaaatgccctccaaagtatgaactcactgaggactgtaacttctgccgacagatgaccggcgcatctctgaaaaaggggtcctacccccttcaggacctgttttgccagtcaagcgaagatgacggaagtaaattgaagacaaagatgaaaggcgtctgtgaggttggtgtgcaagctctcaagaaatgcgatgggcagctgtctactgcccatgaagtagtgcctttcgctgtctttaagaatagtaaaaaggtgtacttagacaagctggatctcaaaaccgaggagaaccttctgccagacagcttcgtttgttttgaacacaagggacagtataaaggcacaatggattcgggccagaccaagagagagttgaaatctttcgacatctcccaatgccccaagattgggggacacggttcaaagaaatgtacgggcgatgccgcattttgcagtgcctacgaatgtactgctcagtatgcgaatgcatactgcagccatgccaacgggtccggaatcgtgcagatccaagtctctggcgtgtggaagaaaccgctatgtgtaggttatgagagggttgtggtcaagcgggaactgagcgctaaacctattcagcgtgtggagccctgcacaacctgtataactaagtgcgagccacacgggctcgtcgtgcgctcaacaggcttcaagatcagttccgccgttgcatgcgccagcggagtgtgtgtaaccggctctcagtcacctagtacggaaattaccctgaaataccccgggatcagccagtcctctggaggtgacataggcgtccatatggctcacgatgaccaatcggtgagctccaagattgttgcccattgcccaccccaggacccttgtcttgtgcacgggtgcatcgtctgtgcacacggactgatcaattatcagtgccatacagcgttgtcagctttcgtggtaatttttgtgttcagttctactgccatcatttgtctcgcagttctgtacagaatgttaaaatgcctgaagatagccccaaggatcgtcctaaacccgctcatgtggattaccgcttttatccggtgggtgtacaaaaagatggtggcccgagtcgcagataacatcaatcaggttaaccgcgagattggctggatggaaggtgggcaactggctcttggcaatcccgcccctataccaagacacgcgcccatccctaggtatagcacatacttgatgctgctcctgattgtgtcctatgcctcagcttgtagcgagcttatccaggcatcttcccggattactacctgcagtacagagggagtgaacaccaaatgtcgcctgagcggcactgccttgatcagagctgggtctgtaggagccgaagcatgcctcatgctgaagggtgtcaaggaggaccagacgaaattcttaaagataaaaacagtgtcctcagaactgagttgcagggagggccagagctactggaccgggtcgttttccccaaagtgtctatctagccgtcggtgccatctcgttggagaatgtcacgtgaatcgatgcctgtcatggagagataacgagacttccgcggagttctcctttgtcggcgaatctaccacaatgagggagaataaatgtttcgaacaatgcggtgggtggggctgtggatgctttaacgtgaatcccagctgtcttttcgttcacacctatttgcagtccgtgcgcaaggaggccctgcgggtatttaactgcatcgactgggtccataagctcactctggaaattacagatttcgacggctcagtgagcacgatcgatttaggggctagttcttccagatttaccaattggggaagcgtgtcgctgtcacttgacgccgagggcatttctggtagtaactccttcagcttcatcgagtctccggggaaaggatacgcaatagtcgatgaaccttttagcgagattccaaggcagggcttcttgggtgaaatccgctgtaattccgagtcaagtgttctcagcgctcacgaatcttgcctgcgagcccccaacctagtgtcctataagcctatgattgaccagctggagtgcactacaaatctcatcgatccctttgtagtgttcgagcggggctcactgccacaaacccgtaacgacaaaacatttgcagccagtaaggggaacagaggagtccaggctttcagcaaaggctccgtgcaggcggatcttactttgatgtttgacaatttcgaagttgactttgtgggggccgcagtctcttgtgatgctgccttcctgaacttaaccggatgctactcgtgtaatgccggcgctagggtgtgcctcagcataacgtcaaccggtacagggactctgtccgcacataacaaggacggaagtcttcacatcgttctgccttctgagaatggcaccaaggatcaatgtcagattttgcattttacagtgcccgaagtcgaggaggagttcatgtacagctgcgacggtgatgagcgcccactcctggtaaaaggcactctaatcgccattgacccgtttgatgaccggagagaagcgggaggagagtccaccgtggttaaccctaagtcaggctcttggaatttcttcgattggtttagcgggctgatgagttggttcggaggccccctcaaaacgatcctgcttatatgtttgtatgtggctctgtccattggtttatttttcctcctgatctaccttgggaggacaggactgagcaagatgtggctagccgcaaccaaaaaggcctcttga

SEQ ID NO: 11142 - RNA, 3594 nt, synthetic construct
  misc_feature 1..3594: note = derived and/or modified CDS sequence (opt3) from RVFV(2373/74)__DQ380194.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctatttcgggaatccgcgaagtgaagacctcaagccaggagctatatcgagcactcaaagccattatcgcggctgacggtctgaataacataacatgttacggcaaggatccagaggacaaaatcagtcttattaaggggccgccccacaaaaagcgtgtcggaatcgtgagatgcgaaaggcggcgcgatgccaagcaaattggcagagagactatggcaggtatcgccatgaccgttctgcctgctttggcagtgtttgccctcgctccagtcgtgttcgccgaagacccccatctgaggaatcggcctgggaaaggacacaactatatagatggcatgacacaggaggacgcgacctgtaagccagtaacttacgcaggcgcctgctcctcttttgatgttctgctcgaaaaagggaagttccccttatttcagagctatgctcatcaccgcacactgcttgaggccgtgcatgacaccattatcgcaaaagctgatcctccatcctgtgacttgcagtcagcccacggaaatccgtgcatgaaggagaagctggtcatgaaaacgcactgtcccaacgattaccaaagtgcgcattatctaaataacgacggtaagatggccagcgtgaaatgccctccaaagtacgaactcactgaggactgtaatttctgccgacagatgaccggcgcatctctgaaaaaggggtcctacccccttcaggatctgttttgccagtcaagcgaagacgatggaagtaaattgaagacaaagatgaaaggcgtgtgtgaggtcggtgttcaagctctcaagaaatgcgacgggcagctgtctactgcccacgaagtggtacctttcgctgtgtttaagaactccaaaaaggtctatttagataagctggacctcaaaaccgaggagaatcttctgccagatagcttcgtgtgttttgaacataagggacagtacaaaggcacaatggactcgggccagaccaagagagagttgaaatctttcgatatttcccaatgccccaagatcgggggacacggttcaaagaaatgtacgggcgacgccgcattttgcagtgcctatgaatgtactgctcagtacgcgaacgcatattgcagccacgccaatgggtccggaatcgttcagattcaagtgtctggcgtctggaagaaaccgctatgtgtgggttacgagagggtagttgtgaagcgggaactgagcgctaaacctatacagcgtgtcgagccctgcacaacctgtatcactaagtgcgagccacatgggctcgtggtccgctcaacaggcttcaagattagttccgccgtggcatgcgccagcggagtttgtgtgaccggctctcagtcacctagtacggaaatcaccctgaaatatcccgggataagccagtcctctggaggtgatattggcgtacacatggctcatgacgaccaatcggtcagctccaagatggtggcccactgcccaccccaggatccttgtcttgttcatgggtgcatcgtgtgtgcacacggactgatcaactaccagtgccacacagcgttgtcagctttcgtcgtggtatttgtgttcagttctgttgccattatctgtctcgcaattctgtacaaagtcttaaagtgcctgaaaatagccccaagaaaggtgctaaatccgctcatgtggatcactgcttttattaggtgggtgtataaaaagatggtcgcccgggttgcagacaacatcaaccaggtgaatcgagagatcggctggatggaaggtgggcaactggctcttggcaaccccgcccctattccacgccatgcgcccatacctagatacagcacctatttgatgctgctcctgatcgtgtcctacgcctcagcttgtagcgagcttattcaggcatcttccaggatcacaacttgcagtaccgagggagtaaatacaaagtgtcggctgagcggcaccgccttgattcgcgctgggtctgtcggagccgaagcatgcctcatgctgaaaggtgtgaaggaggatcagactaaattcttaaagatcaaaacggtttcctcagaactgagttgcagagagggccagagctattggacagggtcgttttccccaaagtgtctatctagcaggcgttgccacctcgtgggagaatgtcatgtcaaccggtgcctgtcatggcgagacaatgagaccagtgcggagttctcctttgtgggcgaatctactaccatgagagagaacaagtgtttcgaacaatgcggtgggtggggctgtggatgctttaatgttaaccccagctgtcttttcgtgcacacatacttgcagtccgtaaggaaagaggccctgcgcgtctttaattgcatagattgggtgcacaagctcaccctggaaatcactgacttcgatggctcagtgagcacattagacctgggggctagttcttcccggtttacgaactggggaagcgtctcgctttcattggatgccgagggcatttctggtagtaattccttcagcttcatcgagtctccggggaaaggatatgcaattgttgacgaaccttttagcgagatcccaagacagggcttcctcggtgaaataaggtgtaactccgagtcaagtgtgctgagcgctcatgaatcttgcctacgcgcccccaatctgatttcctacaagcctatgatcgatcagctcgagtgcaccactaacctgattgacccctttgtagtgttcgagcgaggctcacttccacaaacacggaatgagaaaacctttgcagccagtaaggggaaccgtggagtccaggctttcagcaagggctccgtgcaggcggatttgacactgatgtttgacaacttcgaggttgactttgtgggggccgcagtctcttgtgatgctgccttcttaaatctcactggatgctactcgtgtaacgccggcgctagagtgtgcctgagcatcacctcaacgggtaccgggacactttccgcacacaataaagacggaagtctgcatatagttttgccttctgaaaacggcactaaggatcaatgtcagatcctccactttaccgtgcccgaggtcgaggaagagttcatgtatagctgcgacggtgatgaaaggccactgctagtaaaaggcacactgattgccatcgacccgtttgatgaccgccgggaggctgggggagaatccactgtggttaatcctaagtcaggctcttggaacttcttcgattggtttagcgggctcatgagttggttcggaggccccctgaaaaccattcttttgatctgtctgtacgtggcgttatccataggtctctttttcctgcttatttatctggggagaacgggactaagcaagatgtggctcgccgcaacaaagaaagcctcttga

SEQ ID NO: 11143 - RNA, 3594 nt, synthetic construct
  misc_feature 1..3594: note = derived and/or modified CDS sequence (opt3) from RVFV(200803169)__JF311384.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaggaactgtcctgctctgtgtcggggattcgcgaagtcaagacctcaagccaggagctatatcgagcactcaaagccatcattgcggctgacggtctgaataacatcacatgtcacggcaagaatccagaggataaaataagtcttatcaaggggccgccccataaaaagcgtgtgggaattgttagatgcgaaaggcggcgcgacgccaagcaaatcggcagagagactatggcaggtattgccatgaccgtgctgcctgctttggcagtctttgccctcgctccagtggtattcgccgaagatccccacctgaggaaccggcctgggaaaggacataattacatcgacggcatgacacaggaggatgcgacctgtaagccagttacttatgcaggcgcctgctcctcttttgacgtgctgctcgaaaaagggaagttccccttatttcagagctacgctcaccatcgcacactgcttgaggccgtccacgataccataattgcaaaagctgaccctccatcctgtgatttgcagtcagcccacggaaacccgtgcatgaaggagaagctggtgatgaaaacgcattgtcccaatgactatcaaagtgcgcactacctaaacaatgatggtaagatggccagcgtgaaatgccctccaaagtatgaactcactgaggactgtaacttctgccgacagatgaccggcgcatctctgaaaaaggggtcctacccccttcaggacctgttttgccagtcaagcgaagatgacggaagtaaattgaagacaaagatgaaaggcgtctgtgaggttggtgtgcaagctctcaagaaatgcgatgggcagctgtctactgcccatgaagtagtgcctttcgctgtctttaagaatagtaaaaaggtgtacttagacaagctggatctcaaaaccgaggagaaccttctgccagacagcttcgtttgttttgaacacaagggacagtataaaggcacaatggattcgggccagaccaagagagagttgaaatctttcgacatctcccaatgccccaagattgggggacacggttcaaagaaatgtacgggcgatgccgcattttgcagtgcctacgaatgtactgctcagtatgcgaatgcatactgcagccatgccaacgggtccggaatcgtgcagatccaagtctctggcgtgtggaagaaaccgctatgtgtaggttatgagagggttgtggtcaagcgggaactgagcgctaaacctattcagcgtgtggagccctgcacaacctgtataactaagtgcgagccacacgggctcgtcgtgcgctcaacaggcttcaagatcagttccgccgttgcatgcgccagcggagtgtgtgtaaccggctctcagtcacctagtacggaaattaccctgaaataccccgggatcagccagtcctctggaggtgacataggcgtccatatggctcacgatgaccaatcggtgagctccaagattgttgcccattgcccaccccaggacccttgtcttgtgcacgggtgcatcgtctgtgcacacggactgatcaattatcagtgccatacagcgttgtcagctttcgtggtaatttttgtgttcagttctactgccatcatttgtctcgcagttctgtacagagtcttaaaatgcctgaagatagccccaaggaaagtgctaaacccgctcatgtggatcaccgcttttattcggtgggtgtacaagaaaatggtcgcccgagttgcagataacatcaatcaggtgaaccgcgagatcggctggatggaaggtgggcaactggctcttggcaatcccgcccctattccaagacacgcgcccatacctaggtatagcacatacttgatgctgctcctgatcgtgtcctatgcctcagcttgtagcgagcttattcaggcatcttcccggatcactacctgcagtacagagggagtaaacaccaagtgtcgcctgagcggcactgccttgattagagctgggtctgtcggagccgaagcatgcctcatgctgaagggtgtgaaagttgaccagacgaagttcttaaaaatcaagacagtgtcctcagagctgagttgcagggaaggccagagctactggaccgggtcgttttccccaaaatgtctatctagccgtcggtgccatctcgtcggagagtgtcacgtgaatcgatgcctgtcatggagagataacgaaacttccgcggagttctcctttgttggcgagtctaccacaatgagggaaaataagtgtttcgagcaatgcggtgggtggggctgtggatgctttaacgtgaatcccagctgtcttttcgtacacacctatttgcagtccgtccgcaaggaagccctgcgggtgtttaactgcatagactgggtgcataaactcactctggagatcacagatttcgacggctcagtcagcacgattgatttaggggctagttcttccagatttaccaattggggaagcgtttcgctgtcacttgacgccgaaggcatctctggtagtaactccttcagcttcattgagtctccggggaagggatacgcaatcgtggatgagccttttagcgaaataccaaggcagggcttcttgggtgaggtacgctgtaattccgaatcaagtgtgctcagcgctcacgagtcttgcctgcgagcccccaacctagtctcctataaacctatgattgaccagctggaatgcactacaaatctcatcgatccctttgtggttttcgagcggggctcactgccacaaacccgtaacgacaagacatttgcagccagtaaagggaacagaggagtgcaggctttcagcaagggctccgtccaggcggatcttactttgatgtttgacaatttcgaggtggactttgttggggccgcagtgtcttgtgatgctgccttcctgaacttaaccggatgctactcgtgtaatgccggcgctagggtctgcctcagcattacgtcaaccggtacagggactctgtccgcacataacaaggacggaagtcttcacatcgtactgccttctgaaaatggcaccaaagatcaatgtcagatattgcattttacagtgcccgaggttgaagaggagttcatgtacagctgcgacggtgatgaacgcccactcctggtgaagggcactctaatcgccattgacccgtttgatgaccggagagaggcgggaggagaatccaccgtcgtgaaccctaaatcaggctcttggaatttcttcgattggtttagcgggctgatgagttggttcggaggccccctcaagacgatcctgcttatttgtttgtatgtagctctgtccatcggtttatttttcctcctgatataccttgggaggacaggactgagcaaaatgtggctagccgcaaccaagaaggcctcttga

SEQ ID NO: 11144 - RNA, 3594 nt, synthetic construct
  misc_feature 1..3594: note = derived and/or modified CDS sequence (opt3) from RVFV(200803167)__JF311382.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaggaactgtcctgctctgtgtcggggattcgcgaagtcaagacctcaagccaggagctatatcgagcactcaaagccatcattgcggctgacggtctgaataacatcacatgtcacggcaagaatccagaggataaaataagtcttatcaaggggccgccccataaaaagcgtgtgggaattgttagatgcgaaaggcggcgcgacgccaagcaaatcggcagagagactatggcaggtattgccatgaccgtgctgcctgctttggcagtctttgccctcgctccagtggtattcgccgaagatctgcacctgaggaaccggcccgggaaaggacataattacatcgacggcatgacacaggaggatgcgacctgtaagcctgttacttatgcaggcgcctgctcctcttttgacgtgctcttagaaaaagggaagttcccactgtttcagagctacgctcaccatcgcacacttttggaggccgtccacgataccataattgcaaaagctgatcccccttcctgtgacctgcagtcagcccacggaaacccatgcatgaaggagaagctagtgatgaaaacgcattgtccgaatgactatcaaagtgcgcactacctcaacaatgatggtaagatggccagcgtgaaatgtccccctaagtatgaactgactgaggactgcaacttctgccgacagatgaccggcgcatctcttaaaaaggggtcctacccactgcaggacttgttttgccagtcaagcgaagatgacggaagtaaactcaagacaaagatgaaaggcgtctgtgaggttggtgtgcaagctctgaagaaatgcgatgggcagttatctactgcccatgaagtagtgcccttcgctgtctttaaaaattccaagaaggtgtacctggacaagctcgatcttaaaaccgaggagaacctgttgcctgacagcttcgtttgttttgaacacaagggacagtataaaggcacaatggattcgggccagaccaagagagagctaaaatctttcgacatctcccaatgcccaaagattgggggacacggttcaaagaaatgtacgggcgatgccgcattttgcagtgcctacgaatgtactgctcagtatgcgaatgcatactgcagccatgccaacgggtccggaatcgtgcagatccaagtctctggcgtgtggaagaaacccctgtgtgtaggttatgagagggttgtggtcaagcgggaactcagcgctaaaccgattcagcgtgtggagccttgcacaacctgtataactaagtgcgagccccacgggctggtcgtgcgctcaacaggcttcaagatcagttccgccgttgcatgcgccagcggagtgtgtgtaaccggctctcagtcaccaagtacggaaattgctcttaaataccctgggatcagccagtcctctggaggtgacataggcgtccatatggcccacgatgaccaatcggtgagctccaagattgttgcacattgtcccccacaggacccctgcctggtgcacgggtgcatcgtctgtgcgcacggattgatcaattatcagtgccataccgctctctcagccttcgtggtagtgtttgttttcagttctattgcaatcatttgtctggccatattatacagagtcctgaaatgcctaaagatcgctcctaggaaagtgctcaacccactgatgtggattacagcctttatccggtgggtgtacaagaaaatggtcgcacgagttgctgataacatcaatcaggtgaaccgcgagattggctggatggaaggtgggcaacttgtgttgggcaatccggcccccatacctagacacgcgccaatccccaggtatagcacttacctgatgctcctgcttattgtatcctatgcctcagcttgtagcgagctgatccaggcatcttcccggattaccacatgcagtactgagggagtcaacaccaagtgtcgcttgagcggcacagccctcatcagagctgggtctgtgggagccgaagcatgcctgatgttaaagggtgttaaagaggaccagaccaagttcctgaaaataaagactgtgtcctcagaactaagttgcagggagggccagagctactggacggggtcgttttcccctaaatgtctctctagccgtcggtgccatctggtcggagaatgtcacgtgaatcgatgcctttcatggagagataacgagacaagtgcggagttctcctttgttggcgaatctaccactatgagggagaataagtgtttcgaacaatgcggtgggtggggctgtggatgctttaacgtgaatccaagctgtttgttcgtacacacctatctgcagtccgtccgcaaggaggccctccgggtgtttaactgcatcgactgggtgcataaactgacattagaaattaccgatttcgacggctcagtcagcactatcgatctgggggctagttcttccagatttacaaattggggaagcgtttcgctttcattggacgccgagggcatttctggtagtaactccttcagcttcatcgagtctcccgggaagggatacgcaatagtggatgaaccgtttagcgagattcctaggcagggcttcctcggtgaaatccgctgtaattccgagtcaagtgtactgagcgctcacgaatcttgcctacgagccccaaacctgatttcctataaacccatgatcgaccagctcgagtgcacgaccaatctgatagatccttttgtggtcttcgagcggggctcacttccccaaactcgtaacgacaagacatttgcagccagtaaagggaacagaggagtgcaggctttcagcaagggctccgttcaggcggatttgaccctgatgtttgacaatttcgaagtggactttgtcggggccgcagtgtcttgtgatgctgccttcttaaacctcacaggatgctactcgtgtaatgccggcgctagggtttgcctgagcatcacttcaaccggtacggggaccctttccgcacataacaaggacggaagtctgcacattgtgttgccatctgagaatggcacaaaagatcaatgtcagatcctccattttactgtccctgaagtagaggaggagttcatgtacagctgcgacggtgatgaacgccccctgctagtgaagggcaccctgattgccatcgacccatttgatgaccggagagaagcgggaggagagtccacagttgtgaacccgaaatcaggctcttggaatttcttcgattggtttagcgggctcatgagttggttcggaggccctctgaagactatgcttttgatatgtctgtatgtcgctttatccattggtctctttttcctgcttatctacctggggaggaccggactaagcaaaatgtggctcgccgcaacgaagaaggcctcttga

SEQ ID NO: 11145 - RNA, 3594 nt, synthetic construct
  misc_feature 1..3594: note = derived and/or modified CDS sequence (opt3) from RVFV(Entebbe)__DQ380191.1__GP
  source 1..3594: mol_type = other RNA
atgtacgccctgctcaccatccttattagcgtgctggtctgcgaggctgttataagagtgtccttgtcttcaacaagggaagagacttgtttcggcgacagtacgaaccccgaaatgatcgagggggcatgggatagcttacgggaagaggagatgcctgaagaactgtcctgctctatttcgggaatccgcgaagtaaagacctcaagccaggagctacaccgagccctcaaagcgattatcgctgccgacggtctgaataacataacatgtcatggcaaggatccagaggacaaaatcagtcttattaaggggccgccccacaaaaagcgtgtgggagtcgtgagatgcgaaaggcggcgcgatgcaaagcaaatcggcagagagactatggccggtattgctatgaccgttctgcctgcattggccgtgtttgctctcgccccagtcgtgttcgcggaagacccccatctgaggaatcggcctgggaaaggacacaactatatcgatggcatgacacaggaggacgcaacctgtaagccagtaacttacgccggcgcttgctcctcttttgatgttctgctcgaaaaagggaagttccccttatttcagagctatgcccatcaccgcacactgcttgaggcagtgcacgacaccataattgctaaagccgatcctccatcctgtgacttgcagtcagcgcatggaaatccgtgcatgaaggagaagctggtcatgaaaacgcactgtcccaacgattaccaaagtgcccattatctaaataacgacggtaagatggcaagcgtgaaatgccctccaaagtacgaactcactgaggactgtaatttctgccgacagatgaccggcgcttctctgaaaaaggggtcctatccccttcaggatctgttttgccagtcaagcgaagacgatggaagtaaattgaagacaaagatgaaaggcgtgtgtgaggtcggtgttcaagccctcaagaaatgcgacgggcagctgtctactgctcacgaagtggtacctttcgccgtgtttaagaactccaaaaaggtctacttagataagctggacctcaaaaccgaggagaatcttctgccagatagcttcgtgtgttttgaacacaagggacagtacaaaggcacaatggactcgggccagatcaagagagagttgaaatctttcgatatttcccaatgccccaagatcgggggacatggttcaaagaaatgtaccggcgacgcagccttttgcagtgcttatgaatgtacggcgcagtacgcaaacgcctattgcagccacgctaatgggtccggaatcgttcagattcaagtgtctggcgtctggaagaaaccgctatgtgtgggttacgagagggtagttgtgaagcgggaactgagcgccaaacctatacagcgtgtcgagccctgcactacatgtatcaccaagtgcgagccacatgggctcgtggtccgctcaactggcttcaagattagttccgcagtggcctgcgctagcggagtttgtgtgacaggctctcagtcacctagtaccgaaatcacgctgaaatatcccgggataagccagtcctctggaggtgatattggcgtacacatggcccatgacgaccaatcggtcagctccaagatcgtggcacactgcccaccccaggatccttgtcttgttcacgggtgcatcgtgtgtgcgcatggactgattaactaccagtgccacaccgctttgtcagccttcgtcgtggtatttgtgttcagttctgttgcaatcatttgtctcgccatactgtataaagtcttaaagtgcctgaaaatcgctccaagaaaggtgctaaatccgctcatgtggattacagcctttatcaggtgggtgtacaaaaagatggtcgcacgggttgctgacaacatcaaccaggtgaatcgagagattggctggatggaaggtgggcaactggtgcttggcaaccccgcccctataccacgccatgcgcccatccctagatacagcacttatttgatgctgctcctgattgtatcctacgcctcagcttgtagcgagcttatccaggcatcttccaggattaccacatgcagtactgagggagtcaataccaagtgtcggctgagcggcacagccttgatccgcgctgggtctgtgggagccgaagcatgcctcatgctgaaaggtgttaaggaggatcagaccaaattcttaaagataaaaactgtgtcctcagaactgagttgcagagagggccagagctattggacggggtcgttttccccaaagtgtctatctagcaggcgttgccacctcgtcggagaatgtcacgtgaaccggtgcctgtcatggcgagacaatgagacaagtgcggagttctcctttgttggcgaatctaccactatgagagagaacaagtgtttcgaacaatgcggtgggtggggctgtggatgctttaatgtgaaccccagctgtcttttcgtacatacctacttgcagtccgtcaggaaagaggccctgcgcgtgtttaattgcatcgattgggtgcacaagctcacactggaaattaccgacttcgatggctcagtcagcactgttgacttaggggctagttcttcccggtttacaaactggggaagcgtgtcgctgtcacttgatgccgagggcatctctggtagtaattccttcagcttcattgagtctccggggaaaggatatgcaatcgtagacgaaccttttagcgagataccaagacagggcttcttgggtgaaattaggtgtaactccgagtcaagtgtgctcagcgctcatgaatcttgcctgcgcgcccccaatctaatctcctacaagcctatgattgatcagctggagtgcacgaccaacctcatcgacccctttgtcgtgttcgagcgaggctcactgccacaaactcggaatgataaaacatttgcagccagtaaggggaaccgtggagttcaggctttcagcaagggctccgtgcaggcggaccttaccttgatgtttgacaacttcgaagtcgattttgtgggggccgcagtttcttgtgacgctgccttcctgaatttaacaggatgctattcgtgtaacgccggcgctagagtgtgcctcagcataacttcaaccggtacggggaccctgtccgcacacaataaagatggaagtcttcatatcgtcctgccttctgagaacggcacaaaggaccaatgtcagattttgcactttactgtacccgaagtggaggaggagttcatgtacagctgcgatggtgacgagaggccactcctggttaaaggcaccctaatcgccattgatccgtttgacgatcgccgggaagctgggggagagtccacagtggtcaatcctaagtcaggctcttggaacttcttcgactggtttagcgggctgatgagttggttcggaggccccctcaaaactatcctgcttatatgtttgtacgtggcgctgtccattggtttatttttcctcctgatctatcttgggagaaccggactgagcaagatgtggctagccgcaacgaagaaagcctcttga

SEQ ID NO: 11146 - RNA, 3594 nt, synthetic construct
  misc_feature 1..3594: note = derived and/or modified CDS sequence (opt3) from RVFV(25010-24)__KM210509.1__GP
  source 1..3594: mol_type = other RNA
atgtacgtgctgctcacaatccttattagcgtcctggtttgcgaggccgtgataagagtatccttgtcttcaacaagggaagagacttgtttcggcgacagtacgaaccccgaaatgatcgagcgggcttgggatagcttacgcgaagaggagatgcctgaggaactgtcctgctctatttcggggatccgagaagtgaagacctcaagccaggagctatatcgtgcactcaaagccattatcgcggctgacggactgaataacataacatgtcacggtaaggatccagaggacaaaatcagtcttattaagggcccgccccataaaaagagagtcgggatcgtgaggtgcgaacggcgcagagatgccaagcaagttggaagggagactatggcaggcattgccatgaccgtgctgcctgctttggcagtctttgccctcgctccagtggtattcgccgaagacccccatctgcggaatcgccctggtaaagggcacaactacatcgatggaatgacacaggaggacgcgacctgtaagccagttacttatgcaggcgcctgctcctcttttgatgtgctgctcgaaaaaggcaagttccccttatttcagagctacgctcaccatcgaacactgcttgaggccgtccacgacaccataattgcaaaagctgatcctccatcctgtgacttgcagtcagcccacgggaatccgtgcatgaaggagaagctggtgatgaaaacgcattgtcccaacgattatcaaagtgcgcactacctaaataacgacggaaagatggccagcgtgaaatgccctccaaagtatgaactcactgaggactgtaatttctgcagacagatgaccggtgcatctctgaaaaagggctcctacccccttcaggatctgttttgccagtcaagcgaagacgatgggagtaaattgaagacaaagatgaaaggagtctgtgaggttggcgtgcaagctctcaagaaatgcgacggtcagctgtctactgcccatgaagtagtgcctttcgctgtctttaagaactccaaaaaggtgtacttagataagctggacctcaaaaccgaggagaatcttctgccagatagcttcgtttgttttgaacacaaggggcagtataaaggaacaatggactcgggccagaccaagagggagttgaaatctttcgatatctcccaatgccccaagattggcgggcacggatcaaagaaatgtacgggtgacgccgcattttgcagtgcctacgaatgtactgctcagtatgcgaacgcatactgcagccatgccaatggctccgggatcgtgcagatccaagtctctggagtgtggaagaaaccgctatgtgtaggctatgagcgggttgtggtcaagcgtgaactgagcgctaaacctattcagcgcgtggagccctgcacaacctgtataactaagtgcgagccacacggtctcatcgtcagatcaacagggttcaagattagttccgccgtggcatgcgccagcggcgtttgtgtgaccggatctcagtcacctagtacggaaatcaccctgaaataccccggcataagccagtcctctgggggagatattggtgtacatatggctcacgacgaccaatcggtcagctccaagatcgtggcccattgcccaccccaggatccttgtcttgttcacggctgcatcgtgtgtgcacacgggctgattaactatcagtgccatacagcgttgtcagctttcgtcgtggtatttgtgttcagttctgttgccatcatttgtctcgcaatactgtacaaagtcttaaagtgcctgaaaatcgccccaaagaaagtgctaaatccgctcatgtggattactgcttttatcaggtgggtgtacaagaagatggtcgcccgggttgcagacaacatcaaccaggtgaatcgagagattggatggatggaaggcggtcaactggctcttgggaaccccgcccctataccacgccacgcgcccatccctagatatagcacctacttgatgctgctcctgattgtgtcctatgcctcagcttgtagcgagcttatccaggcatcttccaggattacaacttgcagtaccgagggcgtaaatacaaaatgtcggctgagcggaaccgccttgatccgcgctggctctgtcggggccgaagcatgcctcatgctgaagggagtgaaagatgaccagactaagttcttaaaaataaagacggtttcctcagagctgagttgcagagaaggtcagagctactggacaggctcgttttccccaaagtgtctatctagcaggcgttgccatctcgtgggggagtgtcacgtcaaccggtgcctgtcatggcgagataatgaaaccagtgcggagttctcctttgtgggagagtctactaccatgagagaaaacaaatgtttcgagcaatgcggcggttgggggtgtggctgctttaatgttaaccccagctgtcttttcgtgcacacatatttgcagtccgtaaggaaggaagccctgcgcgtctttaattgcatcgactgggtgcataaactcaccctggagattactgatttcgacggatcagtgagcacaatcgatttaggcgctagttcttcccggtttacgaactgggggagcgtctcgctgtcacttgacgccgaaggaatttctggcagtaattccttcagcttcatcgagtctccgggtaaggggtacgcaatagttgatgagccttttagcgaaattccaagacagggattcttgggcgagatcaggtgtaactccgaatcaagtgtgctcagcgctcacgagtcttgcctgcgcgcccccaatctaatttcctataaacctatgatcgaccagctggaatgcaccactaacctcatagatccctttgtagtgttcgagcgaggttcactgccacaaacacggaatgacaagacctttgcagccagtaagggcaaccgtggggtccaggctttcagcaaaggatccgtgcaggcggaccttacattgatgtttgataacttcgaggttgactttgtgggcgccgcagtctcttgtgatgctgccttcctgaatttaactgggtgctactcgtgtaacgccggagctagagtgtgcctcagcatcacctcaacgggcaccggtacactgtccgcacataataaggacgggagtcttcacattgttctgccttctgaaaacggaactaaagatcaatgtcagatcttgcattttaccgtgcccgaggtcgaagaggagttcatgtacagctgcgacggcgatgaaaggccactcctggtaaagggtacactaattgccatcgacccgtttgatgaccgccgggaggcgggcggggaatccactgtggttaatcctaaatcaggatcttggaacttcttcgattggtttagcggcctgatgagttggttcgggggacccctcaagaccatactgcttatttgtttgtatgtggctctgtccatcggcttatttttcctcctgatctaccttggtagaacggggctgagcaagatgtggctagccgcaaccaaaaaggcctcttga

SEQ ID NO: 11147 - RNA, 3594 nt, synthetic construct
  misc_feature 1..3594: note = derived and/or modified CDS sequence (opt3) from RVFV(Kenya 9800523)__DQ380196.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctgtgtcgggtattcgcgaagtcaagacctcaagccaggagctatatcgagcactcaaagccatcattgcggctgacggactgaataacatcacatgtcacggcaagaatccagaggataaaataagtcttatcaaggggccgccccataaaaagcgtgtgggaattgttagatgcgaaaggcggcgcgacactaagcaaatcggcagagagaccatggccggtattgcaatgacagtgctgcctgccttggctgtctttgcactcgccccagtggtattcgctgaagatccccacctgaggaaccggcctgggaaaggacataattacatcgacggcatgacccaggaggatgccacttgtaagccagttacatatgcgggcgcatgctcctcttttgacgtgctgctcgaaaaagggaagttccccttatttcagagctacgcccaccatcgcaccctgcttgaggctgtccacgatacgataattgccaaagcagaccctccatcctgtgatttgcagtcagctcacggaaacccgtgcatgaaggagaagctggtgatgaaaactcattgtcccaatgactatcaaagtgcccactacctaaacaatgatggtaagatggcgagcgtgaaatgccctccaaagtatgaactcaccgaggactgtaacttctgccgacagatgacaggcgcctctctgaaaaaggggtcctacccccttcaggacctgttttgccagtcaagcgaagatgacggaagtaaattgaagactaagatgaaaggcgtctgtgaggttggtgtgcaagcactcaagaaatgcgatgggcagctgtctaccgctcatgaagtagtgcctttcgccgtctttaagaatagtaaaaaggtgtacttagacaagctggatctcaaaacagaggagaaccttctgccagacagcttcgtttgttttgaacacaagggacagtataaaggcaccatggattcgggccagacgaagagagagttgaaatctttcgacatctcccaatgccccaagattgggggacacggttcaaagaaatgtactggcgatgctgccttttgcagtgcatacgaatgtacagcccagtatgctaatgcgttctgcagccatgcaaacgggtccggaatcgtgcagatccaagtctctggcgtgtggaagaaaccgctatgtgtaggttacgagagggttgtggtcaagcgggaactgagcgccaaacctattcagcgtgtggagccctgcaccacttgtataacaaagtgcgagccacacgggctcgtcgtgcgctcaaccggcttcaagatcagttccgctgttgcctgcgcaagcggagtgtgtgtaacgggctctcagtcacctagtaccgaaattacactgaaatatcccgggatcagccagtcctctggaggtgacataggcgtccatatggcccacgatgaccaatcggtgagctccaagattgttgctcattgcccaccccaggacccttgtcttgtgcacgggtgcatcgtctgtgcccacggactgatcaattaccagtgccatactgcattgtcagcgtttgtggtagtgttcgtttttagttctattgctatcatttgtctcgccatactgtatagagtcttaaaatgcctgaagatcgcaccaaggaaagtgctaaacccgctcatgtggattaccgccttcatccggtgggtgtacaagaaaatggtcgctcgagttgccgataacatcaatcaggtgaaccgcgagattggctggatggaaggtgggcaactggtgcttggcaatcccgcacctataccaagacacgctcccatccctaggtacagcacatatttgatgctgctcctgattgtatcctacgcctcagcgtgtagcgagcttatccaggcctcttcccggattactacctgcagtacagagggagtcaacaccaagtgtcgcctgagcggcactgctttgatcagagcagggtctgtgggagccgaggcttgcctcatgctgaagggtgttaaagaggaccagacgaagtttttaaaaataaagacagtgtcctcagaactgagttgcagggagggccagagctattggaccgggtcgttctccccaaaatgtctatctagccgtcggtgccatctcgtcggagaatgtcacgtgaatcgatgcctgtcatggagagataacgagacttccgccgagttttccttcgttggcgaatctaccacaatgagggagaataagtgttttgaacaatgcggtgggtggggctgtggatgcttcaacgtgaatcccagctgtctttttgtacacacctacttgcagtccgtccgcaaggaggcactgcgggtgttcaactgcatcgactgggtgcataaactcactctggaaattacagattttgacggctcagtcagcacgatcgatttaggggcgagttcttccagattcaccaattggggaagcgtttcgctgtcacttgacgccgagggcatttctggtagtaactccttcagctttatcgagtctccggggaagggatatgctatagtggatgaacctttcagcgagattccaaggcagggctttttgggtgaaatccgctgtaattccgagtcaagtgtactcaacgcccacgaaagctgcctgcgagcacccaatctaatttcttacaaacctatgatcgaccagctggagtgcactacaaacctcatagatcccttcgtggtctttgagcggggctccctgccacaaacccgtaacgacaagacattcgctgcctcaaaagggaatagaggagtgcaggcatttagtaagggcagcgttcaggccgatcttactttgatgttcgacaactttgaagtggacttcgtcggggctgcggtgtcctgtgatgccgcatttctgaatttaaccggatgctattcttgtaacgctggcgccagggtttgcctctcgatcacgagcaccggtacagggactctgtcagcccataataaggagggatcccttcacattgtgctgcctagtgaaaacggcaccaaagaccaatgtcagatcttgcatttcacagtccccgaggtagaggaagagtttatgtactcttgcgatggtgacgaacgcccactcctggtgaagggcactctaattgctatcgatccgttcgacgatcggagagaggcagggggagaaagcaccgttgtgaatcctaaatccggctcatggaacttctttgactggttctctgggctgatgagctggtttggaggccccctcaagacgatactgcttatttgtttgtacgtcgccctgagtatcggtttattctttctcctgatctatcttgggaggacaggactgtccaaaatgtggctagcggctaccaagaaggccagctga

SEQ ID NO: 11148 - RNA, 3594 nt, synthetic construct
  misc_feature 1..3594: note = derived and/or modified CDS sequence (opt3) from RVFV(ANK-6087)__DQ380216.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctatttcgggaatccgcgaagtgaagacctcaagccaggagctatatcgagcactcaaagccattatcgcggctgacggtctgaataacataacatgtcacggcaaggatccagaggacaaaatcagtcttattaaggggccgccccataaaaagcgtgtcggaatcgtgagatgcgaaaggcggcgcgatgccaagcaaattggcagagagactatggcaggtatcgccatgaccgttctgcctgctttggcagtgtttgccctcgctccagtcgtgttcgccgaagacccccacctgaggaatcggcctgggaaaggacataactacatagatggcatgacacaggaggacgcgacctgtaagccagtaacttatgcaggcgcctgctcctcttttgatgttctgctcgaaaaagggaagttccccttatttcagagctacgctcaccatcgcacactgcttgaggccgtgcacgacaccattatcgcaaaagctgatcctccatcctgtgacttgcagtcagcccacggaaatccgtgcatgaaggagaagctggtcatgaaaacgcattgtcccaacgattatcaaagtgcgcactacctaaataacgacggtaagatggccagcgtgaaatgccctccaaagtatgaactcactgaggactgtaatttctgccgacagatgaccggcgcatctctgaaaaaggggtcctacccccttcaggatctgttttgccagtcaagcgaagacgatggaagtaaattgaagacaaagatgaaaggcgtgtgtgaggtcggtgttcaagctctcaagaaatgcgacgggcagctgtctactgcccatgaagtggtacctttcgctgtgtttaagaactccaaaaaggtctacttagataagctggacctcaaaaccgaggagaatcttctgccagatagcttcgtgtgttttgaacacaagggacagtataaaggcaagttggactcgggccagacaaaaagagagctaaagtctttcgatatttcccaatgccccaagatcgggggacacggtagtaaaaagtgtaccggcgacgccgcattttgctcagcctacgaatgtacggctcagtatgcgaacgcatactgcagccatgccaatgggtccggaatcgttcagattcaagtgtctggcgtctggaaaaagccgctgtgtgtgggttatgagagggtagttgtgaaacgggaactcagcgctaagcctatacagcgtgtcgagccctgcactacatgtatcaccaagtgcgagccacacgggctggtggtccgctcaactggcttcaaaattagttccgccgtggcatgcgccagcggagtttgtgtgacaggctctcagtcacctagtaccgaaatcacgcttaagtaccccgggataagccagtcctctggaggtgatattggcgtacatatggctcacgacgaccaatcggtcagctccaaaatcgtggcccattgcccaccccaggatccttgtctggttcacgggtgcatcgtgtgtgcacacggattgattaactatcagtgccataccgcgctctcagctttcgtcgtggtatttgtgttcagttctatcgccattatatgtctggcaatcttatacagagttctgaagtgcctaaaaattgccccaaggaaggtcctcaatccgctgatgtggatcacagcttttatccggtgggtgtaccgaaaaatggtggcccgcgtcgcagacaacattaaccaggttaatagagagataggctggatggaaggtgggcaacttgtgttgggcaaccccgctcctatcccaaggcacgtgcccattcctcggtatagcacttacctgatgctcctgcttatcgtatcctatgcctcagcgtgtagcgagctgattcaggcctcttcccgcatcaccacatgcagtactgagggagtcaataccaagtgtagattgagcggcacagctctcataagggcagggtctgtgggagccgaggcttgcctgatgttaaagggtgttaaagaggatcagaccaagttcctgaaaatcaagactgtgtcctcagaactaagttgccgtgagggccagagctactggacggggtcgttttccccaaaatgtctctctagccggcgatgccatctggtcggagaatgtcacgtgaacagatgcctttcatggagggacaatgagacaagtgccgagttctcctttgttggcgaatctaccactatgcgcgagaacaagtgtttcgaacaatgcggtgggtggggctgtggatgctttaatgtgaaccccagctgtttgttcgtacacacctatctgcagtccgtccggaaggaggcactcagagtgtttaattgcattgattgggtgcataaactgacattagaaatcaccgacttcgatggctcagtcagcactattgacctgggggcgagttcttccaggtttacaaactggggaagcgtttcgctttcattggatgccgagggcatctctggtagtaattccttcagcttcatagagtctccggggaagggatacgctattgtggacgaaccttttagcgagatcccacgccagggcttcctcggtgaaattcgatgtaactccgagtcaagtgtactgagcgcccacgaatcttgcctacgggcacccaatctgatctcctataaacctatgatagatcagctcgagtgctcaacgaacctgatcgacccctttgtggtcttcaagcgtggcagtcttccacaaaccagaaatgataaaacttttgctgccagcaaggggaacaggggagtgcaggcattctccaagggctctgttcaggccgacttgacactgatgtttgacaacttcgaggtggattttgtcggggctgcggtgtcgtgtgacgccgcattcttaaatctcaccggatgctacagctgtaacgctggcgcccgcgtttgcctgtcaattacatccactggtaccgggacgcttagtgcccataataaagatggatctctgcacatcgtgttgcctagcgaaaacggcaccaaggaccaatgtcagattctccattttacagtccccgaggtagaagaggagttcatgtactcctgcgatggtgacgaacggccactgctagtgagaggcactctgatcgctatagatccgtttgacgataggcgagaggcagggggagaatcaaccgttgtgaatcctaaatctggcagctggaacttcttcgactggtttagtgggctcatgtcctggttcggaggccccctgaagacaattcttttgatctgtctgtatgtcgccttaagcatcggtctctttttcctgcttatttacctggggcgcactggactatctaaaatgtggctcgcggctaccaagaaggcctcatga

SEQ ID NO: 11149 - RNA, 3594 nt, synthetic construct
  misc_feature 1..3594: note = derived and/or modified CDS sequence (opt3) from RVFV(SAUDI 200010901)__KU978778.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaggagctgtcctgctctgtgtcgggtattcgcgaagtcaagacctcaagccaggagctatatcgagcactcaaagccatcattgcggctgacggtctgaataacatcacatgtcacggcaagaatccagaggataaaataagtcttatcaaggggccgccccataaaaagcgtgtgggaattgttagatgcggcaggcggcgcgacactaagcaaatcggtagagaaaccatggccgggattgcaatgacagtgctgcctgccttggctgtctttgcactcgccccagtggtattcgctgaggatccccacctgaggaaccggcctggaaaaggccataattacatcgacggcatgacccaggaagatgccacttgtaagccagttacatatgcgggggcatgctcctcttttgacgtgctgctcgagaaaggaaagttccccttatttcagagctacgcccaccatcgcaccctgcttgaagctgtccacgatacgataattgccaaagcagaccctccatcctgtgatttgcagtcagctcacggtaacccgtgcatgaaggagaagctggtgatgaaaactcattgtcccaatgactatcaaagtgcccactacctaaacaatgatggcaagatggcgagcgtgaaatgccctccaaagtatgagctcaccgaagactgtaacttctgccgacagatgacaggggcctctctgaaaaagggatcctacccccttcaggacctgttttgccagtcaagcgaggatgacggcagtaaattgaagactaagatgaaaggtgtctgtgaagttggggtgcaagcactcaagaaatgcgatggacagctgtctaccgctcatgaggtagtgcctttcgccgtctttaagaatagtaaaaaggtgtacttagacaagctggatctcaaaacagaagagaaccttctgccagacagcttcgtttgttttgagcacaagggccagtataaaggcaccatggattcggggcagacgaagagagaattgaaatctttcgacatctcccaatgccccaagattggaggtcacggctcaaagaaatgtactggggatgctgccttttgcagtgcatacgagtgtacagcccagtatgctaatgcgttctgcagccatgcaaacggatccggcatcgtgcagatccaagtctctggtgtgtggaagaaaccgctatgtgtagggtacgaaagggttgtggtcaagcgggagctgagcgccaaacctattcagcgtgtggaaccctgcaccacttgtataacaaagtgcgagccacacggcctcgtcgtgcgctcaaccggattcaagatcagttccgctgttgcctgcgcaagcggcgtgtgtgtaacggggtctcagtcacctagtaccgagattacactgaaatatcccggaatcagccagtcctctggtggcgacataggggtccatatggcccacgatgaccaatcggtgagctccaagattgttgctcattgcccaccccaggacccttgtcttgtgcacggatgcatcgtctgtgcccacggcctgatcaattaccagtgccatactgcattgtcagcgtttgtggtagtgttcgtttttagttctattgctatcatttgtctcgccatactgtatagagtcttaaaatgcctgaagatcgcaccaaggaaagtgctaaacccgctcatgtggattaccgccttcatccggtgggtgtacaagaaaatggtcgctcgagttgccgataacatcaatcaggtgaaccgcgaaattggttggatggaagggggccaactggtgcttggaaatcccgcacctataccaagacacgctcccatccctaggtacagcacatatttgatgctgctcctgattatctcctacgcctcagcgtgtagcgaacttattcaggcctcttcccggatcactacctgcagtacagagggcgtaaacaccaagtgtcgcctgagcgggactgctttgataagagcaggatctgtcggtgccgaggcttgcctcatgctgaagggcgtgaaagaagaccagacgaagtttttaaaaatcaagacagtttcctcagagctgagttgcagggaagggcagagctattggaccggatcgttctccccaaaatgtctatctagccgtcggtgccatctcgtgggcgagtgtcacgtcaatcgatgcctgtcatggagagataacgaaacttccgccgagttttccttcgtgggtgagtctaccacaatgagggaaaataagtgttttgagcaatgcgggggctggggatgtggctgcttcaacgttaatcccagctgtctttttgtgcacacctacttgcagtccgtacgcaaggaagcactgcgggtcttcaactgcattgactgggtgcataaactcactctggagatcacagattttgacgggtcagtgagcacgattgatttaggagcgagttcttccagattcaccaattggggcagcgtctcgctgtcacttgacgccgaaggtatctctgggagtaactccttcagctttatagagtctccgggaaagggctatgctattgttgatgagcctttcagcgaaatcccaaggcagggatttttgggcgagattcgctgtaattccgaatcaagtgtgctcagcgcccacgagtcttgcctgcgagcacccaacctaatctcctacaaacctatgatagaccagctggaatgcactacaaatctcatcgatcccttcgtagtgtttgagcgggggtcactgccacaaacccgtaacgagaagacattcgctgccagtaaaggaaacagaggcgtccaggcatttagcaaggggtccgtgcaggccgaccttactttgatgttcgataattttgaagttgacttcgtgggagctgcggtctcttgtgacgccgcatttctgaacttaaccggctgctattcgtgtaatgctggtgccagggtgtgcctcagcattacgtcaaccgggacaggaactctgtccgcccataacaaggatggcagtcttcacatcgttctgccttctgagaatggtaccaaagaccaatgtcagattttgcatttcacagtgcccgaagtcgaggaggaatttatgtacagctgcgatggcgacgagcgcccactcctggtaaaggggactctaatcgctatagatccgttcgacgatcggagagaagcaggaggcgagtccaccgtggttaaccctaaatcagggtcttggaatttctttgactggttcagcggactgatgagttggtttggcggtcccctcaagacgattctgcttatctgtttgtacgtggccctgtccatcgggttattctttctcctgatttatcttggaaggacaggcctgagcaaaatgtggctagcggctaccaagaaggcctcttga

SEQ ID NO: 11150 - RNA, 3594 nt, synthetic construct
  misc_feature 1..3594: note = derived and/or modified CDS sequence (opt3) from RVFV(35/74)__JF784387.1__GP
  source 1..3594: mol_type = other RNA
atgtacgtgctgctcaccatccttattacagtcctggtttgcgaggccgtgataagagtgagcttgtcctctactagggaagagacgtgtttcggcgactataccaaccccgaaatgatcgagggggcttgggattcattacgggaagaggagatgcctgaagaactgagttgcagcatttccggaatccgcgaagtaaagacatcttcgcaggagctataccgagcactcaaagccattatcgcggctgacggtctgaataacataacttgtcacggcaaggatccagaggacaaaatctcacttgtcaaggggccgccccataaaaagcgtgtgggaattgttagatgcgaaaggcggcgcgatgccaagcaaatcggcagagagaccatggcaggtattgccatgacagtgctgcctgctttggcagtctttgccctcgctccagtggtattcgccgaagacccccacctgaggaatcggcctgggaaaggacataactatatcgatggcatgacccaggaggacgcgacttgtaagccagttacatacgcaggcgcctgcagcagttttgatgtgctgctcgaaaaagggaagttccccttatttcagtcctatgctcaccatcgcaccctgcttgaggccgtccacgacacgataattgcaaaagctgatcctccatcttgtgacttgcagagcgcccacggaaatccgtgcatgaaggagaagctggtgatgaaaactcattgtcccaacgattaccaatccgcgcactatctaaataacgacggtaagatggcctcagtgaaatgccctccaaagtacgaactcaccgaggactgtaatttctgccgacagatgacaggcgcaagtctgaaaaaggggagctacccccttcaggatctgttttgccagtcttccgaagacgatggatcaaaattgaagactaagatgaaaggcgtctgtgaggttggtgtgcaagctctcaagaaatgcgacgggcagctgagcaccgcccatgaagtagtgcctttcgctgtctttaagaacagtaaaaaggtgtatttagataagctggacctcaaaacagaggagaatcttctgccagattctttcgtttgttttgaacacaagggacagtacaaaggcaccatggactccggccagacgaagagagagttgaaatcgttcgatatcagccaatgccccaagattgggggacacggttctaagaaatgtactggcgacgccgcattttgctccgcctatgaatgtacagctcagtacgcgaacgcatattgctcacatgccaatgggagtggagtggtccagatccaagtgagcggcgtatggaagaaaccgctatgtgttggttacgagagggtggtcgtgaagcgggaactgtccgctaaacctatccagcgtgtcgagccctgcaccacttgtattacaaagtgcgagccacacgggctcgtggttcgctctaccggcttcaagataagctcagccgtggcatgcgccagtggagtatgtgtcacgggctcccagagcccttctaccgaaatcacactgaaatatcccgggatttcacagagtagcggaggtgatatcggcgtgcatatggctcacgacgaccaatccgtttcttcgaagatagtggcccattgcccaccccaggatccttgtcttgtccacgggtgcattgtgtgtgcacacggactgatcaactaccagtgccatactgcgttgagcgctttcgtagtggtttttgtcttctcctcagtggccatcatttgtctcgcaatcctgtacaaagtgttaaagtgcctgaaaattgccccaagaaaggtcctagacccgctcatgtggataaccgtttttatcaggtgggtgtataaaaagatggtggctcgggtagccgataatattaaccaggtcaaccgagagatcggctggatggaaggtgggcaactggcacttggcaatcccgctcctatcccacgccacgcccccattcctagatacagtacatatttgatgctgctcctgatagtgtcttacgcgagcgcctgttccgagcttatccaggcttcaagcaggattactacctgctctacagagggagttaacaccaagtgtcggctgtccggcactgcattgatccgcgccgggagtgtgggagctgaagcctgcctcatgctgaaaggtgtcaaggaggaccagacgaaattcttaaagattaaaacagtgagctctgaactgtcctgcagagagggccagtcatattggaccgggagttttagcccaaagtgtctatcgtccaggcgttgccatctcgttggagaatgtcacgtgaatcggtgcctgtcttggcgagataacgagactagcgcagagttctcatttgtaggcgaaagtaccacaatgagagagaataagtgtttcgaacaatgcggtgggtggggctgtggatgctttaacgtcaatccctcctgtcttttcgtgcacacctacttgcagtctgtgaggaaagaggcgctgcgcgtctttaactgcatcgactgggttcataagctcactctggaaataacagatttcgacggcagcgtgtccacgatcgatttaggggcctcaagcagtcggtttaccaattggggatctgtatccctgagccttgacgctgagggcatttcgggttcaaactctttcagtttcatcgagtccccggggaaaggatatgccattgtggatgaaccttttagcgagatcccaagacagggcttcttgggtgaaataaggtgtaattctgagagctccgtcctctcagcacacgaaagttgcctgcgcgctcccaacctaattagctacaagcctatgatcgaccagctggagtgcactacaaatctcattgatccctttgtggttttcgagcgaggctctctgccacaaacccggaacgacaaaacatttgccgcatccaaggggaatcgtggagtgcaggccttctcaaagggcagtgtccaggctgaccttactttgatgtttgataacttcgaagtggactttgttggggcggccgtgagctgtgatgcagctttcctgaacttaaccggatgctactcctgtaatgccggcgccagagtctgcctctctatcacgtcgaccggtacagggactctgagcgctcataacaaagacggatcacttcacatagtactgccttccgagaatggcaccaaggatcaatgtcagatcttgcattttacagtgcccgaagttgaggaggagttcatgtatagttgcgacggtgatgagaggccactcctggtgaaaggcactctaattgcaatcgacccgtttgatgaccgccgggaagccgggggagagtctaccgtcgtgaaccctaagagcggctcctggaatttcttcgattggttttcagggctgatgtcttggttcggaggccccctcaaaacgattctgcttatctgtttgtacgtagcgctgagcataggtttatttttcctcctgatttatcttgggagaacaggactgagtaagatgtggctagctgccaccaagaaagcatcctga

SEQ ID NO: 11151 - RNA, 3594 nt, synthetic construct
  misc_feature 1..3594: note = derived and/or modified CDS sequence (opt3) from RVFV(KEN/Kil-006/07)__HM586966.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctgtgtcggggattcgcgaagtcaagacctcaagccaggagctatatcgagcactcaaagccatcattgcggctgacggtctgaataacatcacatgtcacggcaagaatccagaggataaaataagtcttatcaaggggccgccccataaaaagcgtgtgggagttgtgagatgcgaaaggcggcgcgacgccaagcaaattggcagagagactatggcaggtatcgccatgaccgtcctgcctgctttggcagtgtttgccctcgctccagtagttttcgccgaagatccccacctgaggaaccggcctgggaaaggacataattacattgacggcatgacacaggaggatgcgacctgtaagccagtgacttatgcaggcgcctgctcctcttttgacgtcctgctcgaaaaagggaagttccccttatttcagagctacgctcaccatcgcacactgcttgaggccgtgcacgataccatcatagcaaaagctgaccctccatcctgtgatttgcagtcagccgacggaaacaagtgcatgaaggagaaactggtgatgaagacgcactgtccgaatgattatcaaagtgcgcattacctaaacaatgacggtaaaatggccagcgtcaagtgtccccctaaatatgaactcactgaggactgcaacttctgccgacagatgaccggcgcatctctgaagaaagggtcctacccacttcaggatctgttttgccagtcaagcgaagacgatggaagtaagttgaagacaaaaatgaagggcgtttgtgaggtgggtgtacaagctctcaaaaagtgcgacgggcagctgtctactgcccacgaagtggtccccttcgctgtgtttaaaaattccaagaaggtttacttagataaactggacctcaagaccgaggagaaccttctgcctgatagcttcgtgtgttttgaacataaaggacagtataagggcacaatggactcgggccagaccaaaagagagttgaagtctttcgatatttcccaatgcccaaagatcgggggacacggtagtaaaaagtgtacgggcgacgccgcattttgcagtgcctacgaatgtactgctcagtatgcgaatgcatactgcagccacgccaacgggtccggaattgtccagatccaagtgtctggcgtatggaaaaagcccctatgtgttggttatgagagggtggtcgtgaaacgggaactgagcgctaagccgatccagcgtgtcgagccttgcacaacctgtattactaagtgcgagccccatgggctcgtggttcgctcaacaggcttcaaaataagttccgccgtggcatgcgccagcggagtatgtgtcaccggctctcagtcaccaagtacggaaatcaccctgaagtaccctgggattagccagtcctctggaggtgatatcggcgtgcacatggctcatgacgaccaatcggttagctccaaaatagtggcccactgtcccccacaggatccctgccttgtccatgggtgcattgtgtgtgcacacggactgatcaattatcagtgccacacagcgttgtcagctttcgtagtgatctttgttttcagttctactgccattatctgtctcgcagtcctgtacagagtgttaaagtgcctgaaaattgcccctaggaaggtgctaaacccactcatgtggataaccgcttttatccggtgggtctacaaaaagatggttgcccgagtggcagacaacattaatcaggtgaaccgcgagatcggctggatggaaggtgggcaactggctcttggcaatccggcccccatccctagacatgcgccaattcccaggtatagcacatacttgatgctgctcctgatagtatcctatgcctcagcttgtagcgagcttatccaggcatcttcccggattactacctgcagtacagagggagtcaacaccaagtgtcgcctgagcggcactgccttgatcagagctgggtctgtgggagccgaagcatgcctcatgctgaaaggtgttaaggaggatcagacgaaattcttaaagattaaaacagtgtcctcagaactgagttgcagggagggccagagctactggaccgggtcgttttcccctaagtgtctatctagccgtcggtgccacctcgtcggagaatgtcatgtgaatcgatgcctgtcatggagagacaacgagacttcagcggagttctcctttgttggcgaatctaccacaatgagggagaataagtgtttcgaacaatgcggtgggtggggctgtggatgctttaacgtgaatccaagctgtcttttcgtacacacctatttgcagtccgtccgcaaagaggccctgcgggtgtttaactgcatcgattgggtgcacaagctcactctggaaataacagacttcgatggctcagtcagcacgatcgacttaggggctagttcttccagatttaccaattggggaagcgtttcgctgtcacttgatgccgagggcatttctggtagtaactccttcagcttcatcgagtctcccgggaaaggatacgcaattgtggacgaaccgtttagcgagatccctaggcagggcttcttgggtgaaatacgctgtaattccgagtcaagtgtactcagcgctcatgaatcttgcctgcgagccccaaacctagtgtcctataagcccatgattgatcagctggagtgcactacaaatctcatcgacccttttgtcgtgttcgagcggggctcactgccccaaacccgtaacgataaaacatttgcagccagtaaggggaacagaggagttcaggctttcagcaagggctccgtgcaggcggaccttactttgatgtttgacaatttcgaagtcgattttgtgggggccgcagtttcttgtgacgctgccttcctgaacttaaccggatgctactcgtgtaatgccggcgctagggtgtgcctcagcattacgtcaaccggtacagggactctgtccgcacacaacaaagatggaagtcttcatatcgtcctgccatctgagaatggcaccaaggaccaatgtcagatattgcactttacagtacctgaagtggaggaggagttcatgtacagctgcgatggtgacgagcgccccctcctggttaaaggcactctaatcgccattgatccatttgacgatcggagagaagcgggaggagagtccaccgtggtcaacccgaagtcaggctcttggaatttcttcgactggtttagcgggctgatgagttggttcggaggccctctcaaaacgatcctgcttatttgtttgtatgtggctctgtccatcggtttatttttcctcctgatataccttgggaggacaggactgagcaagatgtggctagccgcaaccaagaaagcctcttga

SEQ ID NO: 11152 - RNA, 3594 nt, synthetic construct
  misc_feature 1..3594: note = derived and/or modified CDS sequence (opt3) from RVFV(MgH824)__DQ380210.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctatttcgggaatccgcgaagtgaagacctcaagccaggagctatatcgagcactcaaagccattatcgcggctgacggtctgaataacataacatgtcacggcaaggatccagaggacaaaatcagtcttattaaggggccgccccataaaaagcgtgtcggaatcgtgagatgcgaaaggcggcgcgatgccaagcaaattggcagagagactatggcaggtatcgccatgaccgttctgcctgctttggcagtgtttgccctcgctccagtcgtgttcgccgaagacccccacctgaggaatcggcctgggaaaggatacaactatatagatggcatgacacaggaggacgcgacctgtaagccagtaacttacgcaggcgcctgctcctcttttgatgttctgctcgaaaaagggaagttccccttatttcagagctatgctcatcaccgcacactgcttgaggccgtgcatgacaccattatcgcaaaagctgatcctccatcctgtgacttgcagtcagcccacggaaatccgtgcatgaaggagaagctggtcatgaaaacgcactgtcccaacgattaccaaagtgcgcattatctaaataacgacggtaagatggccagcgtgaaatgccctccaaagtacgaactcactgaggactgtaatttctgccgacagatgaccggcgcatctctgaaaaaggggtcctacccccttcaggatctgttttgccagtcaagcgaagacgatggaagtaaattgaagacaaagatgaaaggcgtgtgtgaggtcggtgttcaagctctcaagaaatgcgacgggcagctgtctactgcccacgaagtggtacctttcgctgtgtttaagaactccaaaaaggtctatttagataagctggacctcaaaaccgaggagaatcttctgccagatagcttcgtgtgttttgaaagaaagggacagtacaaaggcacaatggactcgggccagaccaagagggagttgaaatctttcgatatttcccaatgccccaagatcgggggacatggttcaaagaaatgtacgggcgacgccgcattttgcagtgcctatgaatgtactacacagtacgctaacgcgtattgcagccacgcaaatgggtccggagttgtgcagatccaagtctctggcgtgtggaagaaaccgctatgtgtaggttacgagcgggttgtggtcaagcgtgaactgagcgccaaacctattcagcgcgtggagccctgcaccacttgtataacaaagtgcgagccacacgggctcgtcgtgagatcaaccggcttcaagatcagttccgctgttgcctgcgcaagcggagtgtgtgtaacgggctctcagtcacctagtaccgaaattacactgaaatatcccgggatcagccagtcctctggaggtgatataggcgtccatatggcccacgacgaccaatcggtgagctccaagattgttgctcattgcccaccccaggatccttgtcttgtgcacgggtgcatcgtctgtgcccatggactgatcaactaccagtgccacactgcattgtcagcgttcgtggtagtgtttgttttcagttctattgctatcatttgtctcgccatactgtacagggtcttaaaatgcctgaagatcgcaccacggaaagtgctaaatccgctcatgtggattaccgcctttatccgatggatctataagaaaatggtggctcgcgtcgccgacaacattaaccaggttaatagagagataggctggatggaaggtgggcaactggtgcttggcaaccccgcacctatcccaaggcacgctcccattcctcggtacagcacatatttgatgctgctcctgatcgtgtcctacgcctcagcgtgtagcgagcttattcaggcctcttcccgcatcactacctgcagtacagagggagtagataccaagtgtagactgagcggcactgctttgataagggcagggtctgtcggagccgaggcttgcctcatgctgaagggtgtgaaagaggaccagacgaagttcttaaaaatcaagacagtttcctcagaactgagttgccgtgagggccagagctattggaccgggtcgttttccccaaaatgtctatctagccggcgatgccatctcgtgggagaatgtcacgtcaatagatgcctgtcatggagggataacgagaccagtgccgagttctcctttgtgggcgaatctactacaatgcgcgagaataagtgtttcgaacaatgcggtgggtggggctgtggatgctttaacgttaatcccagctgtcttttcgtgcatacctacttgcagtccgtacggaaggaggcactgagagtctttaactgcattgactgggtgcacaaactcactctggaaatcacagatttcgacggctcagtgagcacgattgatttaggggcgagttcttccaggtttaccaattggggaagcgtctcgctgtcacttgacgccgagggcatctctggtagtaactccttcagcttcatagagtctccggggaagggatatgctattgttgatgaaccttttccagagatcccccgccagggcttcttgggtgaaattcgatgtaatagcgagtcctcagtgctcagtgcccacgaaagctgcctgcgggcacctaacctaatctcttacaaacccatgatagaccagctggagtgcactacaaatctcatcgatccatttgtagtgttcgagcgtggctccctgcctcaaaccagaaacgacaagacatttgctgcctcaaaagggaataggggagtccaggcattcagtaagggcagcgtgcaggccgaccttactttgatgtttgataacttcgaagttgactttgtgggggctgcggtctcctgtgatgccgcattcctgaacttaaccggatgctactcttgtaatgctggcgcccgcgtgtgcctctcgattacgagcaccggtacagggtcactgtccgcccataacaaggacggaagtcttcacatcgttctgccctctgagaatggcactaaagatcaatgtcagattttgcattttaccgtgccagaagtcgaggaggagttcatgtatagctgcgacggtgatgaacggccgctcctggtaaagggcacactaatcgctatagacccttttgatgacagaagggaagcagggggagagtccactgtggttaaccccaaatcaggctcttggaatttcttcgattggtttagcgggctgatgagttggttcggaggcccactcaagaccattctgcttatctgtttgtacgtggccctgtccatcggtttatttttcctcctgatttatcttgggcgaacgggactgagcaaaatgtggctagcggctacaaagaaggcctcttga

SEQ ID NO: 11153 - RNA, 3594 nt, synthetic construct
  misc_feature 1..3594: note = derived and/or modified CDS sequence (opt3) from RVFV(Kenya 57 (Rintoul))__DQ380192.1__GP
  source 1..3594: mol_type = other RNA
atgtacgccctgctcaccatccttattagcgtgctggtctgcgaggctgttataagagtgtccttgtcttcaacaagggaagagacttgtttcggcgacagtacgaaccccgaaatgatcgagggggcatgggatagcttacgggaagaggagatgcctgaagaactgtcctgctctatttcgggaatccgcgaagtaaagacctcaagccaggagctacaccgagccctcaaagcgattatcgctgccgacggtctgaataacataacatgtcatggcaaggatccagaggacaaaatcagtcttattaaggggccgccccacaaaaagcgtgtgggagtcgtgagatgcgaaaggcggcgcgatgcaaagcaaatcggcagagagactatggccggtattgctatgaccgttctgcctgcattggccgtgtttgctctcgccccagtcgtgttcgcggaagacccccatctgaggaatcggcctgggaaaggacacaactatatcgatggcatgacacaggaggacgcaacctgtaagccagtaacttacgccggcgcttgctcctcttttgatgttctgctcgaaaaagggaagttccccttatttcagagctatgcccatcaccgcacactgcttgaggcagtgcacgacaccataattgctaaagccgatcctccatcctgtgacttgcagtcagcgcatggaaatccgtgcatgaaggagaagctggtcatgaaaacgcactgtcccaacgattaccaaagtgcccattatctaaataacgacggtaagatggcaagcgtgaaatgccctccaaagtacgaactcactgaggactgtaatttctgccgacagatgaccggcgcttctctgaaaaaggggtcctatccccttcaggatctgttttgccagtcaagcgaagacgatggaagtaaattgaagacaaagatgaaaggcgtgtgtgaggtcggtgttcaagccctcaagaaatgcgacgggcagctgtctactgctcacgaagtggtacctttcgccgtgtttaagaactccaaaaaggtctacttagataagctggacctcaaaaccgaggagaatcttctgccagatagcttcgtgtgttttgaacacaagggacagtacaaaggcacaatggactcgggccagatcaagagagagttgaaatctttcgatatttcccaatgccccaagatcgggggacatggttcaaagaaatgtaccggcgacgcagccttttgcagtgcttatgaatgtacggcgcagtacgcaaacgcctattgcagccacgctaatgggtccggaatcgttcagattcaagtgtctggcgtctggaagaaaccgctatgtgtgggttacgagagggtagttgtgaagcgggaactgagcgccaaacctatacagcgtgtcgagccctgcactacatgtatcaccaagtgcgagccacatgggctcgtggtccgctcaactggcttcaagattagttccgcagtggcctgcgctagcggagtttgtgtgacaggctctcagtcacctagtaccgaaatcacgctgaaatatcccgggataagccagtcctctggaggtgatattggcgtacacatggcccatgacgaccaatcggtcagctccaagatcgtggcacactgcccaccccaggatccttgtcttgttcacgggtgcatcgtgtgtgcgcatggactgattaactaccagtgccacaccgctttgtcagccttcgtcgtggtatttgtgttcagttctgttgcaatcatttgtctcgccatactgtataaagtcttaaagtgcctgaaaatcgctccaagaaaggtgctaaatccgctcatgtggattacagcctttatcaggtgggtgtacaaaaagatggtcgcacgggttgctgacaacatcaaccaggtgaatcgagagattggctggatggaaggtgggcaactggtgcttggcaaccccgcccctataccacgccatgcgcccatccctagatacagcacttatttgatgctgctcctgattgtatcctacgcctcagcttgtagcgagcttatccaggcatcttccaggattaccacatgcagtactgagggagtcaataccaagtgtcggctgagcggcacagccttgatccgcgctgggtctgtgggagccgaagcatgcctcatgctgaaaggtgttaaggaggatcagaccaaattcttaaagataaaaactgtgtcctcagaactgagttgcagagagggccagagctattggacggggtcgttttccccaaagtgtctatctagcaggcgttgccacctcgtcggagaatgtcacgtgaaccggtgcctgtcatggcgagacaatgagacaagtgcggagttctcctttgttggcgaatctaccactatgagagagaacaagtgtttcgaacaatgcggtgggtggggctgtggatgctttaatgtgaaccccagctgtcttttcgtacatacctacttgcagtccgtcaggaaagaggccctgcgcgtgtttaattgcatcgattgggtgcacaagctcacactggaaattaccgacttcgatggctcagtcagcactgttgacttaggggctagttcttcccggtttacaaactggggaagcgtgtcgctgtcacttgatgccgagggcatctctggtagtaattccttcagcttcattgagtctccggggaaaggatatgcaatcgtagacgaaccttttagcgagatatccagacagggcttcttgggtgaaattaggtgtaactcagagagtagcgtgctctctgctcatgaatcctgcctgcgcgccccaaatctaatctcatacaagcccatgattgatcagctggagtgcacgaccaacctcatcgacccttttgtcgtgttcgagcgaggcagtctgccccaaactcggaatgataaaacatttgcagccagcaaggggaaccgtggagttcaggctttctccaagggctctgtgcaggcggaccttaccttgatgtttgacaacttcgaagtcgattttgtgggggccgcagtttcgtgtgacgctgccttcctgaatttaacaggatgctatagctgtaacgccggcgctagagtgtgcctctcaataacttccaccggtacggggaccctgagtgcacacaataaagatggatctcttcatatcgtcctgccaagcgagaacggcacaaaggaccaatgtcagattttgcactttactgtacctgaagtggaggaggagttcatgtactcctgcgatggtgacgagaggcccctcctggttaaaggcaccctaatcgccattgatccatttgacgatcgccgggaagctgggggagagtcaacagtggtcaatccgaagtctggcagctggaacttcttcgactggtttagtgggctgatgtcctggttcggaggccctctcaaaactatcctgcttatatgtttgtacgtggcgctgagcattggtttatttttcctcctgatctatcttgggagaaccggactgtctaagatgtggctagccgcaacgaagaaagcctcatga

SEQ ID NO: 11154 - RNA, 3594 nt, synthetic construct
  misc_feature 1..3594: note = derived and/or modified CDS sequence (opt3) from RVFV(SA-75)__DQ380189.1__GP
  source 1..3594: mol_type = other RNA
atgtacgtgctgctcaccatccttattacagtcctggtttgcgaggccgtgataagagtaagcctgtcctctactagggaagagacgtgtttcggcgactataccaaccccgaaatgatcgagggggcttgggattcattacgggaagaggagatgcctgaagaactgagttgcagcatttccggaatccgcgaagtgaagacatcttcgcaggagctataccgagcactcaaagccattatcgcggctgacggtctgaataacataacttgtcacggcaaggatccagaggacaaaatctcacttgtcaaggggccgccccataaaaagcgtgtgggaattgttagatgcgaaaggcggcgcgatgccaagcaaatcggcagagagaccatggcaaggattgccatgacagtgctgcctgctttggcagtctttgccctcgctccagtggtattcgccgaagacccccacttgcggaatcgccctggtaaagggcataactatatcgatggaatgacccaggaggacgcgacttgtaagccagttacatacgcaggcgcctgcagcagttttgatgtgctgctcgaaaaaggcaagttccccttatttcagtcctatgctcaccatcgaaccctgcttgaggccgtccacgacacgataattgcaaaagctgatcctccatcttgtgacttgcagagcgcccacgggaatccgtgcatgaaggagaagctggtgatgaaaactcattgtcccaacgattaccaatccgcgcactatctaaataacgacggaaagatggcctcagtgaaatgccctccaaagtacgaactcaccgaggactgtaatttctgcagacagatgacaggtgcaagtctgaaaaagggcagctacccccttcaggatctgttttgccagtcttccgaagacgatgggtcaaaattgaagactaagatgaaaggagtctgtgaggttggcgtgcaagctctcaagaaatgcgacggtcagctgagcaccgcccatgaagtagtgcctttcgctgtctttaagaacagtaaaaaggtgtatttagataagctggacctcaaaacagaggagaatcttctgccagattctttcgtttgttttgaacacaaggggcagtacaaaggaaccatggactccggccagacgaagagggagttgaaatcgttcgatatcagccaatgccccaagattggcgggcacggatctaagaaatgtactggtgacgccgcattttgctccgcctatgaatgtacagctcagtacgcgaacgcatattgctcacatgccaatggcagtggggtggtccagatccaagtgagcggagtatggaagaaaccgctatgtgttggctacgagcgggtggtcgtgaagcgtgaactgtccgctaaacctatccagcgcgtcgagccctgcaccacttgtattacaaagtgcgagccacacggtctcgtggttagatctaccgggttcaagataagctcagccgtggcatgcgccagtggcgtatgtgtcacgggatcccagagcccttctaccgaaatcacactgaaatatcccggcatttcacagagtagcgggggagatatcggtgtgcatatggctcacgacgaccaatccgtttcttcgaagatagtggcccattgcccaccccaggatccttgtcttgtccacggctgcattgtgtgtgcacacgggctgatcaactaccagtgccatactgcgttgagcgctttcgtagtggtttttgtcttctcctcagtggccatcatttgtctcgcaatcctgtacaaagtgttaaagtgcctgaaaattgccccaaggaaggtcctaaatccgctcatgtggataaccgtttttatccggtgggtgtataaaaagatggtggctcgagtagccgacaacattaaccaggtcaatcgcgagatcggatggatggaaggcggtcaactggcacttgggaaccccgctcctatcccaagacacgcccccattcctaggtacagtacatatttgatgctgctcctgatagtgtcttacgcgagcgcctgttccgagcttatccaggcttcaagccggattactacctgctctacagagggcgttaataccaagtgtcgcctgtccggaactgcattgatcagagccggcagtgtgggggctgaagcctgcctcatgctgaaaggagtcaaggaggatcagacgaaattcttaaagattaaaacagtgagctctgaactgtcctgcagggagggtcagtcatattggaccggcagttttagcccaaagtgtctatcgtcccgtcggtgccatctcgttggggaatgtcacgtgaaccgatgcctgtcttggagagacaatgagactagcgcagagttctcatttgtaggagaaagtaccacaatgagggagaacaagtgtttcgaacaatgcggcggttgggggtgtggctgctttaatgtcaacccctcctgtcttttcgtgcacacctacttgcagtctgtgcgcaaagaggcgctgcgggtctttaattgcatcgattgggttcataagctcactctggaaataacagacttcgatggaagcgtgtccacgatcgacttaggcgcctcaagcagtagatttaccaactgggggtctgtatccctgagccttgatgctgagggaatttcgggctcaaattctttcagtttcatcgagtccccgggtaaagggtatgccattgtggacgaaccttttagcgagatcccaaggcagggattcttgggcgaaatacgctgtaactctgagagctccgtcctctcagcacacgaaagttgcctgcgagctcccaatctaattagctacaagcctatgatcgatcagctggagtgcactacaaacctcattgacccctttgtggttttcgagcggggttctctgccacaaacccgtaatgataaaacatttgccgcatccaagggcaacagaggggtgcaggccttctcaaagggaagtgtccaggctgaccttactttgatgtttgacaacttcgaagtggattttgttggcgcggccgtgagctgtgacgcagctttcctgaatttaaccgggtgctactcctgtaacgccggagccagggtctgcctctctatcacgtcgaccggcacaggtactctgagcgctcataataaagatgggtcacttcacatagtactgccttccgagaacggaaccaaggaccaatgtcagatcttgcattttacagtgcccgaagttgaggaggagttcatgtatagttgcgatggcgacgagcgcccactcctggtgaaaggtactctaattgcaatcgatccgtttgacgatcggagagaagccggcggggagtctaccgtcgtgaatcctaagagcggatcctggaacttcttcgactggttttcaggcctgatgtcttggttcgggggacccctcaaaacgattctgcttatctgtttgtacgtagcgctgagcataggcttatttttcctcctgatttatcttggtaggacagggctgagtaagatgtggctagctgccaccaagaaagcatcctga

SEQ ID NO: 11155 - RNA, 3594 nt, synthetic construct
  misc_feature 1..3594: note = derived and/or modified CDS sequence (opt3) from RVFV(SA01-1322)__KX096942.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaggagctgtcctgctctgtgtcgggtattcgcgaagtcaagacctcaagccaggagctatatcgagcactcaaagccatcattgcggctgacggtctgaataacatcacatgtcacggcaagaatccagaggataaaataagtcttatcaaggggccgccccataaaaagcgtgtgggaattgttagatgcggcaggcggcgcgacactaagcaaatcggtagagaaaccatggccgggattgcaatgacagtgctgcctgccttggctgtctttgcactcgccccagtggtattcgctgaggatccccacctgaggaaccggcctggaaaaggccataattacatcgacggcatgacccaggaagatgccacttgtaagccagttacatatgcgggggcatgctcctcttttgacgtgctgctcgagaaaggaaagttccccttatttcagagctacgcccaccatcgcaccctgcttgaagctgtccacgatacgataattgccaaagcagaccctccatcctgtgatttgcagtcagctcacggtaacccgtgcatgaaggagaagctggtgatgaaaactcattgtcccaatgactatcaaagtgcccactacctaaacaatgatggcaagatggcgagcgtgaaatgccctccaaagtatgagctcaccgaagactgtaacttctgccgacagatgacaggggcctctctgaaaaagggatcctacccccttcaggacctgttttgccagtcaagcgaggatgacggcagtaaattgaagactaagatgaaaggtgtctgtgaagttggggtgcaagcactcaagaaatgcgatggacagctgtctaccgctcatgaggtagtgcctttcgccgtctttaagaatagtaaaaaggtgtacttagacaagctggatctcaaaacagaagagaaccttctgccagacagcttcgtttgttttgagcacaagggccagtataaaggcaccatggattcggggcagacgaagagagaattgaaatctttcgacatctcccaatgccccaagattggaggtcacggctcaaagaaatgtactggggatgctgccttttgcagtgcatacgagtgtacagcccagtatgctaatgcgttctgcagccatgcaaacggatccggcatcgtgcagatccaagtctctggtgtgtggaagaaaccgctatgtgtagggtacgaaagggttgtggtcaagcgggagctgagcgccaaacctattcagcgtgtggaaccctgcaccacttgtataacaaagtgcgagccacacggcctcgtcgtgcgctcaaccggattcaagatcagttccgctgttgcctgcgcaagcggcgtgtgtgtaacggggtctcagtcacctagtaccgagattacactgaaatatcccggaatcagccagtcctctggtggcgacataggggtccatatggcccacgatgaccaatcggtgagctccaagattgttgctcattgcccaccccaggacccttgtcttgtgcacggatgcatcgtctgtgcccacggcctgatcaattaccagtgccatactgcattgtcagcgtttgtggtagtgttcgtttttagttctattgctatcatttgtctcgccatactgtatagagtcttaaaatgcctgaagatcgcaccaaggaaagtgctaaacccgctcatgtggattaccgccttcatccggtgggtgtacaagaaaatggtcgctcgagttgccgataacatcaatcaggtgaaccgcgaaattggttggatggaagggggccaactggtgcttggagaccccgcacctataccaagacacgctcccatccctaggtacagcacatatttgatgctgctcctgattatctcctacgcctcagcgtgtagcgaacttattcaggcctcttcccggatcactacctgcagtacagagggcgtaaataccaagtgtcgcctgagcgggactgctttgataagagcaggatctgtcggtgccgaggcttgcctcatgctgaagggcgtgaaagaagatcagacgaagtttttaaaaatcaagacagtttcctcagagctgagttgcagggaagggcagagctattggaccggatcgttctccccaaaatgtctatctagccgtcggtgccatctcgtgggcgagtgtcacgtcaaccgatgcctgtcatggagagacaatgaaacttccgccgagttttccttcgtgggtgagtctaccacaatgagggaaaacaagtgttttgagcaatgcgggggctggggatgtggctgcttcaatgttaaccccagctgtctttttgtgcacacctacttgcagtccgtacgcaaggaagcactgcgggtcttcaattgcattgattgggtgcataaactcactctggagatcacagactttgatgggtcagtgagcacgattgacttaggagcgagttcttccagattcaccaactggggcagcgtctcgctgtcacttgatgccgaaggtatctctgggagtaattccttcagctttatagagtctccgggaaagggctatgctattgttgacgagcctttcagcgaaatcccaaggcagggatttttgggcgagattcgctgtaactccgaatcaagtgtgctcagcgcccacgagtcttgcctgcgagcacccaatctaatctcctacaaacctatgatagatcagctggaatgcactacaaacctcatcgaccccttcgtagtgtttgagcgggggtcactgccacaaacccgtaatgagaagacattcgctgccagtaaaggaaacagaggcgtccaggcatttagcaaggggtccgtgcaggccgatcttactttgatgttcgacaactttgaagttgacttcgtgggagctgcggtctcttgtgatgccgcatttctgaatttaaccggctgctattcgtgtaacgctggtgccagggtgtgcctcagcattacgtcaaccgggacaggaactctgtccgcccataataaggacggcagtcttcacatcgttctgccttctgagaacggtaccaaagatcaatgtcagattttgcatttcacagtgcccgaagtcgaggaggaatttatgtacagctgcgacggcgatgagcgcccactcctggtaaaggggactctaatcgctatagacccgttcgatgaccggagagaagcaggaggcgagtccaccgtggttaatcctaaatcagggtcttggaacttctttgattggttcagcggactgatgagttggtttggcggtcccctcaagacgattctgcttatctgtttgtacgtggccctgtccatcgggttattctttctcctgatttatcttggaaggacaggcctgagcaaaatgtggctagcggctaccaagaaggcctcttga

SEQ ID NO: 11156 - RNA, 3594 nt, synthetic construct
  misc_feature 1..3594: note = derived and/or modified CDS sequence (opt3) from RVFV(KEN/Mal-032/07)__HM586967.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctgtgtcggggattcgcgaagtcaagacctcaagccaggagctatatcgagcactcaaagccatcattgcggctgacggtctgaataacatcacatgtcacggcaagaatccagaggataaaataagtcttatcaaggggccgccccataaaaagcgtgtgggaattgttagatgcgaaaggcggcgcgacgccaagcaaatcggcagagagactatggcaggtattgccatgaccgtgctgcctgctttggcagtctttgccctcgctccagtggtattcgccgaagatccccacctgaggaaccggcctgggaaaggacataattacatcgacggccgcctgcaggaggatgcgacatgtaagccagttacctatgcaggcgcctgctcctcttttgacgtgctcttagaaaaagggaagttccccctgtttcagagctacgctcaccatcgaactcttttggaggccgtccacgatacaataattgcaaaagctgaccctccatcctgtgatctgcagtcagccgacggaaacaagtgcatgaaggagaagctagtgatgaaaacccactgtccgaatgattatcaaagtgcgcattacctcaacaatgacggtaaaatggccagcgtgaagtgtccccctaaatatgaactgacggaggactgcaacttctgcagacagatgactggcgcatctcttaagaaagggtcctacccactgcaggatttgttttgccagtcaagcgaagacgatggaagtaagctcaagaccaaaatgaagggcgtctgtgaggttggtgtgcaagctctgaaaaagtgcgacgggcagttatctacagcccacgaagtagtgcccttcgctgtctttaaaaattccaagaaggtgtacctggataaactcgaccttaagactgaggagaacctgttgcctgatagcttcgtttgttttgaacataaaggacagtataagggcaccatggactcgggccagacaaaaagggagctaaagtctttcgatatctcccaatgcccaaagattgggggacacggtagtaaaaagtgtaccggcgacgccgcattttgctcagcctacgaatgtacggctcagtatgcgaatgcatactgcagccacgccaacgggtccggaatcgtgcagatccaagtctctggcgtgtggaaaaagcccctgtgtgtaggttatgagcgggttgtggtcaaacgtgaactcagcgctaagccgattcagcgcgtggagccttgcactacatgtataaccaagtgcgagccccatgggctggtcgtgagatcaactggcttcaaaatcagttccgccgttgcatgcgccagcggagtgtgtgtaacaggctctcagtcaccaagtaccgaaattacgcttaagtaccctgggatcagccagtcctctggaggtgatataggcgtccacatggctcatgacgaccaatcggtgagctccaaaattgttgcccactgtcccccacaggatccctgcctggtgcatgggtgcatcgtctgtgcacacggattgatcaattatcagtgccacaccgcgctctcagctttcgtggtaatttttgtgttcagttctacagccatcatttgtctggcagttttatacagggtcctgaagtgcctaaaaatagcccctcggaaggtgctcaacccactgatgtggatcactgcttttattcgatgggtgtacaaaaagatggtcgcccgcgttgcagacaacatcaatcaggtgaacagagagatcggctggatggaaggtgggcaacttgctttgggcaatccggcccccattcctaggcatgcgccaataccccggtatagcacctacctgatgctcctgcttatcgtgtcctatgcctcagcttgtagcgagctgattcaggcatcttcccgcatcacaacttgcagtaccgagggagtaaacacaaagtgtagattgagcggcaccgccctcattagggctgggtctgtcggagccgaagcatgcctgatgttaaaaggtgtgaaggaggatcagactaaattcctgaagatcaaaacggtttcctcagaactaagttgccgtgagggccagagctactggacagggtcgttttcccctaagtgtctctctagccggcgatgccacctggtgggagaatgtcatgtcaatagatgcctttcatggagggacaacgagaccagtgcggagttctcctttgtgggcgaatctactaccatgcgcgagaataagtgtttcgaacaatgcggtgggtggggctgtggatgctttaacgttaatccaagctgtttgttcgtgcacacatatctgcagtccgtacggaaagaggccctcagagtctttaactgcatagattgggtgcacaagctgaccttagaaatcactgacttcgatggctcagtgagcacaattgacctgggggctagttcttccaggtttacgaattggggaagcgtctcgctttcattggatgccgagggcatctctggtagtaactccttcagcttcattgagtctcccgggaaaggatacgcaatcgttgacgaaccgtttagcgagatacctcgccagggcttcctcggtgaaattcgatgtaattccgagtcaagtgtgctgagcgctcatgaatcttgcctacgggccccaaacctggtatcctataagcccatgatcgatcagctcgagtgcaccactaatctgattgacccttttgtggtcttcgagcgtggctcacttccccaaacaagaaacgataaaacctttgcagccagtaaggggaacaggggagtgcaggctttcagcaagggctccgttcaggcggacttgacactgatgtttgacaatttcgaagtggattttgtcggggccgcagtgtcttgtgacgctgccttcttaaacctcactggatgctactcgtgtaatgccggcgctcgcgtttgcctgagcatcacctcaacgggtaccgggacactttccgcacacaacaaagatggaagtctgcatatagtgttgccatctgagaatggcactaaggaccaatgtcagatcctccactttaccgtccctgaagtagaggaggagttcatgtacagctgcgatggtgacgagcggcccctgctagtgaaaggcacactgattgccatcgatccatttgacgatagaagggaagcgggaggagagtccactgttgtgaacccgaagtcaggctcttggaatttcttcgactggtttagcgggctcatgagttggttcggaggccctctgaaaaccattcttttgatctgtctgtatgtcgctttatccataggtctctttttcctgcttatttacctggggcgaacgggactaagcaagatgtggctcgccgcaacaaagaaagcctcttga

SEQ ID NO: 11157 - RNA, 3594 nt, synthetic construct
  misc_feature 1..3594: note = derived and/or modified CDS sequence (opt3) from RVFV(KEN/Gar-008/06)__HM586965.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaatcccgaaatgatcgagggggcttgggatagcttacgggaagaggagatgcctgaggaactgtcctgctctgtgtcggggattcgcgaagtcaagacctcaagccaggagctatatcgagcactcaaagccatcattgcggctgacggtctgaataacatcacatgtcacggcaagaatccagaggataaaataagtcttatcaaggggccgccccataaaaagcgtgtgggaattgttagatgcgaaaggcggcgcgacgccaagcaaatcggcagagagactatggcaggtattgccatgaccgtgctgcctgctttggcagtctttgccctcgctccagtggtattcgccgaagatccccacctgaggaaccggcctgggaaaggacataattacatcgacggcatgacacaggaggatgcgacctgtaagccagttacttatgcaggcgcctgctcctcttttgacgtgctgctcgaaaaagggaagttccccttatttcagagctacgctcaccatcgcacactgcttgaggccgtccacgataccataattgcaaaagctgaccctccatcctgtgatttgcagtcagcccacggaaacccgtgcatgaaggagaagctggtgatgaaaacgcattgtcccaatgactatcaaagtgcgcactacctaaacaatgatggtaagatggccagcgtgaaatgccctccaaagtatgaactcactgaggactgtaacttctgccgacagatgaccggcgcatctctgaaaaaggggtcctacccccttcaggacctgttttgccagtcaagcgaagatgacggaagtaaattgaagacaaagatgaaaggcgtctgtgaggttggtgtgcaagctctcaagaaatgcgatgggcagctgtctactgcccatgaagtagtgcctttcgctgtctttaagaatagtaaaaaggtgtacttagacaagctggatctcaaaaccgaggagaaccttctgccagacagcttcgtttgttttgaacacaagggacagtataaaggcacaatggattcgggccagaccaagagagagttgaaatctttcgacatctcccaatgccccaagattgggggacacggttcaaagaaatgtacgggcgatgccgcattttgcagtgcctacgaatgtactgctcagtatgcgaatgcatactgcagccatgccaacgggtccggaatcgtgcagatccaagtctctagggtgtggaagaaaccgctatgtgtaggctatgagcgggttgtggtcaagcgtgaactgagcgctaaacctattcagcgcgtggagccctgcacaacctgtataactaagtgcgagccacacggtctcgtcgtgagatcaacagggttcaagatcagttccgccgttgcatgcgccagcggcgtgtgtgtaaccggatctcagtcacctagtacggaaattaccctgaaataccccggcatcagccagtcctctgggggagacataggtgtccatatggctcacgatgaccaatcggtgagctccaagattgttgcccattgcccaccccaggacccttgtcttgtgcacggctgcatcgtctgtgcacacgggctgatcaattatcagtgccatacagcgttgtcagctttcgtggtaatttttgtgttcagttctactgccatcatttgtctcgcagttctgtacagggtcttaaaatgcctgaagatagccccacggaaagtgctaaacccgctcatgtggatcaccgcttttattcgatgggtgtacaagaaaatggtcgcccgcgttgcagataacatcaatcaggtgaacagagagatcggatggatggaaggcggtcaactggctcttgggaatcccgcccctattccaaggcacgcgcccatacctcggtatagcacatacttgatgctgctcctgatcgtgtcctatgcctcagcttgtagcgagcttattcaggcatcttcccgcatcactacctgcagtacagagggcgtaaacaccaagtgtagactgagcggaactgccttgattagggctggctctgtcggggccgaagcatgcctcatgctgaagggagtgaaagaggaccagacgaagttcttaaaaatcaagacagtttcctcagaactgagttgccgtgagggtcagagctactggaccggctcgttttccccaaaatgtctatctagccggcgatgccatctcgtgggggaatgtcacgtcaatagatgcctgtcatggagggataacgagacttccgcggagttctcctttgtgggagaatctaccacaatgcgcgagaataagtgtttcgaacaatgcggcggttgggggtgtggctgctttaacgttaatcccagctgtcttttcgtgcacacctatttgcagtccgtacggaaggaggccctgagagtctttaactgcatagactgggtgcataaactcactctggaaatcacagatttcgacggatcagtgagcacgattgatttaggcgctagttcttccaggtttaccaattgggggagcgtctcgctgtcacttgacgccgagggaatctctggcagtaactccttcagcttcattgagtctccgggtaaggggtacgcaatcgttgatgaaccttttagcgagataccacgccagggattcttgggcgaaattcgatgtaattccgagtcaagtgtgctcagcgctcacgaatcttgcctgcgggcccccaacctagtatcctataaacctatgatcgaccagctggagtgcactacaaatctcattgatccctttgtggtcttcgagcgtggttcactgccacaaaccagaaacgacaagacatttgcagccagtaaaggcaacaggggagtgcaggctttcagcaagggatccgttcaggcggatcttactttgatgtttgacaatctgaaggtggacttcgtcggcgccgcagtgtcttgtgatgctgcctttttaaacctcaccgggtgctactcgtgtaatgccggagctcgcgtttgcctgagcatcacgtcaaccggcacaggtactctttccgcacataacaaagacgggagtctgcacatagtgttgccttctgaaaatggaaccaaggatcaatgtcagatcctccatttcacagtccccgaggtaaaagaagagtttatgtacagctgcgacggcgatgagcgggccctgctaatgaagggtactctgattgcgatcgacccattcgatgacagaagggaagctggcggggagtccaccgtggttaacccgaaatcaggatcttggaactttttcgattggttcagcggcctcatgagttggtttgggggacctctgaagacgattcttttgatctgtctgtatgtggccttatccataggcctcttctttctgcttatttacctgggtcgaacagggctaagcaagatgtggctcgcagccaccaaaaaggcttcttga

SEQ ID NO: 11158 - RNA, 3594 nt, synthetic construct
  misc_feature 1..3594: note = derived and/or modified CDS sequence (opt3) from RVFV(Kenya 56 (IB8))__DQ380190.1__GP
  source 1..3594: mol_type = other RNA
atgtacgtgctgctcaccatccttattacagtcctggtttgcgaggccgtgataagagtgagcttgtcctctactagggaagagacgtgtttcggcgactcaaccagtcccgaaatgatcgagggggcttgggatagcttacgggaagaggagatgcctgaggagctgtcctgctctatttcgggaatccgcgaagtaaaaacatcaagccaggagctatatcgagcactcaaagccattatcgcggctgacggtctgaacaatataacttgtcacggcaaggatccagaggacaaaatcagtcttattaaggggccgccccataaaaagcaagtcggaatcgtgcgttgcgaaagaaggcgggatgccaagcagattggccgcgagaccatggcaggtatcgccatgacagttctgcctgctttggcagtgtttgccctcgctccagtcgtgttcgccgaagacccccacctgagaaacaggcctgggaaaggacataattacatagatggcatgacccagggcgacgcgacttgtaagccagtaacatatgcaggggcctgctcctcttttgatgttctgctcgagaaaggaaagttccccttatttcagagctacgctcaccatcggaccctgcttgaagccgtgcacgacacgattatcgcaaaagctgatcctccatcctgtgacttgcaatcagcccacggtaacccgtgcatgaaggagaagctggtcatgaaaactcattgtcccaaggattatcagagtgcgcactacctaaataacgacggcaaaatggccagcgtgaagtgccctccaaaatatgagctcaccgaagactgtaatttctgccgccagatgacaggggcatctctgaagaaaggatcctacccccttcaggatctgttttgccaatcaagcgaggacgatggcagtaagttgaagactaaaatgaagggtgtgtgtgaagtcggggttcaggctctcaaaaagtgcgacggacagctgtctaccgcccatgaggtggtacctttcgctgtgtttaaaaactccaagaaggtctacttagataaactggacctcaagacagaagagaatcttctgccagatagcttcgtgtgttttgagcacaaaggccagtataagggcaccatggactcggggcaaacgaaacgagaattgaagtctttcgatatttcccagtgccccaagatcggaggtcacggcagtaaaaagtgtactggggacgccgcattttgcagtgcctacgagtgtacagctcagtatgcgaacgcatactgcagccatgccaatggatccggcatcgttcaaattcaggtgtctggtgtctggaaaagaccgctatgtgtggggtatgaaagggtagttgtgaagcgggagctgagcgctaaacctatacagcgtgtcgaaccctgcaccacttgtatcacaaagtgcgagccacacggcctcgtggtccgctcaaccggattcaagattagttccgccgtggcatgcgccagcggcgtttgtgtgacggggtctcagtcacctagtaccgagatcacactgaaataccccggaatgagccaatcctctggtggcgatataggggtacatatggctcacgacgaccagtcggtcagctccaagattgtggcccattgcccaccccaggatccttgtcttgttcacggatgcatcgtgtgtgcacacggcctgatcaactatcagtgccatactgcgttgtcagctttcgtcgtggtatttgtgttcagttctgttgccattatctgtctcgcaattctgtacaaagtcttaaagtgcctgaaaatagccccaagaaaggtgctaaatccgctcatgtggatcaccgcttttattaggtgggtgtacaaaaagatggtcgcccgggttgcagacaacatcaatcaagtgaaccgagaaatcggttggatggaagggggccagcccgctctgggaaaccctgccccaattccccgccacgcgcctataccaagatatagcacataccttatgttgctgctcatcgtgtcctatgcctcagcttgtagcgaactgattcaggcatcttccaggatcactacctgcagtacagagggcgtaaataccaagtgtcggcttagcgggactgccctgattcgcgctggatctgtcggtgccgaggcatgcttgatgctcaaaggcgtgaaggaagatcagacgaaattcctgaagatcaaaacagtttcctcagagttaagttgcagagaagggcaaagctactggaccggatcgttttcccccaagtgtctgtctagcaggcgttgccatctagtgggcgagtgtcacgtcaaccggtgcctctcatggcgagacaatgaaacttcagcggagttctcctttgtgggtgagtctaccacaatgagagaaaacaagtgtttcgagcagtgcgggggctggggatgtggctgctttaatgttaacccgagctgtctgttcgtgcacacctatcttcagtccgtaaggaaagaagccttgcgcgtctttaattgcatagattgggtgcataagctgactctcgagatcacagacttcgatgggtcagtgagcacgattgacctgggagctagttcttcccggtttaccaactggggcagcgtctcgttatcactggatgccgaaggtatctctgggagtaattccttcagcttcattgagtctcctggaaaaggctacgcaatcgttgacgagccatttagcgaaatacccagacagggtttccttggcgagattaggtgtaactccgaatcaagtgtgttgagcgctcacgagtcttgcctccgcgcccctaatctgatctcctataagcccatgattgatcaactagaatgcactacaaacctgatcgacccatttgtagcattcgagcgagggtcactccctcagacccggaatgataaaacatttgccgctagtaagggaaaccgtggcgtgcaggcgttcagcaaggggtccgtccaagccgacctgactcttatgtttgacaatttcgaggtggattttgttggagcagctgtgtcttgtgacgccgccttcttgaacctgaccggctgctactcgtgtaacgctggtgcaagagtctgcttaagcataacgtcaaccgggacaggaactctctccgcccataataaagatggcagtctgcacatcgtgcttccctctgaaaacggtaccaaggaccagtgtcagattctgcattttacagttccagaggtggaagaggagttcatgtacagctgcgatggcgacgaaaggccgttgctcgtcaaagggactctgatcgcgattgatccttttgacgatcgccgggaggctggaggcgaatccaccgtagtgaatcccaagtcagggtcttggaacttcttcgactggtttagcggactaatgagttggttcggcggtccactgaaaacgatcctcctgatatgtctttatgttgccttgtccattgggctgtttttcttactcatctacctgggaagaacaggccttagcaagatgtggctggcagccaccaagaaggcttcttga

SEQ ID NO: 11159 - RNA, 3594 nt, synthetic construct
  misc_feature 1..3594: note = derived and/or modified CDS sequence (opt3) from RVFV(KEN/Bar-035/07)__HM586969.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctgtgtcgggtattcgcgaagtcaagacctcaagccaggagctatatcgagcactcaaagccatcattgcggctgacggactgaataacatcacatgtcacggcaagaatccagaggataaaataagtcttatcaaggggccgccccataaaaagcgtgtgggaattgttagatgcgaaaggcggcgcgacgccaagcaaatcggcagagagactatggcaggtattgccatgaccgtgctgcctgctttggcagtctttgccctcgctccagtggtattcgccgaagatccccacctgaggaaccggcctgggaaaggacataattacatcgacggccgcctgcaggaggatgcgacatgtaagccagttacctatgcaggcgcctgctcctcttttgacgtgctcttagaaaaagggaagttccccctgtttcagagctacgctcaccatcgaactcttttggaggccgtccacgatacaataattgcaaaagctgaccctccatcctgtgatctgcagtcagccgacggaaacaagtgcatgaaggagaagctagtgatgaaaacccactgtccgaatgattatcaaagtgcgcattacctcaacaatgacggtaaaatggccagcgtgaagtgtccccctaaatatgaactgacggaggactgcaacttctgcagacagatgactggcgcatctcttaagaaagggtcctacccactgcaggatttgttttgccagtcaagcgaagacgatggaagtaagctcaagaccaaaatgaagggcgtctgtgaggttggtgtgcaagctctgaaaaagtgcgacgggcagttatctacagcccacgaagtagtgcccttcgctgtctttaaaaattccaagaaggtgtacctggataaactcgaccttaagactgaggagaacctgttgcctgatagcttcgtttgttttgaacataaaggacagtataagggcaccatggactcgggccagacaaaaagggagctaaagtctttcgatatctcccaatgcccaaagattgggggacacggtagtaaaaagtgtaccggcgacgccgcattttgctcagcctacgaatgtacggctcagtatgcgaatgcatactgcagccacgccaacgggtccggaatcgtgcagatccaagtctctggcgtgtggaaaaagcccctgtgtgtaggttatgagcgggttgtggtcaaacgtgaactcagcgctaagccgattcagcgcgtggagccttgcactacatgtataaccaagtgcgagccccatgggctggtcgtgagatcaactggcttcaaaatcagttccgccgttgcatgcgccagcggagtgtgtgtaacaggctctcagtcaccaagtaccgaaattacgcttaagtaccctgggatcagccagtcctctggaggtgatataggcgtccacatggctcatgacgaccaatcggtgagctccaaaattgttgcccactgtcccccacaggatccctgcctggtgcatgggtgcatcgtctgtgcacacggattgatcaattatcagtgccacaccgcgctctcagctttcgtggtaatttttgtgttcagttctacagccatcatttgtctggcagttttatacagggtcctgaagtgcctaaaaatagcccctcggaaggtgctcaacccactgatgtggatcactgcttttattcgatgggtgtacaaaaagatggtcgcccgcgttgcagacaacatcaatcaggtgaacagagagatcggctggatggaaggtgggcaacttgctttgggcaatccggcccccattcctaggcatgcgccaataccccggtatagcacctacctgatgctcctgcttatcgtgtcctatgcctcagcttgtagcgagctgattcaggcatcttcccgcatcacaacttgcagtaccgagggagtaaacacaaagtgtagattgagcggcaccgccctcattagggctcgttctgtcggggccgaagcatgcctgatgttaaaaggagtgaaggaggatcagactaaattcctgaagatcaaaacggtttcctcagaactaagttgccgggagggtcagagctactggacaggctcgttttcccctaagtgtctctctagccgaagatgccacctggtgggggaatgtcatgtcaataggtgcctttcatggcgcgacaacgagaccagtgcggagttctcctttgtgggagaatctactaccatgcgggagaataagtgtttcgaacaatgcggcggttgggggtgtggctgctttaacgttaatccaagctgtttgttcgtgcacacatatctgcagtccgtaagaaaagaggccctcagggtctttaactgcatagattgggtgcacaagctgaccttagaaatcactgacttcgatggatcagtgagcacaattgacctgggcgctagttcttcccgctttacgaattgggggagcgtctcgctttcattggatgccgagggaatctctggcagtaactccttcagcttcattgagtctcccggtaaagggtacgcaatcgttgacgaaccgtttagcgagatacctcgacagggattcctcggcgaaattcggtgtaattccgagtcaagtgtgctgagcgctcatgaatcttgcctacgtgccccaaacctggtatcctataagcccatgatcgatcagctcgagtgcaccactaatctgattgacccttttgtggtcttcgagagaggttcacttccccaaacaaggaacgataaaacctttgcagccagtaagggcaaccgcggggtgcaggctttcagcaagggatccgttcaggcggacttgacactgatgtttgacaatttcgaagtggattttgtcggcgccgcagtgtcttgtgacgctgccttcttaaacctcactgggtgctactcgtgtaatgccggagctcgggtttgcctgagcatcacctcaacgggcaccggtacactttccgcacacaacaaagatgggagtctgcatatagtgttgccatctgagaatggaactaaggaccaatgtcagatcctccactttaccgtccctgaagtagaggaggagttcatgtacagctgcgatggcgacgagagacccctgctagtgaaaggtacactgattgccatcgatccatttgacgataggcgagaagcgggcggggagtccactgttgtgaacccgaagtcaggatcttggaatttcttcgactggtttagcggcctcatgagttggttcgggggacctctgaaaaccattcttttgatctgtctgtatgtcgctttatccataggcctctttttcctgcttatttacctgggtcgcacggggctaagcaagatgtggctcgccgcaacaaagaaagcctcttga

SEQ ID NO: 11160 - RNA, 3594 nt, synthetic construct
  misc_feature 1..3594: note = derived and/or modified CDS sequence (opt3) from RVFV(TAN/Dod-002/07)__HM586971.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctgtgtcggggattcgcgaagtcaagacctcaagccaggagctatatcgagcactcaaagccatcattgcggctgacggtctgaataacatcacatgtcacggcaagaatccagaggataaaataagtcttatcaaggggccgccccataaaaagcgtgtgggaattgttagatgcgaaaggcggcgcgacgccaagcaaatcggcagagagactatggcaggtattgccatgaccgtgctgcctgctttggcagtctttgccctcgctccagtggtattcgccgaagatccccacctgaggaaccggcctgggaaaggacataattacatcgacggcatgacacaggaggatgcgacctgtaagccagttacttatgcaggcgcctgctcctcttttgacgtgctgctcgaaaaagggaagttccccttatttcagagctacgctcaccatcgcacactgcttgaggccgtccacgataccataattgcaaaagctgaccctccatcctgtgatttgcagtcagcccacggaaacccgtgcatgaaggagaagctggtgatgaaaacgcattgtcccaatgactatcaaagtgcgcactacctaaacaatgatggtaagatggccagcgtgaaatgccctccaaagtatgaactcactgaggactgtaacttctgccgacagatgaccggcgcatctctgaaaaaggggtcctacccccttcaggacctgttttgccagtcaagcgaagatgacggaagtaaattgaagacaaagatgaaaggcgtctgtgaggttggtgtgcaagctctcaagaaatgcgatgggcagctgtctactgcccatgaagtagtgcctttcgctgtctttaagaatagtaaaaaggtgtacttagacaagctggatctcaaaaccgaggagaaccttctgccagacagcttcgtttgttttgaacacaagggacagtataaaggcacaatggattcgggccagaccaagagagagttgaaatctttcgacatctcccaatgccccaagattgggggacacggtaggaagaaatgtacgggcgatgccgcattttgctcagcctacgaatgtactgctcagtatgcgaatgcatactgcagtcatgccaacgggagcggaatcgtgcagatccaagtctccggcgtgtggaagaaaccgctatgtgtaggttatgagcgggttgtggtcaagcgtgaactgtctgctaaacctattcagcgcgtggagccctgcacaacctgtataactaagtgcgagccacacgggctcgtcgtgagaagcacaggcttcaagatctcaagtgccgttgcatgcgcctccggagtgtgtgtaaccggcagccagtctccttcaacggaaattaccctgaaataccccgggatcagtcagagctccggaggtgacataggcgtccatatggctcacgatgaccaatctgtgtcgagcaagattgttgcccattgcccaccccaggacccttgtcttgtgcacgggtgcatcgtctgtgcacaggcgtggatcatttcccagtggcacacagctctgtcagccttcgtggtaatctttgtgttcagttctactgcaattatatgcttggccgttctctatagggtcctgaaatgtttaaagatcgctccacggaaagtgctgaatccgctaatgtggattaccgcctttatccgatgggtgtacaagaaaatggtcgcacgcgttgctgataacatcaaccaagtgaatagagagattggatggatggaaggcggtcagctcgccctggggaaccccgcgcctataccaaggcatgcccccatccctcggtacagcacatatcttatgttgctgctcattgtgtcctacgcttcagcatgcagcgagctgatccaggcctcttcccgcattactacctgtagtacagagggcgtaaataccaagtgcagacttagcggaactgctctgatcagggccggctctgtcggggcagaagcgtgtttgatgctcaagggagtgaaagaggaccagacgaagttcctgaaaataaagacagtttcctcagaattaagttgccgtgagggtcaaagctattggaccggctcgttttccccaaaatgcctgtctagccggcgatgtcacctagtgggggaatgccatgtcaacagatgtctctcatggagggataatgagacttccgccgagttctcctttgtgggagaatctaccacaatgcgcgagaacaagtgcttcgaacagtgtggcggttgggggtgcggctgttttaatgttaaccccagctgcctgttcgtgcacacctaccttcagtccgtacggaaggaggctttgagagtctttaattgtatcgactgggtgcacaaactgactctcgaaattacagatttcgacggatcagtgagcacgatcgatctgggcgccagttcttccaggtttaccaactgggggagcgtctcgttatcactggacgcagagggaatttctggcagtaattccttcagcttcatcgagtctccgggtaaggggtatgctatagttgatgaaccttttagcgagattccacgccagggattccttggcgaaatccgatgcaactccgagtcaagtgtgttgagcgcccatgaatcttgtctccgggcacccaatctggtatcctacaaacctatgattgaccaactagagtgcactacaaacctgatcgatccctttgtggtcttcgagcgtggttcactcccacagaccagaaatgacaagacatttgccgctagtaaaggcaacaggggagtgcaggcgttcagcaagggatccgttcaagccgatctgactcttatgtttgacaacttcgaagtggactttgtcggcgcagctgtgtcttgcgatgccgccttcttgaatctgaccgggtgttattcgtgcaacgctggagcacgcgtttgtttaagcataacgtcaaccggcacaggtactctctccgcccacaataaggacgggagtctgcatatcgtgcttccttctgagaacggaaccaaagatcagtgccagattctgcactttacagtccccgaagtagaggaggagttcatgtacagctgtgacggcgatgagcggccattgctcgtgaagggtactctgatcgcgattgacccgtttgatgacagaagggaagctggcggggagtccaccgttgtgaatcctaaatcaggatcttggaacttcttcgattggtttagcggcctaatgagttggttcgggggacccctgaagacgatcctcctgatatgcctttacgtcgccttgtccattggcctgtttttcttactcatctatctgggtcgaacagggcttagcaaaatgtggctggcagccaccaagaaggcttcttga

SEQ ID NO: 11161 - RNA, 3594 nt, synthetic construct
  misc_feature 1..3594: note = derived and/or modified CDS sequence (opt3) from RVFV(Beijing-01)__KX611606.1__GP
  source 1..3594: mol_type = other RNA
atgtacgtgctgctcaccatccttattagcgtcctggttttcgaggtggtaataagagtgtccttgtcttcaacaagggaagagacttgctttggcgacagtacgaaccccgaaatgatcgagggggcctgggatagcttacgggaagaggagatgcctgaggaactgtcctgttctatttcgggaatccgcgaagtcaagacctcaagccaggagctatatcgagctctcaaagcaattatcgccgcggacggtctgaataacataacatgccacggcaaggatccagaggacaaaatcagtcttattaaggggccgccccataaaaagcgtgtgggaatcgttagatgtgaaaggcggcgcgatgctaagcaaattggcagagagactatggccggtatcgcaatgaccgtgctgcctgccttggctgtcttcgcactcgccccagtggtatttgctgaagacccccacctgaggaatcggcctgggaaaggacataactacatagatggcgttacacaggaggacgctacctgcaagccagtgacttatgcgggcgcatgttcctctttcgatgtcctgctcgaaaaagggaagtttcccttattccagagctacgcccaccatcgcacactgcttgaggctgtgcacgacaccattatcgccaaagcagatcctccatcctgcgacttgcagtcagctcacggaaatccgtgtatgaaggagaagctggtgatgaaaacgcattgccccaacgattatcaaagtgcccactacctaaataacgacggtaagatggcgagcgtcaaatgtcctccaaagtatgaactcactgaggactgcaatttttgtcgacagatgaccggcgcctctctgaaaaaggggtcctacccccttcaggatctgttctgccagtcaagcgaagacgatggaagtaaattgaagacaaagatgaaaggcgtttgcgaggtgggtgtacaagcactcaagaaatgtgacgggagactgtctactgctcatgaagtggtcccttttgccgtgttcaagaactccaaaaaggtttacttagataagctggacctcaaaaccgaggagaatcttctgccagatagctttgtgtgcttcgaacacaagggacagtataaaggcacaatggactcgggccagaccaagagggagttgaaatcttttgatatttcccagtgtcccaagatcgggggacacggttcaaagaaatgcacgggcgacgctgccttctgtagtgcatacgaatgcactgcccaatatgctaacgcgtactgtagccatgcaaatgggtccggaatcgtccagattcaggtgtctggcgtatggaagaaaccgctatgcgttggttatgagcgggtggtcgtgaagcgtgaactgagcgccaaacctatacaacgcgtcgagccctgtacaacctgcatcactaagtgtgagccacacgggctcgtggttagatcaacaggcttcaagattagttccgctgtggcctgcgcaagcggagtatgcgtcaccggctctcagtcacctagtacggaaatcaccctgaaataccccgggataagccagtcctctggaggtgatattggcgtgcatatggcccacgacgaccagtcggttagctccaagatcgtgtttgattgtccaccccaagacccttgccttgtccatgggtgtatcgtgtgcgctcacggactgattaactatcagtgtcacacagccttgtcagcattcgtagtggtttttgtcttcagttctgtggcgatcatttgcctcgctatactgtacaaagtgttaaggtgtctgaagatcgccccgaaaaaggtcctaaatccactcatgtggattactgcatttatccggtgggtttacaaaaagatggtggcccgagtggctgataacatcaaccaggtaaatcgcgagattggctggatggaaggtgggcagctggcccttggcaaccccgcacctataccaagacatgctcccatccctaggtatagcacctacttgatgctgctcctgattatctcctatgcctcagcgtgcagcgagcttattcaagcctcttcccggatcacaacttgtagtaccgagggagtcaatacaaagtgccgcctgagcggcaccgctttgataagagcagggtctgtgggagccgaagcctgtctcatgttcgagggtgttaaagaagaccagactaagtttctgaaaatcaagacggtgtcctcagagttaagttgcagggaaggccagagctactggacagggtcgttctccccaaaatgcctgtctagccgtcggtgtcacctagtcggagagtgccatgtgaaccgatgtctctcatggagagataatgagaccagtgccgaattttccttcgttggcgagtctactaccatgagggaaaacaagtgctttgagcagtgtggtgggtggggctgcggatgtttcaatgtgaaccccagctgcctgtttgtacacacatatcttcaatccgtccgcaaggaagcattgcgggtgttcaattgtattgactgggtgcacaaactgaccctcgagatcactgatttcgacggctcagtcagcacaattgatctgggggcgagttcttccagatttacgaactggggaagcgtttcgttatcactggacgccgagggcatctctggtagtaattccttcagctttatagaatctccggggaagggatacgctattgtggatgagcctttcagcgaaatcccaaggcagggctttcttggtgagattcgctgcaactccgaatcaagtgtattgagcgcccatgagtcttgtctccgagcacccaatctgatctcctataaacctatgatagaccagctagagtgcaccactaacctgatcgatcccttcgtggtctttgaacggggctcactcccacagacacgtaatgacaagaccttcgctgccagtaaagggaacagaggagtgcaagcatttagcaagggctccgttcaggccgacctgacacttatgttcgataactttgaggtggacttcgtcggggctgcggtgtcttgcgatgccgcatttttgaatctgactggatgttactcgtgcaacgctggcgccagggtttgtttaagcattacctcaacgggtaccgggacactctccgcccacaataaggacggaagtctgcatatcgtgcttccttctgaaaacggcactaaagatcagtgccaaattctgcacttcaccgtccccgaggtagaggaagagttcatgtacagctgtgacggtgatgaacgcccattgctcgtgaagggcacactgatcgctatagacccgtttgatgaccggagagaggcagggggagaatccactgttgtgaatcctaaatcaggctcttggaacttctttgattggttcagcgggctaatgagttggtttggaggccccctgaagaccattctcctgatctgcctttatgtcgccttgtccatcggtctgttctttttactcatttacctggggaggacgggacttagcaaaatgtggctggcggctacaaagaaggcctcttga

SEQ ID NO: 11162 - RNA, 3594 nt, synthetic construct
  misc_feature 1..3594: note = derived and/or modified CDS sequence (opt3) from RVFV(Smithburn)__DQ380193.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaggaactgtcctgctctatttcgggaatccgcgaagtgaagacctcaagccaggagctatatcgagcactcaaagccacaattgcggctgacggtctgaataacatcacttgtcacggcaaggatccagaggacaaaataagtcttatcaaggggccgccccataaaaagcgtgtcggagtggttagatgcgaaaggcaacgggatgccaagcagattggccgcggtaccatggcagggatcgccatgacagtgtttcctgctctggtcgtgttcgcattggccccagtagtttttgctgaggacccccacctcagaaataggcctggaaaaggccataactacattgatggcatgacccaggaagacgccacttgtaagccagtgacatatgcgggggcatgctcctctttcgatgtcctgctggagaaaggaaagtttcccctcttccagagctacgcccaccatcggaccttactggaagctgtgcacgacatcataattgccaaagcagatcctccatcctgtaatcttcaatcagctcacggtaacccgtgcatgaaggagaagttggtgatgaaaacgtattgtcccaatgactaccagagtgcccattatctgaacaatgatggcaagatggcgagcgtcaaatgccctccaaagcacgagctaactgaagactgtaacttttgccgccagatgaccggggcctctctcaaagagggatcctaccccctgcaggaccttttctgccaatcaagcgaagatgacggcagtaagctgaaaacaaagatgaagggtgtttgtgaggtgggggtacaggtgttgaaaaagtgcgatggacagctctctactgcacatgaagtcgtgccttttgctgttttcaaaaattccaagaaagtgtacctggacaagttagatctgaagaccgaggagaacctccttccagacagctttgtctgtttcgaacacaaaggccagtataagggcacaatggattcggggcaaatcaaacgagagctgaagtcttttgacatttcccagtgccccaaaatcggaggtcacggctcaaagaagtgtaccggggatgccgctttctgcagtgcctacgaatgtacggcacagtatgccaatgcttactgcagccatgcgaacggatccggcatcgtgcaaattcaggtatctggtgtttggaaaaagccgttgtgtgtggggtatgagagagtcgtggtcaaaagggaactaagcgcaaagcctatacagcgggtggagccctgcactacatgtatcaccaaatgcgagccacacggcctggttgtgcgttcaactggattcaagattagttccgccgtagcttgcgccagcggcgtctgtgtgacagggtctcagtcacctagtaccgaaatcacgctcaagtaccccggaataagccaatcctctggtggcgacattggggttcatatggcacacgatgaccagtcggtgagctccaaaatcgtcgcccattgcccaccccaggacccttgtctggtgcacggatgcatcgtatgtgctcacggccttattaattatcagtgccataccgccttttcagcattcgtggttgtctttgtgttcagttctgtggtcatcatttgtctggcgatattgtacaaggttctcaaatgcctgaagatcgctccacgcaaagtgttaaacccgctgatgtggattacagcctttatcagatgggtgtacaagaaaatggtagcaagggtcgccgataacatcaatcaagtgaaccgggagattggttggatggaagggggccagctagttctcggaaatcccgctcctataccacgacacgcccccatccctcgctatagcacttacctgatgcttttgctgattgtgtcctatgcatcagcttgtagcgagctcatccaggcctcttccagaattaccacatgcagtactgagggcgtcaacaccaagtgtaggctgagcgggacagcgcttatccgggccggatctgtgggtgctgaagcatgcctgatgttgaagggcgttaaagaggaccagaccaagttcctcaaaataaagactgtgtcctcagaactgagttgccgcgaggggcaaagctactggacgggatcgttttccccaaaatgtttatctagcagaaggtgccatctggtaggcgaatgtcacgtcaatcgttgcctatcatggcgggataacgagacaagtgccgagttctcctttgtgggtgaatctaccactatgcgagagaataagtgtttcgaacagtgcgggggctggggatgtggctgctttaacgtgaatcccagctgtctcttcgtccacacctatctgcagtccgttagaaaggaggctcttagggtgtttaactgcatcgactgggtacataaattgacactggaaattaccgatttcgacgggtcagtgagcactgtcgatctcggagccagttcttcccgcttcacaaattggggcagcgtgtcgctgtcattagacgcagagggtatctctgggagtaactcctttagcttcattgagtctccgggaaagggctacgcgatcgttgatgaaccttttagcgagataccacggcagggtttcctgggcgaaattagatgtaattccgagtcaagtgtgcttagcgcccacgaatcttgcttgagggctcccaacctcatctcctataaacctatgattgaccaactggagtgcacgaccaatctaatcgatccctttgtcgtgttcgagcgcgggtcactgccacagactcgaaacgacaagacatttgccgcaagtaaaggaaaccggggcgttcaggctttcagcaaggggtccgtgcaagccgatctcaccctgatgtttgacaatttcgaagtcgactttgtaggagcagccgtgtcttgtgatgctgcgttccttaacttgacaggctgctactcgtgtaatgccggtgcacgtgtttgcctgagcataacttcaaccgggacgggaaccttatccgctcataacaaggacggcagtctccacatcgtgctgccttctgagaatggtacaaaagatcagtgtcagattcttcattttactgtccccgaagtggaggaggaatttatgtacagctgcgacggcgatgagagaccactgttggtaaaggggaccctcatcgccattgacccgttcgatgacaggcgcgaagccggaggcgagtccacagtggtcaaccctaaatcagggtcttggaatttcttcgattggtttagcggactgatgagttggttcggcggtcccctaaagactatcctgctcatatgtctgtatgttgctctttccattgggttgtttttctttctgatctacttaggacggaccggcctcagcaaaatgtggctggcagccacgaagaaggcgtcttga

SEQ ID NO: 11163 - RNA, 3594 nt, synthetic construct
  misc_feature 1..3594: note = derived and/or modified CDS sequence (opt3) from RVFV(KEN/Bar-032/07)__HM586968.1__GP
  source 1..3594: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctgtgtcgggtattcgcgaagtcaagacctcaagccaggagctatatcgagcactcaaagccatcattgcggctgacggactgaataacatcacatgtcacggcaagaatccagaggataaaataagtcttatcaaggggccgccccataaaaagcgtgtgggaattgttagatgcgaaaggcggcgcgacgccaagcaaatcggcagagagactatggcaggtattgccatgaccgtgctgcctgctttggcagtctttgccctcgctccagtggtattcgccgaagatccccacctgaggaaccggcctgggaaaggacataattacatcgacggccgcctgcaggaggatgcgacatgtaagccagttacctatgcaggcgcctgctcctcttttgacgtgctcttagaaaaagggaagttccccctgtttcagagctacgctcaccatcgaactcttttggaggccgtccacgatacaataattgcaaaagctgaccctccatcctgtgatctgcagtcagccgacggaaacaagtgcatgaaggagaagctagtgatgaaaacccactgtccgaatgattatcaaagtgcgcattacctcaacaatgacggtaaaatggccagcgtgaagtgtccccctaaatatgaactgacggaggactgcaacttctgcagacagatgactggcgcatctcttaagaaagggtcctacccactgcaggatttgttttgccagtcaagcgaagacgatggaagtaagctcaagaccaaaatgaagggcgtctgtgaggttggtgtgcaagctctgaaaaagtgcgacgggcagttatctacagcccacgaagtagtgcccttcgctgtctttaaaaattccaagaaggtgtacctggataaactcgaccttaagactgaggagaacctgttgcctgatagcttcgtttgttttgaacataaaggacagtataagggcaccatggactcgggccagacaaaaagggagctaaagtctttcgatatctcccaatgcccaaagattgggggacacggtagtaaaaagtgtaccggcgacgccgcattttgctcagcctacgaatgtacggctcagtatgcgaatgcatactgcagccacgccaacgggtccggaatcgtgcagatccaagtctctggcgtgtggaaaaagcccctgtgtgtaggttatgagcgggttgtggtcaaacgtgaactcagcgctaagccgattcagcgcgtggagccttgcactacatgtataaccaagtgcgagccccatgggctggtcgtgagatcaactggcttcaaaatcagttccgccgttgcatgcgccagcggagtgtgtgtaacaggctctcagtcaccaagtaccgaaattacgcttaagtaccctgggatcagccagtcctctgtcggagatataggtgtgcacatggctcatgacgaccaatcggttagctccaaaattgtggcccactgtcccccacaggatccctgcctggtccatggctgcatcgtgtgtgcacacgggttgatcaattatcagtgccacaccgcgctctcagctttcgtagtgatttttgttttcagttctacagccatcatttgtctggcagtcttatacagggtgctgaagtgcctaaaaatagcccctcggaaggtgctcaacccactgatgtggatcactgcttttattcgatgggtctacaaaaagatggttgcccgcgtggcagacaacatcaatcaggtgaacagagagatcggatggatggaaggcggtcaacttgctttggggaatccggcccccattcctaggcatgcgccaataccccggtatagcacctacctgatgctcctgcttatcgtatcctatgcctcagcttgtagcgagctgattcaggcatcttcccgcatcacaacttgcagtaccgagggcgtcaacacaaagtgtagattgagccacaccgccctcattagggctggatctgtgggcgccgaagcatgcctgatgttaaaaggggttaaggaggatcagactaaattcctgaagatcaaaacggtgtcctcagaactaagttgccgtgagggacagagctactggacaggttcgttttcccctaagtgtctctctagccggcgatgccatctggtcggcgaatgtcacgtgaatagatgcctttcatggagggacaacgagaccagtgcggagttctcctttgttggggaatctactaccatgcgcgagaataagtgtttcgaacaatgcggaggctggggttgtgggtgctttaacgtgaatccaagctgtttgttcgtacacacatatctgcagtccgtccggaaagaggccctcagagtgtttaactgcatagattgggtgcataagctgaccttagaaatcactgacttcgatggctcagtcagcacaattgacctgggagctagttcttccaggtttacgaattggggcagcgtttcgctttcattggatgccgaggggatctctggaagtaactccttcagcttcattgagtctcccggcaaaggttacgcaatcgtggacgaaccgtttagcgagatacctcgccaggggttcctcggagaaattcgatgtaattccgagtcaagtgtactgagcgctcacgaatcttgcctacgggccccaaacctggtgtcctataagcccatgatcgatcagctcgagtgcaccactaatctgattgacccttttgtcgtgttcgagcgtggctcacttccccaaacaagaaacgataaaacctttgcagccagtaagggtaacaggggcgttcaggctttcagcaaggggtccgtgcaggcggacttgacactgcgctttgacaatttcgaagtcgattttgtgggagccgcagtttcttgtgacgctgccttcttaaacctcactggctgctactcgtgtaatgccggggctcgggtgtgcctgagcatcacctcaacgggaaccggcacactttccgcacataacaaagatggtagtctgcacatagtcttgccatctgagaatgggactaaggaccaatgtcagatcctccattttaccgtacctgaagtggaggaggagttcatgtacagctgcgatggagacgagagacccctgctagttaaaggcacactgattgccatcgatccatttgacgataggcgagaagcgggtggcgagtccactgtggtcaacccgaagtcagggtcttggaatttcttcgactggtttagcggactcatgagttggttcggcgggcctctgaaaaccattcttttgatctgtctgtatgtggctttatccataggactctttttcctgcttatttacctgggccgcacgggtctaagcaagatgtggctcgccgcaacaaagaaagcctcttga

SEQ ID NO: 11164 - RNA, 3594 nt, synthetic construct
  misc_feature 1..3594: note = derived and/or modified CDS sequence (opt3) from RVFV(KEN/Gar-004/06)__HM586964.1__GP
  source 1..3594: mol_type = other RNA
atgtacgtgctgctcaccatccttattagcgtctgggtttgcgaggccgtgataagagtatccctgtcttcaacaagggaagagacttgtttcggcgacagtacgaaccccgaaatgatcgagggggcttgggatagcttgcgggaagaggagatgcctgaagagttatcctgctctgtgtcgggtattcgcgaagtcaagacctcaagccaggagctgtatcgagcactaaaagccatcattgcggctgacggactcaataacatcacatgtcacggcaagaatccagaggataaaataagtctgatcaaggggccgccccataaaaagcgtgtgggaattgttagatgcgaaaggcggcgcgacgccaagcaaatcggcagagagactatggcaggtattgccatgaccgtgcttcctgctctggcagtctttgccttggctccagtggtattcgccgaagatccccacctcaggaaccggcctgggaaaggacataattacatcgacggcatgacacaggaggatgcgacctgtaagccagttacttatgcaggcgcctgctcctcttttgacgtgctgctggaaaaagggaagttccccctctttcagagctacgctcaccatcgcacattactggaggccgtccacgataccataattgcaaaagctgaccctccatcctgtgatcttcagtcagcccacggaaacccgtgcatgaaggagaagttggtgatgaaaacgcattgtcccaatgactatcaaagtgcgcactacctgaacaatgatggtaagatggccagcgtgaaatgccctccaaagtatgaactaactgaggactgtaacttctgccgacagatgaccggcgcatctctcaaaaaggggtcctaccccctgcaggacttgttttgccagtcaagcgaagatgacggaagtaaactgaagacaaagatgaaaggcgtctgtgaggttggtgtgcaagctcttaagaaatgcgatgggcagctctctactgcccatgaagtagtgcctttcgctgtctttaaaaattcccagaaagtgtacctggacaagttagatctgaagaccgaggagaacctccttccagacagcttcgtttgttttgaacacaaaggacagtataagggcacaatggattcgggccaaaccaaaagagagctgaagtctttcgacatctcccagtgccccaaaattgggggacacggtaggaagaagcggacgggcgatgccgcattttgttcagcctacgaatgcactgctcagtatgcgaatgcatactgtagtcgtgccaacgggagcggaatcgtgcaaatccaggtctcccgcgtgtggaaaaagccgttgtgcgtaggctatgagagagttgtggtcaaaagggaactatctgctaagcctattcagcgggtggagccctgtacaacctgcataactaaatgtgagccacatggtctggtcgtgcgaagcacagggttcaagatctcaagtgccgttgcatgcgcctccggcgtgtgcgtaaccggaagccagtctccttcaacggaaattaccctcaagtaccccggcatcagtcaaagctccgggggagacataggtgtccacatggctcatgatgaccagtctgtgtcgagcaaaattgttgcccactgtccaccccaggacccttgcctggtgcatggctgtatcgtctgcgcacacgggcttatcaataaccagtcccactcagcgctgagtgctttcgtggtaatttttgtgttctctagcacagccatcatttgtttggcagttctctatcgcgtcctgaagtgcttaaaaatagccccaagaaaggtgctgaacccgctaatgtggatcactgcttttattaggtgggtgtacaaaaagatggtcgcccgggttgcagataatatcaaccaagtgaatcgcgagatcggatggatggaaggcggtcagctcgctctggggaaccccgcccctattccaagacatgcgcccatacctaggtactccacctatcttatgttgctgctcatcgtgtcatacgccagcgcttgttctgagctgattcaggcatccagtcgtatcacaacttgcagcaccgagggcgtaaatacaaaatgtcggctttctggaaccgccctgattcgagctggctccgtcggggccgaagcatgcttgatgctcaagggagtgaaggaggaccagactaaattcctgaagatcaaaacggtttcaagtgaattaagctgtagagagggtcaatcgtattggacaggctccttttctccaaagtgcctgagctcaaggcgctgccacctagtgggggaatgtcatgtcaaccggtgcctcagttggagagataatgagacctccgcggagttctcttttgtgggagaaagcactaccatgagggagaacaaatgtttcgaacagtgcggcggttgggggtgtggctgctttaatgttaacccctcctgtctgttcgtgcacacataccttcagtcagtacgcaaggaggccttgcgagtctttaattgcatagactgggtgcacaagctgaccctcgaaatcactgatttcgacggaagcgtgagtacaattgatctgggcgcttcttccagccggtttacgaactgggggtcggtctcattatctctggacgccgagggaatcagtggctccaatagcttctctttcattgagagcccgggtaaagggtatgcaatcgttgatgaacctttttccgagataccacgtcagggattccttggcgaaattagatgtaactcagagagtagcgtgttgtctgctcatgaatcctgcctcagggcccccaatctggtatcatacaagcctatgatcgaccaactagagtgtaccactaacctgattgatccctttgtggtcttcgagcgcggtagtctcccacagacacggaacgacaaaacctttgcagccagcaagggcaatagaggggtgcaggctttctccaaaggatctgttcaagcggatctgacacttaggtttgacaacttcgaagtggactttgtcggcgccgcagtgtcgtgcgatgctgccttcttgaatctgactgggtgctatagctgtaacgccggagctcgagtttgcttatcaatcacctccacgggcaccggtacactcagtgcacacaataaggacgggtctctgcatatagtgcttcctagcgagaacggaactaaggatcagtgtcagatcctgcactttaccgtccccgaagtagaggaggagttcatgtactcctgcgacggcgatgaacgcccattgctcgtgaaaggtacactgattgccatcgacccgtttgatgaccggagagaagcgggcggggagtcaactgttgtgaatcctaagtctggaagctggaacttcttcgattggtttagtggcctaatgtcctggttcgggggacccctgaaaaccattctcctgatctgtctttacgtcgctttgagcataggcctgtttttcttactcatttatctgggtaggacggggctttctaagatgtggctggccgcaacaaagaaggcctcatga

SEQ ID NO: 11165 - RNA, 3621 nt, synthetic construct
  misc_feature 1..3621: note = derived and/or modified CDS sequence (opt3) from RVFV(RVFV)__M11157.1__GP
  source 1..3621: mol_type = other RNA
atgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaggagctgtcctgctctatttcgggaatccgcgaagtgaagacctcaagccaggagctatatcgagcactcaaagccattatcgcggctgacggtctgaataacataacatgtcacggcaaggatccagaggacaaaatcagtcttattaaggggccgccccataaaaagcgtgtcggaatcgtgagatgcgaaaggcggcgcgatgccaagcaaattggcagagagactatggcaggtatcgccatgaccgttctgcctgctttggcagtgtttgccctcgctccagtcgtgttcgccgaagacccccacctgaggaatcggcctgggaaaggacataactacatagatggcatgacacaggaggacgcgacctgtaagccagtaacttatgcaggcgcctgctcctcttttgatgttctgctcgaaaaagggaagttccccttatttcagagctacgctcaccatcgcacactgcttgaggccgtgcacgacaccattatcgcaaaagctgatcctccatcctgtgacttgcagtcagcccacggaaatccgtgcatgaaggagaagctggtcatgaaaacgcattgtcccaacgattatcaaagtgcgcactacctaaataacgacggtaagatggccagcgtgaaatgccctccaaagtatggcctcactgaagactgtaatttctgccgacagatgaccggggcatctctgaaaaagggatcctacccccttcaggatctgttttgccagtcaagcgaggacgatggcagtaaattgaagacaaagatgaaaggtgtgtgtgaagtcggggttcaagctcataagaaatgcgacggacagctctctactgcccacgaggtggtacctttcgctgtgtttaagaactccaaaaaggtctacctggataagttagacctgaaaaccgaagagaatctccttccagatagcttcgtgtgttttgagcacaagggccagtataaaggcacaatggactcggggcagaccaagagagaactgaaatctttcgatatttcccaatgccccaagatcggaggtcatggctcaaagaaatgtacgggggacgccgcattttgcagtgcctacgagtgtactgctcagtatgcgaacgcatactgcagccacgccaatggatccggcatcgttcagattcaagtgtctggtgtctggaagaaaccgttgtgtgtggggtatgaaagggtagttgtgaagcgggagctaagcgctaaacctatacagcgtgtcgaaccctgcacaacctgtatcactaagtgcgagccacatggcctggtggtccgctcaacaggattcaagattagttccgccgtggcatgcgccagcggcgtttgtgtgaccgggtctcagtcacctagtacggagatcaccctcaaataccccggaataagccagtcctctggtggcgatattggggtacacatggctcatgacgaccaatcggtcagctccaagatcgtggcccactgcccaccccaggatccttgtctggttcacggatgcatcgtgtgtgcacatggccttattaactatcagtgccacacagcgctgtcagctttcgtcgtggtatttgtgttcagttctatcgccattatatgtttggcagttctctacagagtcctgaaatgcttaaagatcgccccaaggaaagtgctgaatccgctaatgtggattactgcttttatccggtggatctacaagaaaatggtggcccgagtcgcacataacattaaccaggttaatcgcgaaataggttggatggaagggggccaactcgtgctgggaaaccccgctcctatcccaagacacgcccccattcctaggtatagcacctaccttatgttgctgctcatcgtgtcctatgcgtcagcctgtagcgaactgattcaggcttcttcccggatcacaacttgcagtaccgagggcgtaaatacaaagtgtcgccttagcgggaccgcactgataagagccggatctgtcggtgctgaggcctgcttgatgctcaagggcgtgaaagaagaccagactaagttcctgaaaatcaagacggtttcctcagagttaagttgcagggaagggcagagctactggacaggatcgatttccccaaaatgtctgtctagccgtcggtgccacctagtgggcgagtgtcatgtcaaccgatgcctctcatggagagataatgaaaccagtgcagagttttccttcgtgggtgagtctactaccatgagggaaaacaagtgttttgagcaatgcgggggctggggatgtggctgcttcaatgttaaccccagctgtctgtttgtgcacacatatcttcagtccgtacgcaaggaagcgttgcgggtcttcaattgcatcgactgggtgcataaactgaccctcgagattactgattttgacgggtcagtgagcacaatcgatctgggagccagttcttccagattcacgaactggggcagcgtctcgttatcactggacgctgaaggtatatctgggagtaattcctttagcttcattgagtctccgagcaagggatacgccatcgttgatgagcctttctccgaaattccaaggcagggctttcttggtgagatccgctgtaactcagaaagtagcgtgttgtctgcacacgagtcctgcctccgagctcccaatctgatatcatataaacctatgatcgaccagctagaatgcaccactaacctgattgatcccttcgtagtgtttgagcggggcagtctcccacaaacacgtaatgacaagaccttcgccgcaagcaaagggaacagaggagtccaggccttttccaagggctctgtgcaggctgatctgacacttatgttcgacaactttgaggttgacttcgtgggggcggccgtctcgtgtgatgcagcctttttgaatctgactggatgctacagctgtaacgctggcgccagggtgtgcttatcaatcacctccacgggtaccgggagtctctctgctcataataaggacggaagcctgcacattgttcttccttccgaaaacggcacaaaagatcaatgtcagatcctgcacttcactgtgcccgaggtcgaagaggagtttatgtactcatgcgacggtgatgaacgcccattgctcgtaaagggcaccctgatagcaattgacccgttcgatgaccggagagaggccgggggagaatctacagtggttaatcctaaaagcggcagttggaactttttcgattggttctccgggctaatgagctggtttggaggccccctgaagctctattcttcattcgcgtgtatgctgcattaccagcttggttcctttagtagcttgtatatcctggaggaacaggcttcgttaaaatgcgggctcctgccacttaggcgaccccaccgctctgtgcgggtcaaggtgatctgttga

SEQ ID NO: 11166 - RNA, 3480 nt, synthetic construct
  misc_feature 1..3480: note = derived and/or modified CDS sequence (opt3) from RVFV(ZH-548)__DQ380206.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaataatatcacatgtcacggtaaggaccctgaagataaaatttccttaatcaagggcccaccgcataaaaagcgcgtcgggatagttcgatgcgagcgtagaagggacgctaagcaaatcggacgggaaactatggccggcattgcaatgacggtgctgcccgccctagctgtattcgcactcgcccctgtggtctttgctgaggatccacatctgcgcaacagacccggtaaagggcacaattatatcgacggaatgacccaggaggatgccacatgtaagcctgtgacttacgcgggcgcatgttcttcgttcgacgttcttctggaaaaaggcaagtttccattgttccagtcatatgcccaccataggaccctcctggaggctgtgcacgatacaattatcgccaaagcagatccccctagctgcgacctgctcagtgctcacgggaacccatgcatgaaggaaaagttagtcatgaaaacccattgtccgaatgactaccagtccgcccactatctgaacaatgatggaaagatggcgtctgtgaaatgtccccctaagtacgagcttactgaagactgcaacttttgccggcaaatgacaggtgccagcttgaaaaagggctcctatccactgcaggacctattctgtcagtcaagtgaggatgacgggagcaaactcaagaccaagatgaaaggagtatgcgaggttggcgtgcaggcactgaagaaatgcgatggtcaactttctacggctcatgaagtcgtgccctttgccgtgttcaaaaattccaagaaggtctacctggacaagttggatctcaaaactgaggaaaacctgttacctgactcatttgtttgtttcgagcacaaggggcagtacaaaggaaccatggatagcggccagacaaagcgcgaactgaaaagttttgacatatctcagtgcccaaagattggcgggcacggatccaagaaatgtactggtgatgctgccttctgcagcgcatatgagtgtaccgcccaatacgctaatgcgtattgctcgcatgcaaacggctctgggatcgtgcagattcaggtatccggagtgtggaagaaacccctctgtgtcggctacgagcgagtggttgtgaagagagaactttcagccaaaccgatccaaagggtcgagccttgcacaacctgtatcacgaagtgcgaaccccacggtctggtggtacggagtactgggtttaagattagctccgctgttgcctgtgcatctggcgtgtgcgtcacaggaagccagtcaccaagtaccgagataactttgaaatatcctggcatctcccagagctctgggggagacattggtgtgcatatggcccacgatgaccagtcagtcagtagcaagatcgtggctcattgtcccccacaagacccctgcctagttcacgattgcatagtgtgtgcccacggcctgattaattaccagtgccatacagcactctccgcgttcgtagtcgtgttcgtgttttcttcgatcgctatcatttgtctggccatcctttatcgtgttctgaaatgcttgaagattgcacctcgcaaagtcctcaacccactgatgtggataaccgccttcatcagatggatttacaagaaaatggtggctagggtagccgacaatatcaaccaggtgaaccgggaaatcgggtggatggagggaggccagttagttctgggtaatccggcacccattcctcgacacgctccaataccccgctacagcacgtatctaatgctcctgcttatcgtctcctacgcctcagcgtgtagtgagttgattcaagcctctagcagaatcaccacatgctccactgaaggggtgaacaccaagtgtaggctgtcaggcacagctctcattcgggcaggaagcgtgggcgccgaggcttgcctgatgcttaagggggtcaaagaagatcagactaagtttctgaaaatcaagaccgtttcttccgagttgagttgtcgcgagggacagagctattggacaggttctttctcccctaaatgcctctcaagtagaaggtgccatctggtgggcgaatgtcacgtgaatcgttgcttaagctggcgggacaacgagacctcggccgaattttccttcgtaggggagtctactacgatgcgagaaaataagtgttttgagcagtgcggaggctggggttgtgggtgcttcaacgtcaatccaagctgtctgtttgtgcacacatacctacaatcagttagaaaggaggcactcagggtgttcaactgcatagattgggtccataaactgacccttgaaatcactgactttgatggcagtgtgtccaccattgacttgggagcgtctagctcccgcttcacaaattggggctcagttagcctgagtctcgatgccgaggggatctctggatccaacagcttttcgttcattgaatcacccggcaagggttatgctatcgtggacgagccgttctctgaaatacctcggcaggggtttctgggagagattagatgtaatagtgagtccagcgtattatctgcccacgaaagctgcctgagggcaccaaaccttatctcctacaaacccatgattgatcagttggagtgtaccactaatctcatcgaccctttcgtcgtgtttgaacgcggctcactgccccagacacgaaacgataagacgttcgctgccagtaaaggtaatcggggcgtgcaagcatttagcaaggggtctgtccaggccgacctaaccctgatgttcgacaactttgaggttgatttcgtgggagctgcggtatcctgcgacgccgcatttctcaacctgactggctgctattcatgtaatgctggggcccgtgtgtgccttagtataacaagcaccggaacaggctccttgtctgcccataacaaggatggttcgctgcacatcgtcttaccaagcgaaaatgggactaaagaccagtgtcaaattctccatttcaccgtgcctgaggttgaggaagagtttatgtactcatgcgatggagacgaaagacccctgcttgtgaagggcacgctgatcgctattgatccattcgacgataggcgcgaggccggtggcgagtccaccgtcgtgaacccgaaaagtgggtcttggaactttttcgactggttcagcggattgatgtcctggtttggcgggcctctcaagacaatcctgctaatatgtctgtacgttgcactctcaattggactgttctttcttttgatctatctgggccggactggtttatctaaaatgtggctcgcggctaccaagaaggccagctga

SEQ ID NO: 11167 - RNA, 3480 nt, synthetic construct
  misc_feature 1..3480: note = derived and/or modified CDS sequence (opt3) from RVFV(ZS-6365)__DQ380205.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaataatatcacatgtcacggtaaggaccctgaagataaaatttccttaatcaagggcccaccgcataaaaagcgcgtcgggatagttcgatgcgagcgtagaagggacgctaagcaaatcggacgggaaactatggccggcattgcaatgacggtgctgcccgccctagctgtattcgcactcgcccctgtggtctttgctgaggatccacatctgcgcaacagacccggtaaagggcacaattatatcgacggaatgacccaggaggatgccacatgtaagcctgtgacttacgcgggcgcatgttcttcgttcgacgttcttctggaaaaaggcaagtttccattgttccagtcatatgcccaccataggaccctcctggaggctgtgcacgatacaattatcgccaaagcagatccccctagctgcgacctgcagagtgctcacgggaacccatgcatgaaggaaaagctcgtcatgaaaacccattgtccgaatgactaccaatccgcccactatttaaacaatgatggaaagatggcgtctgtgaaatgtccccctaagtacgagctgactgaagactgcaacttttgccggcagatgacaggtgccagccttaaaaagggctcctatccattgcaggacctgttctgtcagtcaagtgaggatgacgggagcaaactaaagaccaagatgaaaggagtatgcgaggttggcgtgcaagcactcaagaaatgcgatggtcagctgtctacggctcatgaagtcgtgccctttgccgtgttcaaaaattccaagaaggtctaccttgacaagctggatttgaaaactgaggaaaacctcctgcctgactcatttgtttgtttcgagcacaaggggcagtacaaaggaaccatggatagcggccagacaaagcgcgaattaaaaagttttgacatatctcaatgcccaaagattggcgggcacggatccaagaaatgtactggtgatgctgccttctgcagcgcatatgagtgtaccgcccagtacgctaatgcgtattgctcgcatgcaaacggctctgggatcgtgcagattcaagtatccggagtgtggaagaaacccctgtgtgtcggctacgagcgagtggttgtgaagagagaactctcagccaaaccgatccagagggtcgagccttgcacaacctgtatcacgaagtgcgaaccccacggtcttgtggtacggagtactgggtttaagattagctccgctgttgcctgtgcatctggcgtgtgcgtcacaggaagccagtcaccaagtaccgagataactctgaaatatcctggcatctcccagagctctgggggagacattggtgtgcatatggcccacgatgaccaatcagtcagtagcaagatcgtggctcattgtcccccacaggacccctgcttggttcacggctgcatagtgtgtgcccacgggctaattaattaccagtgccatacagcactgtccgcgttcgtagtcgtgttcgtgttttcttcgatcgctatcatttgtctcgccatcctgtatcgtgttcttaaatgcctgaagattgcacctcgcaaagtcttgaacccactcatgtggataaccgccttcatcagatggatttacaagaaaatggtggctagggtagccgataatatcaaccaggtgaaccgggaaatcggatggatggagggcggtcaactggttttagggaatccggcacccattcctcgacacgctccaataccccgctacagcacgtatctgatgctactcctgatcgtctcctacgcctcagcgtgtagtgagcttattcaggcctctagcagaatcaccacatgctccactgaaggcgtgaacaccaagtgtaggttgtcaggaacagctctgattcgggcaggcagcgtgggggccgaggcttgcctcatgctgaagggagtcaaagaagaccagactaagtttcttaaaatcaagaccgtttcttccgagctgagttgtcgcgagggtcagagctattggacaggctctttctcccctaaatgcttgtcaagtagaaggtgccatctcgtgggggaatgtcacgtgaatcgttgcctgagctggcgggataacgagacctcggccgaattttccttcgtaggagagtctactacgatgcgagaaaataagtgttttgagcaatgcggcggttgggggtgtggctgcttcaacgtcaatccaagctgtttatttgtgcacacatacctgcagtcagttagaaaggaggcactaagggtgttcaactgcatagactgggtccataaactcaccctggaaatcactgattttgacggaagtgtgtccaccattgatcttggcgcgtctagctcccgcttcacaaattgggggtcagttagcttgagtctggacgccgagggaatctctggctccaacagcttttcgttcattgaatcacccggtaaggggtatgctatcgtggatgagccgttctctgaaatacctcggcagggatttctcggcgagattagatgtaatagtgagtccagcgtactgtctgcccacgaaagctgcttaagggcaccaaacctgatctcctacaaacccatgattgaccagcttgagtgtaccactaatttgatcgatcctttcgtcgtgtttgaacgcggttcactcccccaaacacgaaacgacaagacgttcgctgccagtaaaggcaatcgtggggtgcaggcatttagcaagggatctgtccaggccgatctgaccctaatgttcgacaactttgaggttgacttcgtgggcgctgcggtatcctgcgatgccgcatttctgaacctcactgggtgctattcatgtaatgctggagcccgggtgtgcctgagtataacaagcaccggcacaggttccctttctgcccataacaaggacgggtcgttgcacatcgtcctgccaagcgaaaatggaactaaagatcaatgtcagattttacatttcaccgtgcctgaggttgaggaagagtttatgtactcatgcgacggcgatgaaagacccctcctggtgaagggtacgcttatcgctattgacccattcgatgacaggcgcgaggcaggcggggagtccaccgtcgtgaacccgaaaagtggatcttggaactttttcgattggttcagcggcctgatgtcctggtttgggggacctttgaagacaatcctcctgatatgtctatacgttgccctgtcaattggcctcttctttctgcttatctatttgggtcggactgggctgtctaaaatgtggttagcggctaccaagaaggccagctga

SEQ ID NO: 11168 - RNA, 3480 nt, synthetic construct
  misc_feature 1..3480: note = derived and/or modified CDS sequence (opt3) from RVFV(MP-12)__DQ380208.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaataatatcacatgtcacggtaaggaccctgaagataaaatttccttaatcaagggcccaccgcataaaaagcgcgtcgggatagttcgatgcgagcgtagaagggacgctaagcaaatcggacgggaaactatggccggcattgcaatgacggtgctgcccgccctagctgtattcgcactcgcccctgtggtctttgctgaggatccacatctgcgcaacagacccggtaaagggcacaattatatcgacggaatgacccaggaggatgccacatgtaagcctgtgacttacgcgggcgcatgttcttcgttcgacgttcttctggaaaaaggcaagtttccattgttccagtcatatgcccaccataggaccctcctggaggctgtgcacgatacaattatcgccaaagcagatccccctagctgcgacctgctcagtgctcacgggaacccatgcatgaaggaaaagttagtcatgaaaacccattgtccgaatgactaccagtccgcccaccatctgaacaatgatggaaagatggcgtctgtgaaatgtccccctaagtatgagcttactgaagactgcaacttttgccggcaaatgacaggtgccagcttgaaaaagggctcctacccactgcaggacctattctgtcagtcaagtgaggatgacgggagcaaactcaagaccaagatgaaaggagtatgcgaggttggcgtgcaggcactgaagaaatgcgatggtcaactttctacggctcacgaagtcgtgccctttgccgtgttcaaaaattccaagaaggtctatctggacaagttggatctcaaaactgaggaaaacctgttacctgactcatttgtttgtttcgagcacaaggggcagtacaaaggaaccatggatagcggccagacaaagcgcgaactgaaaagttttgacatatctcagtgcccaaagattggcgggcatggatccaagaaatgtactggtgatgctgccttctgcagcgcatacgagtgtaccgcccaatatgctaatgcgtactgctcgcacgcaaacggctctgggatcgtgcagattcaggtatccggagtgtggaagaaacccctctgtgtcggctatgagcgagtggttgtgaagagagaactttcagccaaaccgatccaaagggtcgagccttgcacaacctgtatcacgaagtgcgaaccccatggtctggtggtacggagtactgggtttaagattagctccgctgttgcctgtgcatctggcgtgtgcgtcacaggaagccagtcaccaagtaccgagataactttgaaataccctggcatctcccagagctctgggggagacattggtgtgcacatggcccatgatgaccagtcagtcagtagcaagatcgtggctcactgtcccccacaagacccctgcctagttcacgattgcatagtgtgtgcccatggcctgattaattatcagtgccacacagcactctccgcgttcgtagtcgtgttcgtgttttcttcgatcgctatcatttgtctggccatcctttaccgtgttctgaaatgcttgaagattgcacctcgcaaagtcctcaacccactgatgtggataaccgccttcatcagatggatttataagaaaatggtggctagggtagccgacaatatcaaccaggtgaaccgggaaatcgggtggatggagggaggccagttagttctgggtaatccggcacccattcctcgacatgctccaataccccgctacagcacgtacctaatgctcctgcttatcgtctcctatgcctcagcgtgtagtgagttgattcaagcctctagcagaatcaccacatgctccactgaaggggtgaacaccaagtgtaggctgtcaggcacagctctcattcgggcaggaagcgtgggcgccgaggcttgcctgatgcttaagggggtcaaagaagatcagactaagtttctgaaattgaagaccgtttcttccgagctcagttgtcgcgagggacagagctactggacaggttctttctcccctaaatgcctgtcaagtagaaggtgccacttagtgggcgaatgtcacgtgaatcgttgcctgagctggcgggacaacgagacctcggccgaattttccttcgtaggggagtctactacgatgcgagaaaataagtgttttgagcagtgcggaggctggggttgtgggtgcttcaacgtcaatccaagctgtctatttgtgcatacatatctccaatcagttagaaaggaggcactgagggtgttcaactgcatcgattgggtccacaaacttaccttggaaataactgactttgatggcagtgtgtccaccatcgacctgggagcgtctagctcccgcttcacaaattggggctcagttagcctcagtctggatgccgaggggatttctggatccaacagcttttcgttcatcgaatcacccggcaagggttacgctattgtggacgagccgttctctgaaatccctcggcaggggtttttaggagagataagatgtaatagtgagtccagcgtactgtctgcccatgaaagctgccttagggcaccaaacttgatttcctataaacccatgatcgatcagctcgagtgtaccactaatctgattgaccctttcgtcgtgtttgaacgcggctcactaccccagacacgaaacgataagacgttcgctgccagtaaaggtaatcggggcgtgcaagcatttagcaaggggtctgtccaggccgacctgaccctcatgttcgacaactttgaggttgatttcgtgggagctgcggtatcctgcgacgccgcatttctgaaccttactggctgctactcatgtaatgctggggcccgtgtgtgcttgagtatcacaagcaccggaacaggctccctgtctgcccacaacaaggatggttcgttacatatagtcctcccaagcgaaaatgggactaaagaccagtgtcaaatcctgcacttcaccgtgcctgaggttgaggaagagtttatgtattcatgcgatggagacgaaagaccccttctggtgaagggcacgttgattgctatcgatccattcgacgataggcgcgaggccggtggcgagtccaccgtcgtgaacccgaaaagtgggtcttggaactttttcgactggttcagcggactcatgtcctggtttggcgggcctctgaagacaattctactgatctgtctctacgttgcactgtcaataggacttttctttttgctgatttacttaggcggtactgggctctctaaaatgtggctggcggctaccaagaaggccagctga

SEQ ID NO: 11169 - RNA, 3480 nt, synthetic construct
  misc_feature 1..3480: note = derived and/or modified CDS sequence (opt3) from RVFV(T1)__DQ380201.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaataatatcacatgtcacggtaaggaccctgaagataaaatttccttaatcaagggcccaccgcataaaaagcgcgtcgggatagttcgatgcgagcgtagaagggacgctaagcaaatcggacgggaaactatggccggcattgcaatgacggtgctgcccgccctagctgtattcgcactcgcccctgtggtctttgctgaggatccacatctgcgcaacagacccggtaaagggcacaattatatcgacggaatgacccaggaggatgccacatgtaagcctgtgacttacgcgggcgcatgttcttcgttcgacgttcttctggaaaaaggcaagtttccattgttccagtcatatgcccaccataggaccctcctggaggctgtgcacgatacaattatcgccaaagcagatccccctagctgcgacctgcagagtgctcacgggaacccatgcatgaaggaaaagctcgtcatgaaaacccattgtccgaatgactaccaatccgcccactatttaaacaatgatggaaagatggcgtctgtgaaatgtccccctaagtacgagctgactgaagactgcaacttttgccggcagatgacaggtgccagccttaaaaagggctcctatccattgcaggacctgttctgtcagtcaagtgaggatgacgggagcaaactaaagaccaagatgaaaggagtatgcgaggttggcgtgcaagcactcaagaaatgcgatggtcagctgtctacggctcatgaagtcgtgccctttgccgtgttcaaaaattccaagaaggtctaccttgacaagctggatttgaaaactgaggaaaacctcctgcctgactcatttgtttgtttcgagcacaaggggcagtacaaaggaaccatggatagcggccagacaaagcgcgaattaaaaagttttgacatatctcaatgcccaaagattggcgggcacggatccaagaaatgtactggtgatgctgccttctgcagcgcatatgagtgtaccgcccagtacgctaatgcgtattgctcgcatgcaaacggctctgggatcgtgcagattcaagtatccggagtgtggaagaaacccctgtgtgtcggctacgagcgagtggttgtgaagagagaactctcagccaaaccgatccagagggtcgagccttgcacaacctgtatcacgaagtgcgaaccccacggtcttgtggtacggagtactgggtttaagattagctccgctgttgcctgtgcatctggcgtgtgcgtcacaggaagccagtcaccaagtaccgagataactctgaaatatcctggcatctcccagagctctgggggagacattggtgtgcatatggcccacgatgaccaatcagtcagtagcaagatcgtggctcattgtcccccacaggacccctgcttggttcacggctgcatagtgtgtgcccacgggctaattaattaccagtgccatacagcactgtccgcgttcgtagtcgtgttcgtgttttcttcgatcgctatcatttgtctcgccgttctgtatcgtgtccttaaatgcctgaagatcgcacctcgcaaagtgttgaacccactcatgtggattaccgccttcataagatggatctacaagaaaatggtagctagggtggccgataatattaaccaggttaaccgggaaatcggatggatggagggcggtcaactggtcttagggaatccggcacccatccctcgacacgctccaattccccgctacagcacgtatctgatgctactcctgatagtgtcctacgcctcagcgtgtagtgagcttatccaggcctctagcagaattaccacatgctccactgaaggcgtgaacaccaagtgtaggttgtcaggaacagctctgatccgggcaggcagcgtcggggccgaggcttgcctcatgctgaagggagttaaagaagaccagactaagtttcttaaaattaagaccgtgtcttccgagctgagttgtcgcgagggtcagagctattggacaggctctttctcccctaaatgcttgtcaagtagaaggtgccatctcgtgggggaatgtcacgtaaatcgttgcctgagctggcgggataacgagacctcggccgaattttccttcgtcggagagtctactacgatgcgagaaaataagtgttttgagcaatgcggcggttgggggtgtggctgcttcaacgtgaatccaagctgtttatttgttcacacatacctgcagtcagtgagaaaggaggcactaagggtcttcaactgcatcgactgggtgcataaactcaccctggaaataactgattttgacggaagtgtttccaccatcgatcttggcgcgtctagctcccgcttcacaaattgggggtcagtgagcttgagtctggacgccgagggaatttctggctccaacagcttttcgttcatcgaatcacccggtaaggggtatgctattgtagatgagccgttctctgaaatccctcggcagggatttctcggcgagataagatgtaatagtgagtccagcgtcctgtctgcccacgaaagctgcttaagggcaccaaacctgatttcctacaaacccatgatcgaccagcttgagtgtaccactaatttgattgatcctttcgtggtgtttgaacgcggttcactcccccaaacacgaaacgacaagacgttcgctgccagtaaaggcaatcgtggggtccaggcatttagcaagggatctgttcaggccgatctgaccctaatgttcgacaactttgaggtggacttcgtaggcgctgcggtgtcctgcgatgccgcatttctgaacctcactgggtgctattcatgtaatgctggagcccgggtctgcctgagtatcacaagcaccggcacaggttccctttctgcccataacaaggacgggtcgttgcacatagtgctgccaagcgaaaatggaactaaagatcaatgtcagatcttacatttcaccgttcctgaggtggaggaagagtttatgtactcatgcgacggcgatgaaagacccctcctggtcaagggtacgcttattgctatcgacccattcgatgacaggcgcgaggcaggcggggagtccaccgtggttaacccgaaaagtggatcttggaactttttcgattggttcagcggcctgatgtcctggtttgggggacctttgaagacaattctcctgatctgtctatacgtggccctgtcaataggcctcttctttctgcttatttatttgggtcggactgggctgtctaaaatgtggttagcggctaccaagaaggccagctga

SEQ ID NO: 11170 - RNA, 3480 nt, synthetic construct
  misc_feature 1..3480: note = derived and/or modified CDS sequence (opt3) from RVFV(1853/78)__DQ380220.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaataatatcacatgtcacggtaaggaccctgaagataaaatttccttaatcaagggcccaccgcataaaaagcgcgtcgggatagttcgatgcgagcgtagaagggacgctaagcaaatcggacgggaaactatggccggcattgcaatgacggtgctgcccgccctagctgtattcgcactcgcccctgtggtctttgctgaggatccacatctgcgcaacagacccggtaaagggcacaattatatcgacggaatgacccaggaggatgccacatgtaagcctgtgacttacgcgggcgcatgttcttcgttcgacgttcttctggaaaaaggcaagtttccattgttccagtcatatgcccaccataggaccctcctggaggctgtgcacgatacaattatcgccaaagcagatccccctagctgcgacctgcagagtgctcacgggaacccatgcatgaaggaaaagctcgtcatgaaaacccattgtccgaatgactaccaatccgcccactatttaaacaatgatggaaagatggcgtctgtgaaatgtccccctaagtacgagctgactgaagactgcaacttttgccggcagatgacaggtgccagccttaaaaagggctcctatccattgcaggacctgttctgtcagtcaagtgaggatgacgggagcaaactaaagaccaagatgaaaggagtatgcgaggttggcgtgcaagcactcaagaaatgcgatggtcagctgtctacggctcatgaagtcgtgccctttgccgtgttcaagaatagcaaaaaggtctaccttgacaagctggatttgaaaactgaggaaaacctcctgcctgactcatttgtttgtttcgagcacaaggggcagtacaaaggaaccatggatagcggccagacaaagcgcgaattaaaaagttttgacatatctcaatgcccaaagattggcgggcacggatccaagaaatgtactggtgatgctgccttctgcagcgcatatgagtgtaccgcccagtacgctaatgcgtattgctcgcatgcaaacggctctggggtggtacagatccaagtgtccggagtctggaagaaacccctgtgtgtgggctacgagcgagttgtggtcaagagagaactctcagccaaaccgattcagagggtggagccttgcacaacctgtatcacgaagtgcgaaccccacggtcttgtagttcggagtactgggtttaagatcagctccgctgtggcctgtgcatctggcgtctgcgtgacaggaagccagtcaccaagtaccgagattactctgaaatatcctggcatatcccagagctctgggggagacatcggtgtccatatggcccacgatgaccaatcagtgagtagcaagattgttgctcattgtcccccacaggacccctgcttggtgcacggctgcatcgtatgtgcccacgggctaataaattaccagtgccatacagcactgtccgcgttcgtcgtggttttcgtgttttcttcgattgctatcatctgtctcgccattctgtatcgtgtccttaaatgcctgaagatcgcacctcgcaaagtgttgaacccactcatgtggattaccgccttcataagatgggtatacaagaaaatggtggctagggttgccgataatatcaaccaggtcaaccgggaaattggatggatggagggcggtcaactggtgttagggaatccggcacccatccctcgacacgctccaatcccccgctacagcacgtatctgatgctactcctgattgtgtcctacgcctcagcgtgtagtgagcttatacaggcctctagcagaatcaccacatgctccactgaaggcgtcaacaccaagtgtaggttgtcaggaacagctctgattcgggcaggcagcgttggggccgaggcttgcctcatgctgaagggagtgaaagaagaccagactaagtttcttaaaatcaagaccgtgtcttccgagctgagttgtcgcgagggtcagagctattggacaggctctttctcccctaaatgcttgtcaagtagaaggtgccatctcgtaggggaatgtcacgtcaatcgttgcctgagctggcgggataacgagacctcggccgaattttccttcgtgggagagtctactacgatgcgagaaaataagtgttttgagcaatgcggcggttgggggtgtggctgcttcaacgttaatccaagctgtttatttgtgcacacatacctgcagtcagtcagaaaggaggcactaagggtgttcaactgcattgactgggttcataaactcaccctggaaatcactgattttgacggaagtgtgtccaccatagatcttggcgcgtctagctcccgcttcacaaattgggggtcagtatccttgagtctggacgccgagggaatctctggctccaacagcttttcgttcattgaatcacccggtaaggggtatgctatcgtcgatgagccgttctctgaaattcctcggcagggatttctcggcgagatcagatgtaatagtgagtccagcgtgctgtctgcccacgaaagctgcttaagggcaccaaacctgatatcctacaaacccatgattgaccagcttgagtgtaccactaatttgatcgatcctttcgtggtctttgaacgcggttcactcccccaaacacgaaacgacaagacgttcgctgccagtaaaggcaatcgtggggttcaggcatttagcaagggatctgtgcaggccgatctgaccctaatgttcgacaactttgaggtagacttcgtgggcgctgcggtctcctgcgatgccgcatttctgaacctcactgggtgctattcatgtaatgctggagcccgggtgtgcctgagtattacaagcaccggcacaggtactctttccgcccataacaaggacgggtctttgcacatcgttctgccatcggaaaatggaaccaaagatcaatgtcagatattacatttcacggtgcctgaggtcgaggaagagtttatgtacagctgcgacggcgatgaaagacccctcctggtgaagggtacccttatcgctattgacccattcgatgacaggcgcgaggcaggcggggagtcaacagttgtgaacccgaaatccggaagttggaactttttcgattggttctctggcctgatgagctggtttgggggacctttgaagactatcctcctgatttgtctatacgtcgccctgtccatcggcctcttctttctgcttatatatttgggtcggaccgggctgtcaaaaatgtggttagcggctacaaagaaggcctcttga

SEQ ID NO: 11171 - RNA, 3480 nt, synthetic construct
  misc_feature 1..3480: note = derived and/or modified CDS sequence (opt3) from RVFV(CAR-R1622)__DQ380219.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaataatatcacatgtcacggtaaggaccctgaagataaaatttccttaatcaagggcccaccgcataaaaagcgcgtcgggatagttcgatgcgagcgtagaagggacgctaagcaaatcggacgggaaactatggccggcattgcaatgacggtgctgcccgccctagctgtattcgcactcgcccctgtggtctttgctgaggatccacatctgcgcaacagacccggtaaagggcacaattatatcgacggaatgacccaggaggatgccacatgtaagcctgtgacttacgcgggcgcatgttcttcgttcgacgttcttctggaaaaaggcaagtttccattgttccagtcatatgcccaccataggaccctcctggaggctgtgcacgatacaattatcgccaaagcagatccccctagctgcgacctgcagagtgctcacgggaacccatgcatgaaggaaaagctcgtcatgaaaacccattgtccgaatgactaccaatccgcccactatttaaacaatgatggaaagatggcgtctgtgaaatgtccccctaagtacgagctgactgaagactgcaacttttgccggcagatgacaggtgccagccttaaaaagggctcctatccattgcaggacctgttctgtcagtcaagtgaggatgacgggagcaaactaaagaccaagatgaaaggagtatgcgaggttggcgtgcaagcactcaagaaatgcgatggtcagctgtctacggctcatgaagtcgtgccctttgccgtgttcaaaaattccaagaaggtctaccttgacaagctggatttgaaaactgaggaaaacctcctgcctgactcatttgtttgtttcgagcacaaggggcagtacaaaggaaccatggatagcggccagacaaagcgcgaattaaaaagttttgacatatctcaatgcccaaagattggcgggcacggatccaagaaatgtactggtgatgctgccttctgcagcgcatatgagtgtaccgcccagtacgctaatgcgtattgctcgcatgcaaacggctctgggatcgtgcagattcaagtatccggagtgtggaagaaacccctgtgtgtcggctacgagcgagtggttgtgaagagagaactctcagccaaaccgatccagagggtcgagccttgcacaacctgtatcacgaagtgcgaaccccacggtcttgtggtacggagtactgggtttaagattagctccgctgttgcctgtgcatctggcgtgtgcgtcacaggaagccagtcaccaagtaccgagataactctgaaatatcctggcatctcccagagctctgggggagacattggtgtgcatatggcccacgatgaccaatcagtcagtagcaagatcgtggctcattgtcccccacaggacccctgcttggttcacggctgcatagtgtgtgcccacgggctaattaattaccagtgccatacagcactgtccgcgttcgtagtcgtgttcgtgttttcttcgatcgctatcatttgtctcgccatcctgtatcgtgttcttaaatgcctgaagattgcacctcgcaaagtcttgaacccactcatgtggataaccgccttcatcagatgggtgtacaagaaaatggtagctagggtggccgataatattaaccaggttaaccgggaaatcggatggatggagggcggtcaactggtcttagggaatccggcacccatccctcgacacgctccaattccccgctacagcacgtatctgatgctactcctgatagtgtcctacgcctcagcgtgtagtgagcttatccaggcctctagcagaattaccacatgctccactgaaggcgtgaacaccaagtgtaggttgtcaggaacagctctgatccgggcaggcagcgtcggggccgaggcttgcctcatgctgaagggagttaaagaagaccagactaagtttcttaaaattaagaccgtgtcttccgagctgagttgtcgcgagggtcagagctattggacaggctctttctcccctaaatgcttgtcaagtagaaggtgccatctcgtgggggaatgtcacgtaaatcgttgcctgagctggcgggataacgagacctcggccgaattttccttcgtcggagagtctactacgatgcgagaaaataagtgttttgagcaatgcggcggttgggggtgtggctgcttcaacgtgaatccaagctgtttatttgttcacacatacctgcagtcagtgagaaaggaggcactaagggtcttcaactgcatcgactgggtgcataaactcaccctggaaataactgattttgacggaagtgtttccaccatcgatcttggcgcgtctagctcccgcttcacaaattgggggtcagtgagcttgagtctggacgccgagggaatttctggctccaacagcttttcgttcatcgaatcacccggtaaggggtatgctattgtagatgagccgttctctgaaatccctcggcagggatttctcggcgagataagatgtaatagtgagtccagcgtcctgtctgcccacgaaagctgcttaagggcaccaaacctgatttcctacaaacccatgatcgaccagcttgagtgtaccactaatttgattgatcctttcgtggtgtttgaacgcggttcactcccccaaacacgaaacgacaagacgttcgctgccagtaaaggcaatcgtggggtccaggcatttagcaagggatctgttcaggccgatctgaccctaatgttcgacaactttgaggtggacttcgtaggcgctgcggtgtcctgcgatgccgcatttctgaacctcactgggtgctattcatgtaatgctggagcccgggtctgcctgagtatcacaagcaccggcacaggtactctttccgcccataacaaggacgggtctttgcacatagtgctgccatcggaaaatggaaccaaagatcaatgtcagatcttacatttcacggttcctgaggtggaggaagagtttatgtacagctgcgacggcgatgaaagacccctcctggtcaagggtacccttattgctatcgacccattcgatgacaggcgcgaggcaggcggggagtcaacagtggttaacccgaaatccggaagttggaactttttcgattggttctctggcctgatgagctggtttgggggacctttgaagactattctcctgatctgtctatacgtggccctgtccataggcctcttctttctgcttatttatttgggtcggaccgggctgtcaaaaatgtggttagcggctacaaagaaggcctcttga

SEQ ID NO: 11172 - RNA, 3480 nt, synthetic construct
  misc_feature 1..3480: note = derived and/or modified CDS sequence (opt3) from RVFV(2250/74)__DQ380209.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaataatatcacatgtcacggtaaggaccctgaagataaaatttccttaatcaagggcccaccgcataaaaagcgcgtcgggatagttcgatgcgagcgtagaagggacgctaagcaaatcggacgggaaactatggccggcattgcaatgacggtgctgcccgccctagctgtattcgcactcgcccctgtggtctttgctgaggatccacatctgcgcaacagacccggtaaagggcacaattatatcgacggaatgacccaggaggatgccacatgtaagcctgtgacttacgcgggcgcatgttcttcgttcgacgttcttctggaaaaaggcaagtttccattgttccagtcatatgcccaccataggaccctcctggaggctgtgcacgatacaattatcgccaaagcagatccccctagctgcgacctgcagagtgctcacgggaacccatgcatgaaggaaaagctcgtcatgaaaacccattgtccgaatgactaccaatccgcccactatttaaacaatgatggaaagatggcgtctgtgaaatgtccccctaagtacgagctgactgaagactgcaacttttgccggcagatgacaggtgccagccttaaaaagggctcctatccattgcaggacctgttctgtcagtcaagtgaggatgacgggagcaaactaaagaccaagatgaaaggagtatgcgaggttggcgtgcaagcactcaagaaatgcgatggtcagctgtctacggctcatgaagtcgtgccctttgccgtgttcaaaaattccaagaaggtctaccttgacaagctggatttgaaaactgaggaaaacctcctgcctgactcatttgtttgtttcgagcacaaggggcagtacaaaggaaccatggatagcggccagacaaagcgcgaattaaaaagttttgacatatctcaatgcccaaagattggcgggcacggatccaagaaatgtactggtgatgctgccttctgcagcgcatatgagtgtaccgcccagtacgctaatgcgtattgctcgcatgcaaacggctctgggatcgtgcagattcaagtatccggagtgtggaagaaacccctgtgtgtcggctacgagcgagtggttgtgaagagagaactctcagccaaaccgatccagagggtcgagccttgcacaacctgtatcacgaagtgcgaaccccacggtcttgtggtacggagtactgggtttaagattagctccgctgttgcctgtgcatctggcgtgtgcgtcacaggaagccagtcaccaagtaccgagataactctgaaatatcctggcatctcccagagctctgggggagacattggtgtgcatatggcccacgatgaccaatcagtcagtagcaagatcgtggctcattgtcccccacaggacccctgcttggttcacggctgcatagtgtgtgcccacgggctaattaattaccagtgccatacagcactgtccgcgttcgtagtcgtgttcgtgttttcttcgatcgctatcatttgtctcgccatcctgtatcgtgttcttaaatgcctgaagattgcacctcgcaaagtcttgaacccactcatgtggataaccgccttcatcagatggatttacaagaaaatggtggctagggtagccgataatatcaaccaggtgaaccgggaaatcggatggatggagggcggtcaactggttttagggaatccggcacccattcctcgacacgctccaataccccgctacagcacgtatctgatgctactcctgatcgtctcctacgcctcagcgtgtagtgagcttattcaggcctctagcagaatcaccacatgctccactgaaggcgtgaacaccaagtgtaggttgtcaggaacagctctgattcgggcaggcagcgtgggggccgaggcttgcctcatgctgaagggagtcaaagaagaccagactaagtttcttaaaatcaagaccgtttcttccgagctgagttgtcgcgagggtcagagctattggacaggctctttctcccctaaatgcttgtcaagtagaaggtgccatctcgtgggggaatgtcacgtgaatcgttgcctgagctggcgggataacgagacctcggccgaattttccttcgtaggagagtctactacgatgcgagaaaataagtgttttgagcaatgcggcggttgggggtgtggctgcttcaacgtcaatccaagctgtttatttgtgcacacatacctgcagtcagttagaaaggaggcactaagggtgttcaactgcatagactgggtccataaactcaccctggaaatcactgattttgacggaagtgtgtccaccattgatcttggcgcgtctagctcccgcttcacaaattgggggtcagttagcttgagtctggacgccgagggaatctctggctccaacagcttttcgttcattgaatcacccggtaaggggtatgctatcgtggatgagccgttctctgaaatacctcggcagggatttctcggcgagattagatgtaatagtgagtccagcgtactgtctgcccacgaaagctgcttaagggcaccaaacctgatctcctacaaacccatgattgaccagcttgagtgtaccactaatttgatcgatcctttcgtcgtgtttgaacgcggttcactcccccaaacacgaaacgacaagacgttcgctgccagtaaaggcaatcgtggggtgcaggcatttagcaagggatctgtccaggccgatctgaccctaatgttcgacaactttgaggttgacttcgtgggcgctgcggtatcctgcgatgccgcatttctgaacctcactgggtgctattcatgtaatgctggagccaaggtgtgcctgagtataacaagcaccggcacaggttccctttctgcccataacaaagacgggtcgttgcacatcgtcctgccaagcgaaaatggaactaaggatcaatgtcagattttacatttcaccgtgcctgaggttgaggaagagtttatgtactcatgcgacggcgatgaacggcccctcctggtgaaaggtacgcttatcgctattgacccattcgatgacagaagggaggcaggcggggagtccaccgtcgtgaacccgaagagtggatcttggaactttttcgattggttcagcggcctgatgtcctggtttgggggacctttgaaaacaatcctcctgatatgtctatacgttgccctgtcaattggcctcttctttctgcttatctatttgggtcgcactgggctgtctaagatgtggttagcggctaccaagaaagccagctga

SEQ ID NO: 11173 - RNA, 3480 nt, synthetic construct
  misc_feature 1..3480: note = derived and/or modified CDS sequence (opt3) from RVFV(2007000094)__EU574055.1__NSm-Gn-Gc
  source 1..3480: mol_type = other RNA
atgatcgagggcgcctgggacagcctgagagaagaggaaatgcccgaggaactctcctgctctgtgtcagggattagggaggtcaagaccagtagccaggagctttaccgggctctgaaagcaataatcgccgcggatggattgaacaatattacatgtcacggtaagaaccctgaagacaaaatctccttaattaagggcccaccgcataaaaagcgcgttgggatcgtgcgatgcgagcgtagaagggatgctaagcaaataggacgggaaactatggccggcatcgcaatgacggtactgcccgccctagctgtgttcgcactcgcccctgtcgtgtttgctgaggacccacatctgcgcaatagacccggtaaagggcacaactatattgatggaatgacccaggaggacgccacatgtaagcctgttacttacgcgggcgcatgcagctcgttcgatgtgcttctggaaaaaggcaagtttccattgttccagtcatatgcccaccataggaccctcctggaggctgtccacgacacaatcattgccaaagcagatccccctagctgtgacctgcagagtgctcacgggaatccatgcatgaaggaaaagctcgtgatgaaaacccattgtccgaacgattaccaatccgcccactatttaaataacgacggaaagatggcgtctgtaaaatgtccccctaagtacgagctgactgaagattgcaatttttgccggcagatgacaggtgccagccttaaaaagggctcctatccattgcaggacctgttctgtcagtcaagtgaggacgatgggagcaaactaaagaccaagatgaaaggagtttgcgaggtgggcgtccaagcactcaagaaatgcgacggtcagctgtctacggctcatgaagtggtgccctttgccgtcttcaagaactccaaaaaggtttaccttgataagctggacttgaaaactgaggaaaatctcctgcctgattcatttgtgtgtttcgagcacaaggggcagtacaaaggaaccatggacagcggccagacaaagcgcgaattaaaaagttttgatatctctcaatgcccaaagataggcgggcacggatccaagaaatgtactggtgacgctgccttctgcagcgcatatgagtgtaccgcccagtacgctaacgcgtattgctcgcatgcaaatggctctgggattgtacagatccaagtgtccggagtctggaagaaacccctgtgtgtgggctacgagcgagttgtggtcaagagagaactctcagccaaaccgattcagagggtggagccttgcacaacctgtatcacgaagtgcgaaccccacggtcttgtagttcggagtactgggtttaagatcagctccgctgtggcctgtgcatctggcgtctgcgtgacaggaagccagtcaccaagtaccgagattactctgaaatatcctggcatatcccagagctctgggggagatatcggtgtccatatggcccacgacgatcaatcagtgagtagcaagattgttgctcattgtcccccacaggacccctgcttggtgcacggctgcatcgtatgtgcccacgggctaataaactaccagtgccatacagcactgtccgcgttcgtcgtggttttcgtgttttcttcgattgctatcatctgtctcgccattctgtatcgtgtccttaaatgcctgaagatcgcacctcgcaaagtgttgaatccactcatgtggattaccgccttcataagatgggtatacaagaaaatggtggctagggttgccgacaacatcaaccaggtcaatcgggaaattggatggatggagggcggtcaactggtgttagggaacccggcacccatccctcgacacgctccaatcccccgctacagcacgtatctgatgctactcctgattgtgtcctacgcctcagcgtgtagtgagcttatacaggcctctagcagaatcaccacatgctccactgaaggcgtcaataccaagtgtaggttgtcaggaacagctctgattcgggcaggcagcgttggggccgaggcttgcctcatgctgaagggagtgaaagaagatcagactaagtttcttaaaatcaagaccgtgtcttccgagctgagttgtcgcgagggtcagagctattggacaggctctttctcccctaaatgcttgtcaagtagaaggtgccatctcgtaggggaatgtcacgtcaaccgttgcctgagctggcgggacaatgagacctcggccgaattttccttcgtgggagagtctactacgatgcgagaaaacaagtgttttgagcaatgcggcggttgggggtgtggctgcttcaatgttaacccaagctgtttatttgtgcacacatacctgcagtcagtcagaaaggaggcactaagggtgttcaattgcattgattgggttcataaactcaccctggaaatcactgactttgatggaagtgtgtccaccatagaccttggcgcgtctagctcccgcttcacaaactgggggtcagtatctttgagtctggatgccgagggaatctctggctccaatagcttttcgttcattgaatcacccggtaaggggtatgctatcgtcgacgagccgttctctgaaattcctcggcagggatttctcggcgagatcagatgtaacagtgagtccagcgtgctgtctgcccacgaaagctgcttaagggcaccaaatctgatatcctacaaacccatgattgatcagcttgagtgtaccactaacttgatcgaccctttcgtggtctttgaacgcggttcactcccccaaacacgaaatgataagacgttcgctgccagtaaaggcaaccgtggggttcaggcatttagcaagggatctgtgcaggccgacctgaccctaatgttcgataactttgaggtagacttcgtgggcgctgcggtctcctgcgacgccgcatttctgaatctcactgggtgctattcatgtaacgctggagcccgggtgtgcctgagtattacaagcaccggcacaggtactctttccgcccataataaggatgggtctttgcacatcgttctgccatcggaaaacggaaccaaagaccaatgtcagatattacatttcacggtgcctgaggtcgaggaagagtttatgtacagctgcgatggcgacgaaagacccctcctggtgaagggtacccttatcgctattgatccattcgacgataggcgcgaggcaggcggggagtcaacagttgtgaatccgaaatccggaagttggaactttttcgactggttctctggcctgatgagctggtttgggggacctttgaagactatcctcctgatttgtctatacgtcgccctgtccatcggcctcttctttctgcttatatatttgggtcggaccgggctgtcaaaaatgtggttagcggctacaaagaaggcctcttga

SEQ ID NO: 11174 - RNA, 3480 nt, synthetic construct
  misc_feature 1..3480: note = derived and/or modified CDS sequence (opt3) from RVFV(ZM-657)__DQ380204.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaacaatatcacatgtcacggtaaggaccctgaagataaaatttccttaatcaagggcccaccgcataaaaagcgcgtcgggatagttcgatgcgagcgtagaagggacgctaagcaaatcggacgggaaactatggccggcattgcaatgacggtgctgcccgccctagctgtattcgcactcgcccctgtggtctttgctgaggatccacatctgcgcaacagacccggtaaagggcacaattatatcgacggaatgacccaggaggatgccacatgtaagcctgtgacttacgcgggcgcatgttcttcgttcgacgttcttctggaaaaaggcaagtttccattgttccagtcatatgcccaccataggaccctcctggaggctgtgcacgatacaattatcgccaaagcagatccccctagctgcgacctgcagagtgctcacgggaacccatgcatgaaggaaaagctcgtcatgaaaacccattgtccgaatgactaccaatccgcccactatttaaacaatgatggaaagatggcgtctgtgaaatgtccccctaagtacgagctgactgaagactgcaacttttgccggcagatgacaggtgccagccttaaaaagggctcctatccattgcaggacctgttctgtcagtcaagtgaggatgacgggagcaaactaaagaccaagatgaaaggagtatgcgaggttggcgtgcaagcactcaagaaatgcgatggtcagctgtctacggctcatgaagtcgtgccctttgccgtgttcaaaaattccaagaaggtctaccttgacaagctggatttgaaaactgaggaaaacctcctgcctgactcatttgtttgtttcgagcacaaggggcagtacaaaggaaccatggatagcggccagacaaagcgcgaattaaaaagttttgacatatctcaatgcccaaagattggcgggcacggatccaagaaatgtactggtgatgctgccttctgcagcgcatatgagtgtaccgcccagtacgctaaggcgtattgctcgcatgcaaatggctctgggatcgtgcagattcaagtatccggagtgtggaaaaagcccctgtgtgtcggctacgagcgagtggttgtgaaaagagaactctcagccaagccgatccagagggtcgagccttgcacaacctgtatcacgaagtgcgaaccccacggtcttgtggtacggagtactgggtttaaaattagctccgctgttgcctgtgcatctggcgtgtgcgtcacaggaagccagtcaccaagtaccgagataactctgaagtatcctggcatctcccagagctctgggggagacattggtgtgcatatggcccacgatgaccaatcagtcagtagcaaaatcgtggctcattgtcccccacaggacccctgcttggttcacggctgcatagtgtgtgcccacgggctaattaactaccagtgccatacagcactgtccgcgttcgtagtcgtgttcgtgttttcttcgatcgctatcatttgtctcgccatcctgtatcgtgttcttaagtgcctgaaaattgcacctcgcaaggtcttgaatccactcatgtggataaccgccttcatcagatggatttacaaaaagatggtggctagggtagccgataacatcaatcaggtgaaccgggaaatcggatggatggagggcggtcaactggttttagggaacccggcacccattcctcgacacgctccaataccccgctacagcacgtatctgatgctactcctgatcgtctcctacgcctcagcgtgtagtgagcttattcaggcctctagcagaatcaccacatgctccactgaaggcgtgaataccaagtgtaggttgtcaggaacagctctgattcgggcaggcagcgtgggggccgaggcttgcctcatgctgaaaggagtcaaggaagaccagactaaatttcttaagatcaaaaccgtttcttccgagctgagttgtcgcgagggtcagagctattggacaggctctttctcccctaagtgcttgtcaagtagaaggtgccatctcgtgggggaatgtcacgtgaaccgttgcctgagctggcgggataatgagacctcggccgaattttccttcgtaggagagtctactacgatgcgagaaaacaagtgttttgagcaatgcggcggttgggggtgtggctgcttcaatgtcaacccaagctgtttatttgtgcacacatacctgcagtcagttagaaaagaggcactaagggtgttcaattgcatagactgggtccataagctcaccctggaaatcactgattttgacggaagtgtgtccaccattgatcttggcgcgtctagctcccgcttcacaaactgggggtcagttagcttgagtctggacgccgagggaatctctggctccaatagcttttcgttcattgaatcacccggtaaagggtatgctatcgtggatgagccgttctctgaaatacctcggcagggatttctcggcgagattagatgtaacagtgagtccagcgtactgtctgcccacgaaagctgcttaagggcaccaaatctgatctcctacaagcccatgattgaccagcttgagtgtaccactaacttgatcgatcctttcgtcgtgtttgaacgcggttcactcccccaaacacgaaatgacaaaacgttcgctgccagtaagggcaaccgtggggtgcaggcatttagcaagggatctgtccaggccgatctgaccctaatgttcgacaattttgaggttgacttcgtgggcgctgcggtatcctgcgatgccgcatttctgaacctcactgggtgctattcatgtaacgctggagcccgggtgtgcctgagtataacaagcaccggcacaggttccctttctgcccataataaagacgggtcgttgcacatcgtcctgccaagcgaaaacggaactaaggatcaatgtcagattttacatttcaccgtgcctgaggttgaggaagagtttatgtactcatgcgacggcgatgaaagacccctcctggtgaaaggtacgcttatcgctattgacccattcgatgacaggcgcgaggcaggcggggagtccaccgtcgtgaatccgaagagtggatcttggaactttttcgattggttcagcggcctgatgtcctggtttgggggacctttgaaaacaatcctcctgatatgtctatacgttgccctgtcaattggcctcttctttctgcttatctatttgggtcggactgggctgtctaagatgtggttagcggctaccaagaaagccagctga

SEQ ID NO: 11175 - RNA, 3480 nt, synthetic construct
  misc_feature 1..3480: note = derived and/or modified CDS sequence (opt3) from RVFV(ZH-548M12)__M25276.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaataatatcacatgtcacggtaaggaccctgaagataaaatttccttaatcaagggcccaccgcataaaaagcgcgtcgggatagttcgatgcgagcgtagaagggacgctaagcaaatcggacggaaaactatggccggcattgcaatgacggtgctgcccgccctagctgtattcgcactcgcccctgtggtctttgctgaagatccacatctgcgcaacagacccggtaaggggcacaattatatcgacggaatgacccaggaggatgccacatgtaaacctgtgacttacgcgggcgcatgttcttcgttcgacgttcttctggagaagggcaaatttccattgttccagtcatatgcccaccataggaccctcctggaagctgtgcacgatacaattatcgccaaggcagatccccctagctgcgacctgctcagtgctcacgggaacccatgcatgaaggagaaattagtcatgaagacccattgtccgaatgactaccagtccgcccaccatctgaacaatgatggaaaaatggcgtctgtgaagtgtccccctaaatatgaacttactgaggactgcaacttttgccggcaaatgacaggtgccagcttgaagaaaggctcctacccactgcaggacctattctgtcagtcaagtgaagatgacgggagcaagctcaagaccaaaatgaagggagtatgcgaggttggcgtgcaggcactgaaaaagtgcgatggtcaactttctacggctcacgaggtcgtgccctttgccgtgttcaaaaattccaagaaggtctatctggacaaattggatctcaagactgaagagaacctgttacctgactcatttgtttgtttcgaacacaaagggcagtacaagggaaccatggatagcggccagacaaaacgcgagctgaagagttttgacatatctcagtgcccaaagattggcgggcatggatccaaaaagtgtactggtgatgctgccttctgcagcgcatacgaatgtaccgcccaatatgctaatgcgtactgctcgcacgcaaacggctctgggatcgtgcagattcaggtatccggagtgtggaaaaagcccctctgtgtcggctatgagcgagtggttgtgaaaagagagctttcagccaagccgatccaaagggtcgaaccttgcacaacctgtatcacgaagtgcgagccccatggtctggtggtacggagtactgggtttaaaattagctccgctgttgcctgtgcatctggcgtgtgcgtcacaggaagccagtcaccaagtaccgaaataactttgaagtaccctggcatctcccagagctctgggggagacattggtgtgcacatggcccatgatgaccagtcagtcagtagcaaaatcgtggctcactgtcccccacaagacccctgcctagttcacgattgcatagtgtgtgcccatggcctgattaattatcagtgccacacagcactctccgcgttcgtagtcgtgttcgtgttttcttcgatcgctatcatttgtctggccatcctttaccgtgttctgaagtgcttgaaaattgcacctcgcaaggtcctcaacccactgatgtggataaccgccttcatcagatggatttataaaaagatggtggctagggtagccgacaatatcaaccaggtgaaccgggagatcgggtggatggaaggaggccagttagttctgggtaatccggcacccattcctcgacatgctccaataccccgctacagcacgtacctaatgctcctgcttatcgtctcctatgcctcagcgtgtagtgagttgattcaagcctctagcagaatcaccacatgctccactgagggggtgaacaccaagtgtaggctgtcaggcacagctctcattcgggcaggaagcgtgggcgccgaagcatgcctgatgcttaaaggggtcaaggaggatcagactaaatttctgaagttgaaaaccgtttcttccgaactcagttgtcgcgagggacagagctactggacaggttctttctcccctaagtgcctgtcaagtagaaggtgccacttagtgggcgagtgtcacgtgaatcgttgcctgagctggcgggacaacgaaacctcggccgagttttccttcgtaggggaatctactacgatgcgagagaataagtgttttgaacagtgcggaggctggggttgtgggtgcttcaacgtcaatccaagctgtctatttgtgcatacatatctccaatcagttagaaaagaggcactgagggtgttcaactgcatcgattgggtccacaaacttaccttggagataactgactttgatggcagtgtgtccaccatcgacctgggagcgtctagctcccgcttcacaaattggggctcagttagcctcagtctggatgccgaagggatttctggatccaacagcttttcgttcatcgagtcacccggcaagggttacgctattgtggacgaaccgttctctgagatccctcggcaggggtttttaggagaaataagatgtaatagtgagtccagcgtactgtctgcccatgagagctgccttagggcaccaaacttgatttcctataagcccatgatcgatcagctcgaatgtaccactaatctgattgaccctttcgtcgtgtttgagcgcggctcactaccccagacacgaaacgataaaacgttcgctgccagtaagggtaatcggggcgtgcaagcatttagcaaggggtctgtccaggccgacctgaccctcatgttcgacaactttgaagttgatttcgtgggagctgcggtatcctgcgacgccgcatttctgaaccttactggctgctactcatgtaatgctggggcccgtgtgtgcttgagtatcacaagcaccggaacaggctccctgtctgcccacaacaaagatggttcgttacatatagtcctcccaagcgagaatgggactaaggaccagtgtcaaatcctgcacttcaccgtgcctgaagttgaggaggaatttatgtattcatgcgatggagacgagagaccccttctggtgaaaggcacgttgattgctatcgatccattcgacgataggcgcgaagctggtggcgagtccaccgtcgtgaacccgaagagtgggtcttggaactttttcgactggttcagcggactcatgtcctggtttggcgggcctctgaaaacaattctactgatctgtctctacgttgccctgtcaataggacttttctttttgctgatttacttaggcggtactgggctctctaagatgtggctggcggctaccaagaaagccagctga

SEQ ID NO: 11176 - RNA, 3480 nt, synthetic construct
  misc_feature 1..3480: note = derived and/or modified CDS sequence (opt3) from RVFV(ZH-501-777)__DQ380202.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaataatatcacatgtcacggtaaggaccctgaagataaaatttccttaatcaagggcccaccgcataaaaagcgcgtcgggatagttcgatgcgagcgtagaagggacgctaagcaaatcggacgggaaactatggccggcattgcaatgacggtgctgcccgccctagctgtattcgcactcgcccctgtggtctttgctgaggatccacatctgcgcaacagacccggtaaagggcacaattatatcgacggaatgacccaggaggatgccacatgtaagcctgtgacttacgcgggcgcatgttcttcgttcgacgttcttctggaaaaaggcaagtttccattgttccagtcatatgcccaccataggaccctcctggaggctgtgcacgatacaattatcgccaaagcagatccccctagctgcgacctgcagagtgctcacgggaacccatgcatgaaggaaaagctcgtcatgaaaacccattgtccgaatgactaccaatccgcccactatttaaacaatgatggaaagatggcgtctgtgaaatgtccccctaagtacgagctgactgaagactgcaacttttgccggcagatgacaggtgccagccttaaaaagggctcctatccattgcaggacctgttctgtcagtcaagtgaggatgacgggagcaaactaaagaccaagatgaaaggagtatgcgaggttggcgtgcaagcactcaagaaatgcgatggtcagctgtctacggctcatgaagtcgtgccctttgccgtgttcaaaaattccaaaaaggtctaccttgacaagctggatttgaaaactgaggaaaacctcctgcctgactcatttgtttgtttcgagcacaaggggcagtacaaaggaaccatggatccaggccagacaaagcgcgaattaaagagctttgacataagtcaatgccccaagattggcgggcacggatctaagaaatgtactggtgatgctgccttctgctccgcatatgagtgtaccgcccagtacgctaatgcgtattgcagccatgcaaacggctcggggatcgtgcagattcaagtatctggagtgtggaagaaaccgctgtgtgtcggctacgagcgagtggttgtgaagagagaactctccgccaaacctatccagagggtcgagccctgcacaacctgtatcacgaagtgcgaaccacacggtcttgtggtacggtcaactgggtttaagattagtagcgctgttgcctgtgcatccggcgtgtgcgtcacaggatctcagagcccttcaaccgagataactctgaaatatcccggcatcagtcagtccagcgggggagacattggtgtgcatatggcccacgatgaccaatctgtctcaagtaagatcgtggctcattgcccaccccaggacccttgtttggttcacggctgcatagtgtgtgcccacgggctaattaattaccagtgccatacagcactgagcgcgttcgtagtcgtgttcgtgttttcctctatcgctatcatttgtctcgccgttctgtatcgtgtccttaaatgcctgaagatcgcaccacgcaaagtgttgaacccgctcatgtggattaccgccttcataagatggatctacaagaaaatggtagctagggtggccgataatattaaccaggttaaccgggaaatcggatggatggagggcggtcaactggtcttagggaatcccgcacctatcccacgacacgctcccattcctcgctactcgacgtatctgatgctactcctgatagtgagctacgcctccgcgtgttcagagcttatccaggccagttctagaattaccacatgcagcactgaaggcgtgaacaccaagtgtaggttgtccggaacagctctgatccgggcaggctcagtcggggccgaggcttgcctcatgctgaagggagttaaagaagaccagactaagtttcttaaaattaagaccgtgagctctgagctgtcctgtcgcgagggtcagagttattggacaggcagcttctctccaaaatgcttgtcctcaagaaggtgccatctcgtgggggaatgtcacgtaaatcgttgcctgagttggcgggataacgagaccagcgccgaattttcgttcgtcggagagtccactacgatgcgagaaaataagtgttttgagcaatgcggcggttgggggtgtggctgcttcaacgtgaatccctcttgtttatttgttcacacatacctgcagagcgtgagaaaggaggcactaagggtcttcaactgcatcgactgggtgcataaactcaccctggaaataactgattttgacggatcagttagtaccatcgatcttggcgcgtcctctagccgcttcacaaattgggggtccgtgtcattgagcctggacgccgagggaattagtggctctaactcctttagcttcatcgaatcgccgggtaaggggtatgctattgtagatgagcctttctcagaaatcccacggcagggatttctcggcgagataagatgtaattctgagagttccgtcctgagcgcccacgaatcttgcttaagggcacccaacctgattagctacaaacctatgatcgaccagcttgagtgtaccactaatttgattgatcccttcgtggtgtttgaacgcggttccctcccacaaacacgaaacgacaagacgttcgctgcctcaaaaggcaatcgtggggtccaggcatttagtaagggaagcgttcaggccgatctgaccctaatgttcgacaactttgaggtggacttcgtaggcgctgcggtgtcttgcgatgccgcatttctgaacctcactgggtgctattcctgtaatgctggagcccgggtctgcctgtcaatcacaagtaccggcacaggtagcctttccgcccataacaaggacgggtctttgcacatagtgctgccttcggaaaatggaactaaagatcaatgtcagatcttacatttcaccgttcccgaggtggaggaagagtttatgtacagctgcgacggcgatgaaagaccactcctggtcaagggtacgcttattgctatcgacccgttcgatgacaggcgcgaggcaggcggggagtcaaccgtggttaaccctaaatccggaagttggaactttttcgattggttctctggcctgatgagctggtttgggggacccttgaagacaattctcctgatctgtctatacgtggccctgtccataggcctcttctttctgcttatttatttgggtcggactgggctgtcaaaaatgtggttagcggctaccaagaaggcctcttga

SEQ ID NO: 11177 - RNA, 3480 nt, synthetic construct
  misc_feature 1..3480: note = derived and/or modified CDS sequence (opt3) from RVFV(T-46 (228113))__DQ380199.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaataatatcacatgtcacggtaaggaccctgaagataaaatttccttaatcaagggcccaccgcataaaaagcgcgtcgggatagttcgatgcgagcgtagaagggacgctaagcaaatcggacgggaaactatggccggcattgcaatgacggtgctgcccgccctagctgtattcgcactcgcccctgtggtctttgctgaggatccacatctgcgcaacagacccggtaaagggcacaattatatcgacggaatgacccaggaggatgccacatgtaagcctgtgacttacgcgggcgcatgttcttcgttcgacgttcttctggaaaaaggcaagtttccattgttccagtcatatgcccaccataggaccctcctggaggctgtgcacgatacaattatcgccaaagcagatccccctagctgcgacctgcagagtgctcacgggaacccatgcatgaaggaaaagctcgtcatgaaaacccattgtccgaatgactaccaatccgcccactatttaaacaatgatggaaagatggcgtctgtgaaatgtccccctaagtacgagctgactgaagactgcaacttttgccggcagatgacaggtgccagccttaaaaagggctcctatccattgcaggacctgttctgtcagtcaagtgaggatgacgggagcaaactaaagaccaagatgaaaggagtatgcgaggttggcgtgcaagcactcaagaaatgcgatggtcagctgtctacggctcatgaagtcgtgccctttgccgtgttcaaaaattccaagaaggtctaccttgacaagctggatttgaaaactgaggaaaacctcctgcctgactcatttgtttgtttcgagcacaaggggcagtacaaaggaaccaaggatagcggccagacaaaacgcgaattaaagagttttgacatatctcaatgcccaaagattggcgggcacggatccaaaaagtgtactggtgatgctgccttctgcagcgcatatgagtgtaccgcccagtacgctaatgcgtattgctcgcatgcaaacggctctgggatcgtgcagattcaagtatccggagtgtggaaaaagcccctgtgtgtcggctacgagcgagtggttgtgaaaagagaactctcagccaagccgatccagagggtcgagccttgcacaacctgtatcacgaagtgcgaaccccacggtcttgtggtacggagtactgggtttaaaattagctccgctgttgcctgtgcatctggcgtgtgcgtcacaggaagccagtcaccaagtaccgagataactctgaagtatcctggcatctcccagagctctgggggagacattggtgtgcatatggcccacgatgaccaatcagtcagtagcaaaatcgtggctcattgtcccccacaggacccctgcttggttcacggctgcatagtgtgtgcccacgggctaattaattaccagtgccatacagcactgtccgcgttcgtagtcgtgttcgtgttttcttcgatcgctatcatttgtctcgccgttctgtatcgtgtccttaagtgcctgaaaatcgcacctcgcaaggtgttgaacccactcatgtggattaccgccttcataagatggatctacaaaaagatggtagctagggtggccgataatattaaccaggttaaccgggaaatcggatggatggagggcggtcaactggtcttagggaatccggcacccatccctcgacacgctccaattccccgctacagcacgtatctgatgctactcctgatagtgtcctacgcctcagcgtgtagtgagcttatccaggcctctagcagaattaccacatgctccactgaaggcgtgaacaccaagtgtaggttgtcaggaacagctctgatccgggcaggcagcgtcggggccgaggcttgcctcatgctgaaaggagttaaggaagaccagactaaatttcttaagattaaaaccgtgtcttccgagctgagttgtcgcgagggtcagagctattggacaggctctttctcccctaagtgcttgtcaagtagaaggtgccatctcgtgggggaatgtcacgtaaatcgttgcctgagctggcgggataacgagacctcggccgaattttccttcgtcggagagtctactacgatgcgagaaaataagtgttttgagcaatgcggcggttgggggtgtggctgcttcaacgtgaatccaagctgtttatttgttcacacatacctgcagtcagtgagaaaagaggcactaagggtcttcaactgcatcgactgggtgcataagctcaccctggaaataactgattttgacggaagtgtttccaccatcgatcttggcgcgtctagctcccgcttcacaaattgggggtcagtgagcttgagtctggacgccgagggaatttctggctccaacagcttttcgttcatcgaatcacccggtaaagggtatgctattgtagatgagccgttctctgaaatccctcggcagggatttctcggcgagataagatgtaatagtgagtccagcgtcctgtctgcccacgaaagctgcttaagggcaccaaacctgatttcctacaagcccatgatcgaccagcttgagtgtaccactaatttgattgatcctttcgtggtgtttgaacgcggttcactcccccaaacacgaaacgacaaaacgttcgctgccagtaagggcaatcgtggggtccaggcatttagcaagggatctgttcaggccgatctgaccctaatgttcgacaactttgaggtggacttcgtaggcgctgcggtgtcctgcgatgccgcatttctgaacctcactgggtgctattcatgtaatgctggagcccgggtctgcctgagtatcacaagcaccggcacaggttccctttctgcccataacaaagacgggtcgttgcacatagtgctgccaagcgaaaatggaactaaggatcaatgtcagatcttacatttcaccgttcctgaggtggaggaagagtttatgtactcatgcgacggcgatgaaagacccctcctggtcaaaggtacgcttattgctatcgacccattcgatgacaggcgcgaggcaggcggggagtccaccgtggttaacccgaagagtggatcttggaactttttcgattggttcagcggcctgatgtcctggtttgggggacctttgaaaacaattctcctgatctgtctatacgtggccctgtcaataggcctcttctttctgcttatttatttgggtcggactgggctgtctaagatgtggttagcggctaccaagaaagccagctga

SEQ ID NO: 11178 - RNA, 3480 nt, synthetic construct
  misc_feature 1..3480: note = derived and/or modified CDS sequence (opt3) from RVFV(OS-3)__DQ380184.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaataatatcacatgtcacggtaaggaccctgaagataaaatttccttaatcaagggcccaccgcataaaaagcgcgtcgggatagttcgatgcgagcgtagaagggacgctaagcaaatcggacgggaaactatggccggcattgcaatgacggtgctgcccgccctagctgtattcgcactcgcccctgtggtctttgctgaggatccacatctgcgcaacagacccggtaaagggcacaattatatcgacggaatgacccaggaggatgccacatgtaagcctgtgacttacgcgggcgcatgttcttcgttcgacgttcttctggaaaaaggcaagtttccattgttccagtcatatgcccaccataggaccctcctggaggctgtgcacgatacaattatcgccaaagcagatccccctagctgcgacctgcagagtgctcacgggaacccatgcatgaaggaaaagctcgtcatgaaaacccattgtccgaatgactaccaatccgcccactatttaaacaatgatggaaagatggcgtctgtgaaatgtccccctaagtacgagctgactgaagactgcaacttttgccggcagatgacaggtgccagccttaaaaagggctcctatccattgcaggacctgttctgtcagtcaagtgaggatgacgggagcaaactaaagaccaagatgaaaggagtatgcgaggttggcgtgcaagcactcaagaaatgcgatggtcagctgtctacggctcatgaagtcgtgccctttgccgtgttcaagaatagcaaaaaggtctaccttgacaagctggatttgaaaactgaggaaaacctcctgcctgactcatttgtttgtttcgagcacaaggggcagtacaaaggaaccatggatagcggccagacaaagcgcgaattaaaaagttttgacatatctcaatgcccaaagattggcgggcacggatccaagaaatgtactggtgatgctgccttctgcagcgcatatgagtgtaccgcccagtacgctaatgcgtattgctcgcatgcaaacggctctggggtggtacagatccaagtgtccggagtctggaagaaacccctgtgtgtgggctacgagcgagttgtggtcaagagagaactctcagccaaaccgattcagagggtggagccttgcacaacctgtatcacgaagtgcgaaccccacggtcttgtagttcggagtactgggtttaagatcagctccgctgtggcctgtgcatctggcgtctgcgtgacaggaagccagtcaccaagtaccgagattactctgaaatatcctggcatatcccagagctctgggggagacatcggtgtccatatggcccacgatgaccaatcagtgagtagcaagattgttgctcattgtcccccacaggacccctgcttggtgcacggctgcatcgtatgtgcccacgggctaataaattaccagtgccatacagcactgtccgcgttcgtcgtggttttcgtgttttcttcggtcgctattatctgtctcgccatcctgtataaagtgcttaagtgcctgaaaattgcacctcgtaaggtattgaacccactcatgtggatcaccgccttcattcgctgggtgtacaaaaagatggttgctagagtcgccgataatataaaccaggtgaacagggaaatcggatggatggagggcggtcaactggcattagggaatccggctcccattcctcggcacgccccaatcccccgatacagcacgtatctgatgctactcctgatcgtgtcctacgcgtcagcctgtagtgagcttattcaggcttctagccgcataaccacatgctccactgaaggcgtcaacaccaagtgtagattgtcaggaacagcactgatcagggccggcagcgttggggctgaggcctgcctcatgctgaaaggagtgaaggaagaccagactaaatttcttaagattaaaaccgtgtcttccgagctgagttgtcgggagggtcagagctattggacaggctctttctcccctaagtgcttgtcaagtcgcagatgccatctcgtaggggaatgtcacgtcaataggtgcctgagctggcgtgataacgagacctcggcagaattttccttcgtgggagagtctactacgatgcgggaaaataagtgttttgagcaatgcggcggttgggggtgtggctgcttcaacgttaatccaagctgtttatttgtgcacacatacctgcagtcagtccgaaaagaggcgctaagagtgttcaactgcatcgactgggttcataagctcaccctggaaattactgattttgacggaagtgtgtccaccatcgatcttggcgcctctagctccaggttcacaaattgggggtcagtatccttgagtctggacgctgagggaatatctggctccaacagcttttcgttcatcgaatcacccggtaaagggtatgccattgtcgatgagccgttctctgaaatccctcgccagggatttctcggcgagattcggtgtaatagtgagtccagcgtgctgtctgcacacgaaagctgcttaagagctccaaacctgatctcctacaagcccatgatagaccagcttgagtgtaccactaatttgattgatcctttcgtggtctttgaaaggggttcactcccccaaacacgcaacgacaaaacgttcgccgcaagtaagggcaatcgaggggttcaggcctttagcaagggatctgtgcaggctgatctgaccctaatgttcgacaactttgaggtagacttcgtgggcgcggccgtctcctgcgatgcagcttttctgaacctcactgggtgctattcatgtaatgccggagcccgggtgtgcctgagtatcacaagcaccggcacaggtactctttccgctcataacaaagacgggtctttgcacattgttctgccatcggaaaatggaaccaaggatcaatgtcagatcttacatttcacggtgcctgaggtcgaggaagagtttatgtacagctgcgacggcgatgaacgtcccctcctggtgaaaggtacccttatagcaatcgacccattcgatgacagaagggaggccggcggggagtcaacagttgtgaacccgaagtccggaagttggaactttttcgattggttctctggcctgatgagctggtttgggggacctttgaaaactattctcctgatctgtctatacgtcgcgctgtccattggcctcttctttctgcttatctatttgggtcgcaccgggctgtcaaagatgtggttagctgccacaaagaaagcatcttga

SEQ ID NO: 11179 - RNA, 3480 nt, synthetic construct
  misc_feature 1..3480: note = derived and/or modified CDS sequence (opt3) from RVFV(Sudan 86-2010)__JQ820489.1__NSm-Gn-Gc
  source 1..3480: mol_type = other RNA
atgatcgagggcgcctgggacagcctgagagaagaggaaatgcccgaggaactctcctgctctgtgtcagggattagggaggtcaagaccagtagccaggagctttaccgggctctgaaagcaataatcgccgcggatggattgaacaatattacatgtcacggtaagaaccctgaagacaaaatctccttaattaagggcccaccgcataaaaagcgcgttgggatcgtgcgatgcgagcgtagaagggatgctaagcaaataggacgggaaactatggccggcatcgcaatgacggtactgcccgccctagctgtgttcgcactcgcccctgtcgtgtttgctgaggacccacatctgcgcaatagacccggtaaagggcacaactatattgatggaatgacccaggaggacgccacatgtaagcctgttacttacgcgggcgcatgcagctcgttcgatgtgcttctggaaaaaggcaagtttccattgttccagtcatatgcccaccataggaccctcctggaggctgtccacgacacaatcattgccaaagcagatccccctagctgtgacctgcagagtgctcacgggaatccatgcatgaaggaaaagctcgtgatgaaaacccattgtccgaacgattaccaatccgcccactatttaaataacgacggaaagatggcgtctgtaaaatgtccccctaagtacgagctgactgaagattgcaatttttgccggcagatgacaggtgccagccttaaaaagggctcctatccattgcaggacctgttctgtcagtcaagtgaggacgatgggagcaaactaaagaccaagatgaaaggagtttgcgaggtgggcgtccaagcactcaagaaatgcgacggtcagctgtctacggctcatgaagtggtgccctttgccgtcttcaagaactccaaaaaggtttaccttgataagctggacttgaaaactgaggaaaatctcctgcctgattcatttgtgtgtttcgagcacaaggggcagtacaaaggaaccatggacagcggccagacaaagcgcgaattaaaaagttttgatatctctcaatgcccaaagataggcgggcacggatccaagaaatgtactggtgacgctgccttctgcagcgcatatgagtgtaccgcccagtacgctaacgcgtattgctcgcatgcaaatggctctgggattgtacagatccaagtgtccggagtctggaagaaacccctgtgtgtgggctacgagcgagttgtggtcaagagagaactctcagccaaaccgattcagagggtggagccttgcacaacctgtatcacgaagtgcgaaccccacggtcttgtagttcggagtactgggtttaagatcagctccgctgtggcctgtgcatctggcgtctgcgtgacaggaagccagtcaccaagtaccgagattactctgaaatatcctggcatatcccagagctctgggggagatatcggtgtccatatggcccacgacgatcaatcagtgagtagcaagattgttgctcattgtcccccacaggacccctgcttggtgcacggctgcatcgtatgtgcccacgggctaataaactaccagtgccatacagcactgtccgcgttcgtcgtggttttcgtgttttcttcgattgctatcatctgtctcgccattctgtatcgtgtccttaaatgcctgaagatcgcacctcgcaaagtgttgaatccactcatgtggattaccgccttcataagatgggtatacaagaaaatggtggctagggttgccgacaacatcaaccaggtcaatcgggaaattggatggatggagggcggtcaactggtgttagggaacccggcacccatccctcgacacgctccaatcccccgctacagcacgtatctgatgctactcctgattgtgtcctacgcctcagcgtgtagtgagcttatacaggcctctagcagaatcaccacatgctccactgaaggcgtcaataccaagtgtaggttgtcaggaacagctctgattcgggcaggcagcgttggggccgaggcttgcctcatgctgaagggagtgaaagaagatcagactaagtttcttaaaatcaagaccgtgtcttccgagctgagttgtcgcgagggtcagagctattggacaggctctttctcccctaaatgcttgtcaagtagaaggtgccatctcgtaggggaatgtcacgtcaaccgttgcctgagctggcgggacaatgagacctcggccgaattttccttcgtgggagagtctactacgatgcgagaaaacaagtgttttgagcaatgcggcggttgggggtgtggctgcttcaatgttaacccaagctgtttatttgtgcacacatacctgcagtcagtcagaaaggaggcactaagggtgttcaattgcattgattgggttcataaactcaccctggaaatcactgactttgatggaagtgtgtccaccatagaccttggcgcgtctagctcccgcttcacaaactgggggtcagtatctttgagtctggatgccgagggaatctctggctccaatagcttttcgttcattgaatcacccggtaaggggtatgctatcgtcgacgagccgttctctgaaattcctcggcagggatttctcggcgagatcagatgtaacagtgagtccagcgtgctgtctgcccacgaaagctgcttaagggcaccaaatctgatatcctacaaacccatgattgatcagcttgagtgtaccactaacttgatcgaccctttcgtgatttttgaacgcggttcactcccccaaacacgaaatgataagacgttcgctgccagtaaaggcaaccgtggggtccaggcatttagcaagggatctgttcaggccgacctgaccctaatgttcgataactttgaggtggacttcgtaggcgctgcggtgtcctgcgacgccgcatttctgaatctcactgggtgctattcatgtaacgctggagcccgggtctgcctgagtatcacaagcaccggcacaggtactctttccgcccataataaggatgggtctttgcacatagtgctgccatcggaaaacggaaccaaagaccaatgtcagatcttacatttcacggttcctgaggtggaggaagagtttatgtacagctgcgatggcgacgaaagacccctcctggtcaagggtacccttattgctatcgatccattcgacgataggcgcgaggcaggcggggagtcaacagtggttaatccgaaatccggaagttggaactttttcgactggttctctggcctgatgagctggtttgggggacctttgaagactattctcctgatctgtctatacgtggccctgtccataggcctcttctttctgcttatttatttgggtcggaccgggctgtcaaaaatgtggttagcggctacaaagaaggcctcttga

SEQ ID NO: 11180 - RNA, 3480 nt, synthetic construct
  misc_feature 1..3480: note = derived and/or modified CDS sequence (opt3) from RVFV(Sudan 28-2010)__JQ820491.1__NSm-Gn-Gc
  source 1..3480: mol_type = other RNA
atgatcgagggcgcctgggacagcctgagagaagaggaaatgcccgaggaactctcctgctctgtgtcagggattagggaggtcaagaccagtagccaggagctttaccgggctctgaaagcaataatcgccgcggatggattgaacaatattacatgtcacggtaagaaccctgaagacaaaatctccttaattaagggcccaccgcataaaaagcgcgttgggatcgtgcgatgcgagcgtagaagggatgctaagcaaataggacgggaaactatggccggcatcgcaatgacggtactgcccgccctagctgtgttcgcactcgcccctgtcgtgtttgctgaggacccacatctgcgcaatagacccggtaaagggcacaactatattgatggaatgacccaggaggacgccacatgtaagcctgttacttacgcgggcgcatgcagctcgttcgatgtgcttctggaaaaaggcaagtttccattgttccagtcatatgcccaccataggaccctcctggaggctgtccacgacacaatcattgccaaagcagatccccctagctgtgacctgcagagtgctcacgggaatccatgcatgaaggaaaagctcgtgatgaaaacccattgtccgaacgattaccaatccgcccactatttaaataacgacggaaagatggcgtctgtaaaatgtccccctaagtacgagctgactgaagattgcaatttttgccggcagatgacaggtgccagccttaaaaagggctcctatccattgcaggacctgttctgtcagtcaagtgaggacgatgggagcaaactaaagaccaagatgaaaggagtttgcgaggtgggcgtccaagcactcaagaaatgcgacggtcagctgtctacggctcatgaagtggtgccctttgccgtcttcaagaactccaaaaaggtttaccttgataagctggacttgaaaactgaggaaaatctcctgcctgattcatttgtgtgtttcgagcacaaggggcagtacaaaggaaccatggacagcggccagacaaagcgcgaattaaaaagttttgatatctctcaatgcccaaagataggcgggcacggatccaagaaatgtactggtgacgctgccttctgcagcgcatatgagtgtaccgcccagtacgctaacgcgtattgctcgcatgcaaatggctctgggattgtacagatccaagtgtccggagtctggaagaaacccctgtgtgtgggctacgagcgagttgtggtcaagagagaactctcagccaaaccgattcagagggtggagccttgcacaacctgtatcacgaagtgcgaaccccacggtcttgtagttcggagtactgggtttaagatcagctccgctgtggcctgtgcatctggcgtctgcgtgacaggaagccagtcaccaagtaccgagattactctgaaatatcctggcatatcccagagctctgggggagatatcggtgtccatatggcccacgacgatcaatcagtgagtagcaagattgttgctcattgtcccccacaggacccctgcttggtgcacggctgcatcgtatgtgcccacgggctaataaactaccagtgccatacagcactgtccgcgttcgtcgtggttttcgtgttttcttcgattgctatcatctgtctcgccattctgtatcgtgtccttaaatgcctgaagatcgcacctcgcaaagtgttgaatccactcatgtggattaccgccttcataagatgggtatacaagaaaatggtggctagggttgccgacaacatcaaccaggtcaatcgggaaattggatggatggagggcggtcaactggtgttagggaacccggcacccatccctcgacacgctccaatcccccgctacagcacgtatctgatgctactcctgattgtgtcctacgcctcagcgtgtagtgagcttatacaggcctctagcagaatcaccacatgctccactgaaggcgtcaataccaagtgtaggttgtcaggaacagctctgattcgggcaggcagcgttggggccgaggcttgcctcatgctgaagggagtgaaagaagatcagactaagtttcttaaaatcaagaccgtgtcttccgagctgagttgtcgcgagggtcagagctattggacaggctctttctcccctaaatgcttgtcaagtagaaggtgccatctcgtaggggaatgtcacgtcaaccgttgcctgagctggcgggacaatgagacctcggccgaattttccttcgtgggagagtctactacgatgcgagaaaacaagtgttttgagcaatgcggcggttgggggtgtggctgcttcaatgttaacccaagctgtttatttgtgcacacatacctgcagtcagtcagaaaggaggcactaagggtgttcaattgcattgattgggttcataaactcaccctggaaatcactgactttgatggaagtgtgtccaccatagaccttggcgcgtctagctcccgcttcacaaactgggggtcagtatctttgagtctggatgccgagggaatctctggctccaatagcttttcgttcattgaatcacccggtaaggggtatgctatcgtcgacgagccgttctctgaaattcctcggcagggatttctcggcgagatcagatgtaacagtgagtccagcgtgctgtctgcccacgaaagctgcttaagggcaccaaatctgatatcctacaaacccatgattgatcagcttgagtgtaccactaacttgatcgaccctttcgtggtctttgaacgcggttcactcccccaaacacgaaatgataagacgttcgctgccagtaaaggcaaccgtggggttcaggcatttagcaagggatctgtgcaggccgacctgaccctaatgttcgataactttgaggtagacttcgtgggcgctgcggtctcctgcgacgccgcatttctgaatctcactgggtgctattcatgtaacgctggagcccgggtgtgcctgagtattacaagcaccggcacaggtactctttccgcccataataaggatgggtctttgcacatcgttctgccatcggaaaacggaaccaaagaccaatgtcagatattacatttcacggtgcctgaggtcgaggaagagtttatgtacagctgcgatggcgacgaaagacccctcctggtgaagggtacccttatcgctattgatccattcgacgataggcgcgaggcaggcggggagtcaacagttgtgaatccgaaatccggaagttggaactttttcgactggttctctggcctgatgagctggtttgggggacctttgaagactatcctcctgatttgtctatacgtcgtactgtccatcggcctcttctttctgcttatatatttgggtcggaccgggctgtcaaaaatgtggttagccgcgacaaagaaggcttcttga

SEQ ID NO: 11181 - RNA, 3480 nt, synthetic construct
  misc_feature 1..3480: note = derived and/or modified CDS sequence (opt3) from RVFV(2007004194)__EU574031.1__NSm-Gn-Gc
  source 1..3480: mol_type = other RNA
atgatcgagggcgcctgggacagcctgagagaagaggaaatgcccgaggaactctcctgctctgtgtcagggattagggaggtcaagaccagtagccaggagctttaccgggctctgaaagcaataatcgccgcggatggattgaataatattacatgtcacggtaagaaccctgaagacaaaatctccttaattaagggcccaccgcataaaaagcgcgttgggatcgtgcgatgcgagcgtagaagggatgctaagcaaataggacgggaaactatggccggcatcgcaatgacggtactgcccgccctagctgtgttcgcactcgcccctgtcgtgtttgctgaggacccacatctgcgcaatagacccggtaaagggcacaactatattgatggaatgacccaggaggacgccacatgtaagcctgttacttacgcgggcgcatgttcttcgttcgatgtgcttctggaaaaaggcaagtttccattgttccagtcatatgcccaccataggaccctcctggaggctgtccacgacacaatcattgccaaagcagatccccctagctgcgacctgcagagtgctcacgggaatccatgcatgaaggaaaagctcgtgatgaaaacccattgtccgaacgattaccaatccgcccactatttatctaatgacggaaagatggcgagcgtaaaatgtccccctaagtacgagctgactgaagattgcaacttttgccggcagatgacaggtgcctcccttaaaaagggctcatatccattgcaggacctgttctgtcagagtagcgaggacgatgggtctaaactaaagaccaagatgaaaggagtttgcgaggtgggcgtccaagcactcaagaaatgcgacggtcagctgtccacggctcatgaagtggtgccctttgccgtcttcaagaatagcaaaaaggtttaccttgataagctggacttgaaaactgaggaaaacctcctgcctgattcatttgtgtgtttcgagcacaaggggcagtacaaaggaaccatggacagtggccagacaaagcgcgaattaaaatcttttgatatctcccaatgcccaaagataggcgggcacggaagcaagaaatgtactggtgacgctgccttctgctcggcatatgagtgtaccgcccagtacgctaatgcgtattgctctcatgcaaacggctccgggattgtacagatccaagtgtcaggagtctggaagaaacccctgtgtgtgggctacgagcgagttgtggtcaagagagaactcagtgccaaaccgattcagagggtggagccttgcacaacctgtatcacgaagtgcgaaccccacggtcttgtagttcggagcactgggtttaagatctcctctgctgtggcctgtgcaagcggcgtctgcgtgacaggatcacagagtccatccaccgagattactctgaaatatcctggcataagccagtcttcagggggagatatcggtgtccatatggcccacgacgatcaaagtgtgagctccaagattgttgctcattgtcccccacaggacccctgcttggtgcacggctgcatcgtatgtgcccacgggctaataaattaccagtgccatacagcactgtctgcgttcgtcgtggttttcgtgttttcgagcattgctatcatctgtctcgccattctgtatcgtgtccttaaatgcctgaagatcgcacctcgcaaagtgttgaacccactcatgtggattaccgccttcataagatgggtatacaagaaaatggtggctagggttgccgacaatatcaaccaggtcaaccgggaaattggatggatggagggcggtcaactggtgttagggaatccggcacccatccctcgacacgctccaatcccccgctactccacgtatctgatgctactcctgattgtgtcatacgccagtgcgtgttctgagcttatacaggccagctccagaatcaccacatgctcaactgaaggcgtcaacaccaagtgtaggttgagcggaacagctctgattcgggcaggctctgttggggccgaggcttgcctcatgctgaagggagtgaaagaagatcagactaagtttcttaaaatcaagaccgtgtccagtgagctgagctgtcgcgagggtcagtcttattggacaggctccttctcacctaaatgcttgagtagcagaaggtgccatctcgtaggggaatgtcacgtcaatcgttgcctgtcgtggcgggacaacgagacctccgccgaattttctttcgtgggagagagcactacgatgcgagaaaataagtgttttgagcaatgcggcggttgggggtgtggctgcttcaacgttaatccatcatgtttatttgtgcacacatacctgcagagtgtcagaaaggaggcactaagggtgttcaactgcattgattgggttcataaactcaccctggaaatcactgactttgatggatccgtgtctaccatagaccttggcgcgagctcctcacgcttcacaaattgggggagcgtaagtttgtctctggatgccgagggaatctccggcagcaactcgttttcattcattgaatctcccggtaaggggtatgctatcgtcgacgagccgttcagtgaaattcctcggcagggatttctcggcgagatcagatgtaattccgagagctctgtgctgagcgcccacgaatcctgcttaagggcaccaaacctgatatcatacaaacccatgattgatcagcttgagtgtaccactaatttgatcgaccctttcgtggtctttgaacgcggtagtctcccccaaacacgaaacgataagacgttcgctgccagcaaaggcaatcgtggggttcaggcattttctaagggatccgtgcaggccgacctgaccctaatgttcgataactttgaggtagacttcgtgggcgctgcggtctcatgcgacgccgcatttctgaacctcactgggtgctatagttgtaatgctggagcccgggtgtgcctgagcattacatccaccggcacaggtactctttctgcccataacaaggatgggtcgttgcacatcgttctgccaagcgaaaatggaaccaaagaccaatgtcagatattacatttcacggtgcctgaggtcgaggaagagtttatgtactcatgcgatggcgacgaaagacccctcctggtgaagggtacccttatcgctattgatccattcgacgataggcgcgaggcaggcggggagtccacagttgtgaacccgaaaagtggatcttggaactttttcgactggttcagcggcctgatgtcctggtttgggggacctttgaagactatcctcctgatttgtctatacgtcgccctgtcaatcggcctcttctttctgcttatatatttgggtcggaccgggctgtctaaaatgtggttagcggctacaaagaaggccagctga

SEQ ID NO: 11182 - RNA, 3480 nt, synthetic construct
  misc_feature 1..3480: note = derived and/or modified CDS sequence (opt3) from RVFV(73HB1230)__DQ380221.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaataatatcacatgtcacggtaaggaccctgaagataaaatttccttaatcaagggcccaccgcataaaaagcgcgtcgggatagttcgatgcgagcgtagaagggacgctaagcaagtgggacgggaaactatggccggcatcgcaatgacggtactgcccgccctagctgtgttcgcactcgcccctgtcgtgtttgctgaggatccacatctgcgcaacagacccggtaaagggcacaattatattgacggaatgacccaggaggatgccacatgtaagcctgttacttacgcgggcgcatgttcttcgttcgacgtgcttctggaaaaaggcaagtttccattgttccagtcatatgcccaccataggaccctcctggaggctgtccacgatacaatcattgccaaagcagatccccctagctgcgacctgcagagtgctcacgggaacccatgcatgaaggaaaagctcgtgatgaaaacccattgtccgaatgactaccaatccgcccactatttaaacaatgatggaaagatggcgtctgtaaaatgtccccctaagtacgagctgactgaagactgcaacttttgccggcagatgacaggtgccagccttaaaaagggctcctatccattgcaggacctgttctgtcagtcaagtgaggatgacgggagcaaactaaagaccaagatgaaaggagtttgcgaggtgggcgtccaagcactcaagaaatgcgatggtcagctgtctacggctcatgaagtggtgccctttgccgtcttcaagaatagcaaaaaggtttaccttgacaagctggatttgaaaactgaggaaaacctcctgcctgactcatttgtgtgtttcgagcacaaggggcagtacaaaggaaccatggatagcggccagacaaagaaagaattaaagagttttgacatctctcaatgcccaaagataggcgggcacggatccaaaaagtgtactggtgatgctgccttctgcagcgcatatgagtgtaccgcccagtacgctaatgcgtattgctcgcatgcaaacggctctgggattgtacagatccaagtgtccggagtctggaaaaagcccctgtgtgtgggctacgagcgcgttgtggtcaaacgagaactctcagccaagccgattcagagagtggagccttgcacaacctgtatcacgaagtgcgaaccccacggtcttgtagttaggagtactgggtttaaaatcagctccgctgtggcctgtgcatctggcgtctgcgtgacaggaagccagtcaccaagtaccgagattactctgaagtatcctggcatatcccagagctctgggggagacatcggtgtccatatggcccacgatgaccaatcagtgagtagcaaaattgttgctcattgtcccccacaggacccctgcttggtgcacggctgcatcgtatgtgcccacgggctaataaattaccagtgccatacagcactgtccgcgttcgtcgtggttttcgtgttttcttcgattgctatcatctgtctcgccattctgtatcgggtccttaagtgcctgaaaatcgcacctcgtaaggtgttgaacccactcatgtggattaccgccttcatacgctgggtatacaaaaagatggtggctagagttgccgataatatcaaccaggtcaacagggaaattggatggatggagggcggtcaactggtgttagggaatccggcacccatccctcggcacgctccaatcccccgatacagcacgtatctgatgctactcctgattgtgtcctacgcctcagcgtgtagtgagcttatacaggcctctagccgcatcaccacatgctccactgaaggcgtcaacaccaagtgtagattgtcaggaacagctctgattagggcaggcagcgttggggccgaggcttgcctcatgctgaaaggagtgaaggaagaccagactaaatttcttaagatcaaaaccgtgtcttccgagctgagttgtcgggagggtcagagctattggacaggctctttctcccctaagtgcttgtcaagtcgcagatgccatctcgtaggggaatgtcacgtcaataggtgcctgagctggcgtgataacgagacctcggccgaattttccttcgtgggagagtctactattatgcgggaaaataagtgttttgagcaatgcggcggttgggggtgtggctgcttcaacgttaatccaagctgtttatttgtgcacacgtacctgcagtcagtccgaaaagaggcactaagagtgttcaactgcatcgactgggttcataagctcacactggaaataaccgattttgacggaagtgtgtccactatcgatcttggcgcgtctagctccaggttcaccaattgggggtcagtatccttgagtctggacgccgagggaatttctggctccaacagcttttcgttcatcgaatcacccggtaaagggtatgctattgtcgatgagccgttctctgaaatccctcgccagggatttctcggcgagatacggtgtaatagtgagtccagcgtgctgtctgcccacgaaagctgcttaagagcaccaaacctgatttcctacaagcccatgatcgaccagcttgagtgtacaaccaatttgattgatcctttcgtggtctttgaaaggggttcactcccccaaactcgcaacgacaaaacattcgctgccagtaagggcaatcgaggggttcaggcatttagcaagggatctgtgcaggccgatctgacgctaatgttcgacaactttgaggtagacttcgtgggcgctgcggtctcctgcgatgccgcatttctgaacctcaccgggtgctattcatgtaatgctggagcccgggtgtgcctgagtatcactagcacaggcaccggtacactttccgcccataacaaagacgggtctttgcacatagttctgccatcggaaaatggaactaaggatcaatgtcagatcttacatttcaccgtgcctgaggtcgaggaagagtttatgtacagctgcgacggcgatgaacgtcccctcctggtgaaaggtacgcttattgctatcgacccattcgatgacagaagggaggcaggcggggagtcaaccgttgtgaacccgaagtccggaagttggaactttttcgattggttctctggcctgatgagctggtttgggggacctttgaaaacaattctcctgatctgtctatacgtcgccctgtccataggcctcttctttctgcttatttatttgggtcgcactgggctgtcaaagatgtggttagcggctaccaagaaagcctcttga

SEQ ID NO: 11183 - RNA, 3480 nt, synthetic construct
  misc_feature 1..3480: note = derived and/or modified CDS sequence (opt3) from RVFV(1260/78)__DQ380214.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaataatatcacatgtcacggtaaggaccctgaagataaaatttccttaatcaagggcccaccgcataaaaagcgcgtcgggatagttcgatgcgagcgtagaagggacgctaagcaaatcggacgggaaactatggccggcattgcaatgacggtgctgcccgccctagctgtattcgcactcgcccctgtggtctttgctgaggatccacatctgcgcaacagacccggtaaagggcacaattatatcgacggaatgacccaggaggatgccacatgtaagcctgtgacttacgcgggcgcatgttcttcgttcgacgttcttctggaaaaaggcaagtttccattgttccagtcatatgcccaccataggaccctcctggaggctgtgcacgatacaattatcgccaaagcagatccccctagctgcgacctgcagagtgctcacgggaacccatgcatgaaggaaaagctcgtcatgaaaacccattgtccgaatgactaccaatccgcccactatttaaacaatgatggaaagatggcgtctgtgaaatgtccccctaagtacgagctgactgaagactgcaacttttgccggcagatgacaggtgccagccttaaaaagggctcctatccattgcaggacctgttctgtcagtcaagtgaggatgacgggagcaaactaaagaccaagatgaaaggagtatgcgaggttggcgtgcaagcactcaagaaatgcgatggtcagctgtctacggctcatgaagtcgtgccctttgccgtgttcaaaaattccaagaaggtctaccttgacaagctggatttgaaaactgaggaaaacctcctgcctgactcatttgtttgtttcgagcacaaggggcagtacaaaggaaccatggatagcggccagacaaagcgcgaattaaaaagttttgacatatctcaatgcccaaagattggcgggcacggatccaagaaatgtactggtgatgctgccttctgcagcgcatatgagtgtaccgcccagtacgctaatgcgtattgctcgcatgcaaacggctctgggatcgtgcagattcaagtatccggagtgtggaagaaacccctgtgtgtcggctacgagcgagtggttgtgaagagagaactctcagccaaaccgatccagagggtcgagccttgcacaacctgtatcacgaagtgcgaaccccacggtcttgtggtacggagtactgggtttaagattagctccgctgttgcctgtgcatctggcgtgtgcgtcacaggaagccagtcaccaagtaccgagataactctgaaatatcctggcatctcccagagctctgggggagacattggtgtgcatatggcccacgatgaccaatcagtcagtagcaagatcgtggctcattgtcccccacaggacccctgcttggttcacggctgcatagtgtgtgcccacgggctaattaattaccagtgccatacagcactgtccgcgttcgtagtcgtgttcgtgttttcttcgatcgctatcatttgtctcgccatcctgcaccgtgttcttaaatgcctgaagattgcacctcgcaaagtcttgaacccactcatgtggataaccgccttcatcagatgggtgtataagaaaatggtagctagggtggccgataatattaaccaggttaaccgggaaatcggatggatggagggcggtcaactggtcttagggaatccggcacccatccctcgacatgctccaattccccgctacagcacgtacctgatgctactcctgatagtgtcctatgcctcagcgtgtagtgagcttatccaggcctctagcagaattaccacatgctccactgaaggcgtgaacaccaagtgtaggttgtcaggaacagctctgatccgggcaggcagcgtcggggccgaggcttgcctcatgctgaagggagttaaagacgatcagactaagtttcttaaaattaagaccgtgtcttccgaactgagttgtcgcgagggtcagagctactggacaggctctttctcccctaaatgcttgtcaagtagaaggtgccacctcgtgggggagtgtcacgtaaatcgttgcctgagctggcgggacaacgaaacctcggccgagttttccttcgtcggagaatctactacgatgcgagagaataagtgttttgaacaatgcggcggttgggggtgtggctgcttcaacgtgaatccaagctgtttatttgttcatacatatctgcagtcagtgagaaaggaggcactaagggtcttcaactgcatcgattgggtgcacaaactcaccctggagataactgactttgatggaagtgtttccaccatcgaccttggcgcgtctagctcccgcttcacaaattgggggtcagtgagcttgagtctggatgccgaaggaatttctggctccaacagcttttcgttcatcgagtcacccggtaaggggtacgctattgtagacgaaccgttctctgagatccctcggcagggatttctcggcgaaataagatgtaatagtgagtccagcgtcctgtctgcccatgagagctgcttaagggcaccaaacctgatttcctataaacccatgatcgatcagcttgaatgtaccactaatttgattgaccctttcgtggtgtttgagcgcggttcactcccccaaacacgaaacgataagacgttcgctgccagtaaaggcaatcgtggggtccaggcatttagcaagggatctgttcaggccgacctgaccctaatgttcgacaactttgaagtggatttcgtaggcgctgcggtgtcctgcgacgccgcatttctgaacctcactgggtgctactcatgtaatgctggagcccgggtctgcctgagtatcacaagcaccggcacaggtactctttccgcccacaacaaggatgggtctttgcatatagtgctgccatcggagaatggaaccaaagaccaatgtcagatcttacacttcacggttcctgaagtggaggaggaatttatgtatagctgcgatggcgacgagagacccctcctggtcaagggtacccttattgctatcgatccattcgacgataggcgcgaagcaggcggggagtcaacagtggttaacccgaaatccggaagttggaactttttcgactggttctctggcctgatgagctggtttgggggacctttgaagactattctcctgatctgtctatacgtggccctgtccataggcctcttctttctgcttatttacttgggtcggaccgggctgtcaaaaatgtggttagcggctacaaagaaggcctcttga

SEQ ID NO: 11184 - RNA, 3480 nt, synthetic construct
  misc_feature 1..3480: note = derived and/or modified CDS sequence (opt3) from RVFV(ZC-3349)__DQ380207.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaataatatcacatgtcacggtaaggaccctgaagataaaatttccttaatcaagggcccaccgcataaaaagcgcgtcgggatagttcgatgcgagcgtagaagggacgctaagcaaatcggacgggaaactatggccggcattgcaatgacggtgctgcccgccctagctgtattcgcactcgcccctgtggtctttgctgaggatccacatctgcgcaacagacccggtaaagggcacaattatatcgacggaatgacccaggaggatgccacatgtaagcctgtgacttacgcgggcgcatgttcttcgttcgacgttcttctggaaaaaggcaagtttccattgttccagtcatatgcccaccataggaccctcctggaggctgtgcacgatacaattatcgccaaagcagatccccctagctgcgacctgcagagtgctcacgggaacccatgcatgaaggaaaagctcgtcatgaaaacccattgtccgaatgactaccaatccgcccactatttaaacaatgatggaaagatggcgtctgtgaaatgtccccctaagtacgagctgactgaagactgcaacttttgccggcagatgacaggtgccagccttaaaaagggctcctatccattgcaggacctgttctgtcagtcaagtgaggatgacgggagcaaactaaagaccaagatgaaaggagtatgcgaggttggcgtgcaagcactcaagaaatgcgatggtcagctgtctacggctcatgaagtcgtgccctttgccgtgttcaaaaattccaagaaggtctaccttgacaagctggatttgaaaactgaggaaaacctcctgcctgactcatttgtttgtttcgagcacaaggggcagtacaaaggaaccatggatagcggccagacaaagcgcgaattaaaaagttttgacatatctcaatgcccaaagattggcgggcacggatccaagaaatgtactggtgatgctgccttctgcagcgcatatgagtgtaccgcccagtacgctaatgcgtattgctcgcatgcaaacggctctgggatcgtgcagattcaagtatccggagtgtggaagaaacccctgtgtgtcggctacgagcgagtggttgtgaagagagaactctcagccaaaccgatccagagggtcgagccttgcacaacctgtatcacgaagtgcgaaccccacggtcttgtggtacggagtactgggtttaagattagctccgctgttgcctgtgcatctggcgtgtgcgtcacaggaagccagtcaccaagtaccgagataactctgaaatatcctggcatctcccagagctctgggggagacattggtgtgcatatggcccacgatgaccaagctgtctcaagtaagatcgtggcccattgtcccccacaggacccctgcttggttcacggctgcatagtgtgtgcacacgggctaattaattaccagtgccatacagcgctgagcgctttcgtagtcgtgttcgtgttttcctctatcgccatcatttgtctcgcaatcctgtatcgtgttcttaaatgcctgaagattgcccctcgcaaagtcttgaacccactcatgtggataaccgctttcatcagatggatttacaagaaaatggtggccagggtagcagataatatcaaccacgtgaaccgggaaatcggatggatggagggcggtcagctggttttagggaatccggctcccattcctcgacatgccccaataccccgctactcgacgtatctgatgctactcctgatcgtcagctacgcgtccgcctgttcagagcttattcaagctagttctagaatcaccacatgcagcactgaaggcgtgaacaccaagtgtaggttgtccggaacagcactgattcgggccggctcagtgggggctgaggcctgcctcatgctgaagggagtcaaagaagaccagactaagtttcttaaaatcaagaccgttagctctgagctgtcctgtcgcgagggtcagagttattggacaggcagcttctctcctaaatgcttgtcctcaagaaggtgccacctcgtgggggaatgtcacgtgaatcgttgcctgagttggcgggataacgagaccagcgcagaattttcgttcgtaggagagtccactacgatgcgagaaaataagtgttttgagcagtgcggcggttgggggtgtggctgcttcaacgtcaatccatcttgtttatttgtgcatacatacctgcaaagcgttagaaaggaggcgctaagggtgttcaactgcatagactgggtccacaaactcaccctggaaatcactgattttgacggatcagtgagtaccattgatcttggcgcctcctctagccgcttcacaaattgggggtccgtttcattgagcctggacgctgagggaatcagtggctctaactcctttagcttcattgaatcgcccggtaaggggtatgccatcgtggatgagccgttctcagaaatacctcggcagggatttctcggcgagattagatgtaattctgagagttccgtactgagcgcacatgaatcttgcttaaaagctccaaacctgatcagctacaagcccatgattgaccagcttgagtgtaccactaatttgatcgatcctttcgtcgtgtttgaaaggggttccctcccccagacacgcaacgacaaaacgttcgccgcatcaaagggcaatcgaggggtgcaagcctttagtaagggaagcgtccaggctgatctgaccctaatgttcgacaactttgaggttgacttcgtgggcgcggccgtatcttgcgatgcagcttttctgaacctcactgggtgctattcctgtaatgccggagcccgggtgtgcctgtcaataacaagtaccggcacaggtagcctttccgctcacaacaaagacgggtctttgcatatcgtcctgccatcggaaaatggaactaaggatcagtgtcaaattttacacttcaccgtgcctgaggttgaggaagagtttatgtacagctgcgacggcgatgaacgtcccctcctggtgaaaggtacgcttatcgcaattgacccattcgatgacagaagggaggccggcggggagtcaaccgtcgtgaacccgaagtccggaagttggaactttttcgattggttctctggcctgatgagctggtttgggggacctttgaaaacaatcctcctgatatgtctatacgttgcgctgtccattggcctcttctttctgcttatctatttgggtcgcactgggctgtcaaagatgtggttagctgccaccaagaaagcatcttga

SEQ ID NO: 11185 - RNA, 3480 nt, synthetic construct
  misc_feature 1..3480: note = derived and/or modified CDS sequence (opt3) from RVFV(Sudan 85-2010)__JQ820488.1__NSm-Gn-Gc
  source 1..3480: mol_type = other RNA
atgatcgagggcgcctgggacagcctgagagaagaggaaatgcccgaggaactctcctgctctgtgtcagggattagggaggtcaagaccagtagccaggagctttaccgggctctgaaagcaataatcgccgcggatggattgaacaatattacatgtcacggtaagaaccctgaagacaaaatctccttaattaagggcccaccgcataaaaagcgcgttgggatcgtgcgatgcgagcgtagaagggatgctaagcaaataggacgggaaactatggccggcatcgcaatgacggtactgcccgccctagctgtgttcgcactcgcccctgtcgtgtttgctgaggacccacatctgcgcaatagacccggtaaagggcacaactatattgatggaatgacccaggaggacgccacatgtaagcctgttacttacgcgggcgcatgcagctcgttcgatgtgcttctggaaaaaggcaagtttccattgttccagtcatatgcccaccataggaccctcctggaggctgtccacgacacaatcattgccaaagcagatccccctagctgtgacctgcagagtgctcacgggaatccatgcatgaaggaaaagctcgtgatgaaaacccattgtccgaacgattaccaatccgcccactatttaaataacgacggaaagatggcgtctgtaaaatgtccccctaagtacgagctgactgaagattgcaatttttgccggcagatgacaggtgccagccttaaaaagggctcctatccattgcaggacctgttctgtcagtcaagtgaggacgatgggagcaaactaaagaccaagatgaaaggagtttgcgaggtgggcgtccaagcactcaagaaatgcgacggtcagctgtctacggctcatgaagtggtgccctttgccgtcttcaagaactccaaaaaggtttaccttgataagctggacttgaaaactgaggaaaatctcctgcctgattcatttgtgtgtttcgagcacaaggggcagtacaaaggaaccatggacagcggccagacaaagcgcgaattaaaaagttttgatatctctcaatgcccaaagataggcgggcacggatccaagaaatgtactggtgacgctgccttctgcagcgcatatgagtgtaccgcccagtacgctaacgcgtattgctcgcatgcaaatggctctgggattgtacagatccaagtgtccggagtctggaagaaacccctgtgtgtgggctacgagcgagttgtggtcaagagagaactctcagccaaaccgattcagagggtggagccttgcacaacctgtatcacgaagtgcgaaccccacggtcttgtagttcggagtactgggtttaagatcagctccgctgtggcctgtgcatctggcgtctgcgtgacaggaagccagtcaccaagtaccgagattactctgaaatatcctggcatatcccagagctctgggggagatatcggtgtccatatggcccacgacgatcaatcagtgagtagcaagattgttgctcattgtcccccacaggacccctgcttggtgcacggctgcatcgtatgtgcccacgggctaataaactaccagtgccatacagcactgtccgcgttcgtcgtggttttcgtgttttcttcgattgctatcatctgtctcgccattctgtatcgtgtccttaaatgcctgaagatcgcacctcgcaaagtgttgaatccactcatgtggattaccgccttcataagatgggtatacaagaaaatggtggctagggttgccgacaacatcaaccaggtcaatcgggaaattggatggatggagggcggtcaactggtgttagggaacccggcacccatccctcgacacgctccaatcccccgctacagcacgtatctgatgctactcctgattgtgtcctacgcctcagcgtgtagtgagcttatacaggcctctagcagaatcaccacatgctccactgaaggcgtcaataccaagtgtaggttgtcaggaacagctctgattcgggcaggcagcgttggggccgaggcttgcctcatgctgaagggagtgaaagaagatcagactaagtttcttaaaatcaagaccgtgtcttccgagctgagttgtcgcgagggtcagagctattggacaggctctttctcccctaaatgcttgtcaagtagaaggtgccatctcgtaggggaatgtcacgtcaaccgttgcctgagctggcgggacaatgagacctcggccgaattttccttcgtgggagagtctactacgatgcgagaaaacaagtgttttgagcaatgcggcggttgggggtgtggctgcttcaatgttaacccaagctgtttatttgtgcacacatacctgcagtcagtcagaaaggaggcactaagggtgttcaattgcattgattgggttcataaactcaccctggaaatcactgactttgatggaagtgtgtccaccatagaccttggcgcgtctagctcccgcttcacaaactgggggtcagtatctttgagtctggatgccgagggaatctctggctccaatagcttttcgttcattgaatcacccggtaaggggtatgctatcgtcgacgagccgttctctgaaattcctcggcagggatttctcggcgagatcagatgtaacagtgagtccagcgtgctgtctgcccacgaaagctgcttaagggcaccaaatctgatatcctacaaacccatgattgatcagcttgagtgtaccactaacttgatcgaccctttcgtggtctttgaacgcggttcactcccccaaacacgaaatgagaagacgttcgctgccagtaaaggcaaccgtggggttcaggcatttagcaagggatctgtgcaggccgatctgaccctaatgttcgacaactttgaagtagatttcgtgggcgctgcggtctcctgcgacgccgcatttctgaatctcactgggtgctattcatgtaacgctggagcccgggtgtgcctgagtattacaagcaccggcacaggtactctttccgcccataataaggacgggtctttgcacatcgttctgccatcggagaacggaaccaaagatcaatgtcagatattacatttcacggtgcctgaggtcgaagaggaatttatgtacagctgcgacggcgatgagagacccctcctggtgaagggtacccttatcgctattgacccattcgatgacaggcgcgaggcaggcggggaatcaacagttgtgaatccgaaatccggaagttggaactttttcgattggttctctggcctgatgagctggtttgggggacctttgaagactatcctcctgatttgtctatacgtcgccctgtccatcggcctcttctttctgcttatatatttgggtcggaccgggctgtcaaaaatgtggttagcggctacaaagaaggcctcttga

SEQ ID NO: 11186 - RNA, 3480 nt, synthetic construct
  misc_feature 1..3480: note = derived and/or modified CDS sequence (opt3) from RVFV(2007000324)__JF326195.1__NSm-Gn-Gc
  source 1..3480: mol_type = other RNA
atgatcgagggcgcctgggacagcctgagagaagaggaaatgcccgaggaactctcctgctctgtgtcagggattagggaggtcaagaccagtagccaggagctttaccgggctctgaaagcaataatcgccgcggatggattgaacaatattacatgtcacggtaagaaccctgaagacaaaatctccttaattaagggcccaccgcataaaaagcgcgttgggatcgtgcgatgcgagcgtagaagggatgctaagcaaataggacgggaaactatggccggcatcgcaatgacggtactgcccgccctagctgtgttcgcactcgcccctgtcgtgtttgctgaggacccacatctgcgcaatagacccggtaaagggcacaactatattgatggaatgacccaggaggacgccacatgtaagcctgttacttacgcgggcgcatgttcttcgttcgatgtgcttctggaaaaaggcaagtttccattgttccagtcatatgcccaccataggaccctcctggaggctgtccacgacacaatcattgccaaagcagatccccctagctgcgacctgcagagtgctcacgggaatccatgcatgaaggaaaagctcgtgatgaaaacccattgtccgaacgattaccaatccgcccactatttaaataacgacggaaagatggcgtctgtaaaatgtccccctaagtacgagctgactgaagattgcaatttttgccggcagatgacaggtgccagccttaaaaagggctcctatccattgcaggacctgttctgtcagtcaagtgaggacgatgggagcaaactaaagaccaagatgaaaggagtttgcgaggtgggcgtccaagcactcaagaaatgcgacggtcagctgtctacggctcatgaagtggtgccctttgccgtcttcaagaactccaaaaaggtttaccttgataagctggacttgaaaactgaggaaaatctcctgcctgattcatttgtgtgtttcgagcacaaggggcagtacaaaggaaccatggacagcggccagacaaagcgcgaattaaaaagttttgatatctctcaatgcccaaagataggcgggcacggatccaagaaatgtactggtgacgctgccttctgcagcgcatatgagtgtaccgcccagtacgctaacgcgtattgctcgcatgcaaatggctctgggattgtacagatccaagtgtccggagtctggaagaaacccctgtgtgtgggctacgagcgagttgtggtcaagagagaactctcagccaaaccgattcagagggtggagccttgcacaacctgtatcacgaagtgcgaaccccacggtcttgtagttcggagtactgggtttaagatcagctccgctgtggcctgtgcatctggcgtctgcgtgacaggaagccagtcaccaagtaccgagattactctgaaatatcctggcatatcccagagctctgggggagatatcggtgtccatatggcccacgacgatcaatcagtgagtagcaagattgttgctcattgtcccccacaggacccctgcttggtgcacggctgcatcgtatgtgcccacgggctaataaactaccagtgccatacagcactgtccgcgttcgtcgtgattttcgtgttttcttcgaccgctatcatctgtctcgccgttctgtatcgtgtccttaaatgcctgaagattgcacctcgcaaagtgttgaatccactcatgtggatcacggccttcattagatgggtatacaagaaaatggtggctagggttgccgacaacataaaccaggtcaatcgggaaatcggatggatggagggcggtcaactggcattagggaacccggctcccattcctcgacacgccccaatcccccgctacagcacctatctgatgctactcctgatcgtgtcctacgcgtcagcctgtagtgagcttattcaggcttctagcagaataacaacttgctccaccgaaggcgtgaatacaaagtgtaggttgtcaggaactgcactgatccgggccggcagcgtcggggctgaggcctgcctcatgctgaagggagttaaagaagatcagaccaagtttcttaaaattaagacagtgtcttccgagctgagttgtcgcgagggtcagagctattggaccggctctttctcccctaaatgcttgtcaagtagaaggtgccatctcgtgggggaatgtcacgtaaaccgttgcctgagctggcgggacaatgagacttcggcagaattttccttcgtcggagagtctacgacaatgcgagaaaacaagtgttttgagcaatgcggcggttgggggtgtggctgcttcaatgtgaacccaagctgtttatttgttcacacctacctgcagtcagtgagaaaggaggcgctaagggtcttcaattgcatcgattgggtgcataaactcactctggaaattaccgactttgatggaagtgtttccacaatcgaccttggcgcctctagctcccgcttcaccaactgggggtcagtgagcttgagtctggatgctgagggaatatctggctccaatagcttttcgttcatcgaatcacccggtaaggggtatgccattgtagacgagccgttctctgaaatccctcggcagggatttctcggcgagattagatgtaacagtgagtccagcgtcctgtctgcacacgaaagctgcttaagggctccaaatctggtgtcctacaaacccatgatcgatcagcttgagtgtactacaaacttgatagaccctttcgtggtctttgaacgcggttcactcccccaaacgcgaaatgataagaccttcgccgcaagtaaaggcaaccgtggggttcaggcctttagcaagggatctgtgcaggctgacctgactctaatgttcgataactttgaggtagacttcgtgggcgcggccgtctcctgcgacgcagcttttctgaatctcacagggtgctattcatgtaacgccggagcccgggtgtgcctgagtattaccagcacaggcactggtaccctttccgctcataataaggatgggtctttgcacatcgttctgccatcggaaaacggaacgaaagaccaatgtcagattttacatttcaccgtgcctgaggtcgaggaagagtttatgtacagctgcgatggcgacgaaagacccctcctggtgaagggtacacttatcgcaatagatccattcgacgataggcgcgaggccggcggggagtcaactgttgtgaatccgaaatccggaagttggaactttttcgactggttctctggcctgatgagctggtttgggggacctttgaagaccatcctcctgatttgtctatacgtcgcgctgtccatcggcctcttctttctgcttatttatttgggtcggacagggctgtcaaaaatgtggttagctgccactaagaaggcatcttga

SEQ ID NO: 11187 - RNA, 3480 nt, synthetic construct
  misc_feature 1..3480: note = derived and/or modified CDS sequence (opt3) from RVFV(OS-8)__DQ380185.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaataatatcacatgtcacggtaaggaccctgaagataaaatttccttaatcaagggcccaccgcataaaaagcgcgtcgggatagttcgatgcgagcgtagaagggacgctaagcaaatcggacgggaaactatggccggcattgcaatgacggtgctgcccgccctagctgtattcgcactcgcccctgtggtctttgctgaggatccacatctgcgcaacagacccggtaaagggcacaattatatcgacggaatgacccaggaggatgccacatgtaagcctgtgacttacgcgggcgcatgttcttcgttcgacgttcttctggaaaaaggcaagtttccattgttccagtcatatgcccaccataggaccctcctggaggctgtgcacgatacaattatcgccaaagcagatccccctagctgcgacctgcagagtgctcacgggaacccatgcatgaaggaaaagctcgtcatgaaaacccattgtccgaatgactaccaatccgcccactatttaaacaatgatggaaagatggcgtctgtgaaatgtccccctaagtacgagctgactgaagactgcaacttttgccggcagatgacaggtgccagccttaaaaagggctcctatccattgcaggacctgttctgtcagtcaagtgaggatgacgggagcaaactaaagaccaagatgaaaggagtatgcgaggttggcgtgcaagcactcaagaaatgcgatggtcagctgtctacggctcatgaagtcgtgccctttgccgtgttcaagaatagcaaaaaggtctaccttgacaagctggatttgaaaactgaggaaaacctcctgcctgactcatttgtttgtttcgagcacaaggggcagtacaaaggaaccatggatagcggccagacaaagcgcgaattaaaaagttttgacatatctcaatgcccaaagattggcgggcacggatccaagaaatgtactggtgatgctgccttctgcagcgcatatgagtgtaccgcccagtacgctaatgcgtattgctcgcatgcaaacggctctggggtggtacagatccaagtgtccggagtctggaagaaacccctgtgtgtgggctacgagcgagttgtggtcaagagagaactctcagccaaaccgattcagagggtggagccttgcacaacctgtatcacgaagtgcgaaccccacggtcttgtagttcggagtactgggtttaagatcagctccgctgtggcctgtgcatctggcgtctgcgtgacaggaagccagtcaccaagtaccgagattactctgaaatatcctggcatatcccagagctctgggggagacatcggtgtccatatggcccacgatgaccaatcagtgagtagcaagattgttgctcattgtcccccacaggacccctgcttggtgcacggctgcatcgtatgtgcccacgggctaataaattaccagtgccatacagcactgtccgcgttcgtcgtggttttcgtgttttcttcggtcgctattatctgtctcgccatcctgtataaagtgcttaagtgcctgaaaattgcacctcgtaaggtattgaacccactcatgtggatcaccgccttcattcgctgggtgtacaaaaagatggttgctagagtcgccgataatataaaccaggtgaacagggaaatcggatggatggagggcggtcaactggcattagggaatccggctcccattcctcggcacgccccaatcccccgatacagcacgtatctgatgctactcctgatcgtgtcctacgcgtcagcctgtagtgagcttattcaggcttctagccgcataaccacatgctccactgaaggcgtcaacaccaagtgtagattgtcaggaacagcactgatcagggccggcagcgttggggctgaggcctgcctcatgctgaaaggagtgaaggaagaccagactaaatttcttcggattaagaccgtgtcttccgagctgagttgtcgcgagggtcagagctattggacaggctctttctcccctaaatgcttgtcaagtagaaggtgccatctcgtaggggaatgtcacgtcaatcgttgcctgagctggcgggataacgagacctcggcagaattttccttcgtgggagagtctactacgatgcgagaaaataagtgttttgagcaatgcggcggttgggggtgtggctgcttcaacgttaatccaagctgtttatttgtgcacacatacctgcagtcagtcagaaaggaggcgctaagggtgttcaactgcatcgactgggttcataaactcaccctggaaattactgattttgacggaagtgtgtccaccatcgatcttggcgcctctagctcccgcttcacaaattgggggtcagtatccttgagtctggacgctgagggaatatctggctccaacagcttttcgttcatcgaatcacccggtaaggggtatgccattgtcgatgagccgttctctgaaatccctcggcagggatttctcggcgagattagatgtaatagtgagtccagcgtgctgtctgcacacgaaagctgcttaagggctccaaacctgatctcctacaaacccatgatagaccagcttgagtgtaccactaatttgattgatcctttcgtggtctttgaacgcggttcactcccccaaacacgaaacgacaagacgttcgccgcaagtaaaggcaatcgtggggttcaggcctttagcaagggatctgtgcaggctgatctgaccctaatgttcgacaactttgaggtagacttcgtgggcgcggccgtctcctgcgatgcagcttttctgaacctctcagggtgctatagttgtaatgccggagcccgggtgtgcctgagcatcacttccacaggcaccggtacactttctgctcataacaaggacgggtcgttgcacattgttctgccaagcgaaaatggaactaaagatcaatgtcagatcttacatttcaccgtgcctgaggtcgaggaagagtttatgtactcatgcgacggcgatgaaagacccctcctggtgaagggtacgcttatagcaatcgacccattcgatgacaggcgcgaggccggcggggagtccaccgttgtgaacccgaaaagtggatcttggaactttttcgattggttcagcggcctgatgtcctggtttgggggacctttgaagacaattctcctgatctgtctatacgtcgcgctgtcaattggcctcttctttctgcttatctatttgggtcggactgggctgtctaaaatgtggttagctgccaccaagaaggcaagctga

SEQ ID NO: 11188 - RNA, 3480 nt, synthetic construct
  misc_feature 1..3480: note = derived and/or modified CDS sequence (opt3) from RVFV(ZINGA J83 R1)__KU978776.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaataatatcacatgtcacggtaaggaccctgaagataaaatttccttaatcaagggcccaccgcataaaaagcgcgtcgggatagttcgatgcgagcgtagaagggacgctaagcaaatcggacgggaaactatggccggcattgcaatgacggtgctgcccgccctagctgtattcgcactcgcccctgtggtctttgctgaggatccacatctgcgcaacagacccggtaaagggcacaattatatcgacggaatgacccaggaggatgccacatgtaagcctgtgacttacgcgggcgcatgttcttcgttcgacgttcttctggaaaaaggcaagtttccattgttccagtcatatgcccaccataggaccctcctggaggctgtgcacgatacaattatcgccaaagcagatccccctagctgcgacctgcagagtgctcacgggaacccatgcatgaaggaaaagctcgtcatgaaaacccattgtccgaatgactaccaatccgcccactatttaaacaatgatggaaagatggcgtctgtgaaatgtccccctaagtacgagctgactgaagactgcaacttttgccggcttatgacaggtgccagcttgaaaaagggctcctatccactgcaggacctattctgtcagtcaagtgaggatgacgggagcaaactcaagaccaagatgaaaggagtatgcgaggttggcgtgcaggcactgaagaaatgcgatggtcaactttctacggctcatgaagtcgtgccctttgccgtgttcaaaaattccaaaaaggtctacctggacaagttggatctcaaaactgaggaaaacctgttacctgactcatttgtttgtttcgagcacaaggggcagtacaaaggaaccatggatagcggccagacaaagcgcgaactgaaaagttttgacatatctcagtgcccaaagattggcgggcacggatccaagaaatgtactggtgatgctgccttctgcagcgcatatgagtgtaccgcccaatacgctaatgcgtattgctcgcatgcaaacggctctgggatcgtgcagattcaggtatccggagtgtggaagaaacccctctgtgtcggctacgagcgagtggttgtgaagagagaactttcagccaaaccgatccaaagggtcgagccttgcacaacctgtatcacgaagtgcgaaccccacggtctggtggtacggagtactgggtttaagattagctccgctgttgcctgtgcatctggcgtgtgcgtcacaggaagccagtcaccaagtaccgagataactttgaaatatcctggcatctcccagagctctgggggagacattggtgtgcatatggcccacgatgaccagtcagtcagtagcaagatcgtggctcattgtcccccacaagacccctgcctagttcacggctgcatagtgtgtgcccacgggctgattaattaccagtgccatacagcactctccgcgttcgtagtcgtgttcgtgttttcttcgatcgctatcatttgtctggccatcctttatcgtgttctgaaatgcttgaagattgcacctcgcaaagtcctcaacccactgatgtggataaccgccttcatcagatgggtgtacaggaagatggtagctcgggtggccgataatattaaccaggttaaccgagaaatcggatggatggagggcggtcagttagtcctggggaatccggcacccatccctcgccacgtgccaattcccagatacagcacgtatctaatgctcctgcttatagtgtcctacgcttcagcctgtagtgagttgatccaagcgtctagcaggattaccacatgctccactgaaggcgtcaacaccaaatgtcggctgtcaggaacagccctcatccgcgctggcagcgttggggcagaggcctgcctgatgcttaagggagtgaaggaagaccagactaaatttctgaagattaaaaccgtgtcttccgagttgagttgtagagagggtcagagctattggacaggctctttctcccctaagtgcctctcaagtaggcgttgccatctggtaggggaatgtcacgtcaatcggtgcttaagctggcgagataacgagacctcggctgaattttccttcgtgggagagtctactacgatgagagaaaataaatgttttgagcagtgcggcggttgggggtgtggctgcttcaacgttaatccaagctgtctgtttgtgcacacatacctacaatcagtcaggaaggaggccctccgcgtgttcaactgcatcgactgggttcataagctgacccttgaaataactgattttgacggaagtgtgtccaccatcgatttgggcgcatctagctcccggttcacaaattgggggtcagtaagcctgagtctcgacgcggagggaatttctggctccaacagcttttcgttcatcgaatcacccggtaaagggtatgccattgtcgatgagccgttctctgaaatccctagacagggatttctgggcgagataaggtgtaatagtgagtccagcgtgttatctgctcacgaaagctgcctgcgcgccccaaaccttatttcctacaagcccatgatcgaccagttggagtgtaccactaatctcattgatcctttcgtggtctttgaacgaggttcactgccccagacacggaacgacaaaacgttcgcagctagtaagggcaatcgtggggttcaagcctttagcaaaggatctgtgcaggcagatctaaccctgatgttcgacaactttgaggtagacttcgtgggcgccgctgtctcctgcgatgcggcctttctcaacctgactgggtgctattcatgtaatgcaggagctagagtgtgccttagtatcacaagcaccggcacaggtactttgtccgcccataacaaggacgggtctctgcacatagttttaccatcggaaaatggaaccaaggatcagtgtcaaatcctccatttcacggtgcctgaggtcgaggaagagtttatgtacagctgcgacggcgatgaaaggcccctgcttgtgcgcggtaccctgattgccatcgacccattcgatgaccggagagaggctggcggggagtcaacagttgtgaacccgaaatccggaagttggaactttttcgattggttctctggcttgatgagctggtttgggggacctctcaagactattctgctaatctgtctgtacgtcgcactctccataggcctgttctttcttttgatttatctgggtaggaccgggttatcaaaaatgtggctcgccgcgacaaagaaggcttcttga

SEQ ID NO: 11189 - RNA, 3480 nt, synthetic construct
  misc_feature 1..3480: note = derived and/or modified CDS sequence (opt3) from RVFV(2007000253)__JF326192.1__NSm-Gn-Gc
  source 1..3480: mol_type = other RNA
atgatcgagggcgcctgggacagcctgagagaagaggaaatgcccgaggaactctcctgctctgtgtcagggattagggaggtcaagaccagtagccaggagctttaccgggctctgaaagcaataatcgccgcggatggattgaacaatattacatgtcacggtaagaaccctgaagacaaaatctccttaattaagggcccaccgcataaaaagcgcgttgggatcgtgcgatgcgagcgtagaagggatgctaagcaaataggacgggaaactatggccggcatcgcaatgacggtactgcccgccctagctgtgttcgcactcgcccctgtcgtgtttgctgaggacccacatctgcgcaatagacccggtaaagggcacaactatattgatggaatgacccaggaggacgccacatgtaagcctgttacttacgcgggcgcatgttcttcgttcgatgtgcttctggaaaaaggcaagtttccattgttccagtcatatgcccaccataggaccctcctggaggctgtccacgacacaatcattgccaaagcagatccccctagctgcgacctgcagagtgctcacgggaatccatgcatgaaggaaaagctcgtgatgaaaacccattgtccgaacgattaccaatccgcccactatttaaataacgacggaaagatggcgtctgtaaaatgtccccctaagtacgagctgactgaagattgcaatttttgccggcagatgacaggtgccagccttaaaaagggctcctatccattgcaggacctgttctgtcagtcaagtgaggacgatgggagcaaactaaagaccaagatgaaaggagtttgcgaggtgggcgtccaagcactcaagaaatgcgacggtcagctgtctacggctcatgaagtggtgccctttgccgtcttcaagaactccaaaaaggtttaccttgataagctggacttgaaaactgaggaaaatctcctgcctgattcatttgtgtgtttcgagcacaaggggcagtacaaaggaaccatggacagcggccagacaaagcgcgaattaaaaagttttgatatctctcaatgcccaaagataggcgggcacggatccaagaaatgtactggtgacgctgccttctgcagcgcatatgagtgtaccgcccagtacgctaacgcgtattgctcgcatgcaaatggctctgggattgtacagatccaagtgtccggagtctggaagaaacccctgtgtgtgggctacgagcgagttgtggtcaagagagaactctcagccaaaccgattcagagggtggagccttgcacaacctgtatcacgaagtgcgaaccccacggtcttgtagttcggagtactgggtttaagatcagctccgctgtggcctgtgcatctggcgtctgcgtgacaggaagccagtcaccaagtaccgagattactctgaaatatcctggcatatcccagagctctgggggagatatcggtgtccatatggcccacgacgatcaatcagtgagtagcaagattgttgctcattgtcccccacaggacccctgcttggtgcacggctgcatcgtatgtgcccacgggctaataaactaccagtgccatacagcactgtccgcgttcgtcgtgattttcgtgttttcttcgaccgctatcatctgtctcgccgttctgtatcgtgtccttaaatgcctgaagattgcacctcgcaaagtgttgaatccactcatgtggatcacggccttcattagatgggtatacaagaaaatggtggctagggttgccgacaacataaaccaggtcaatcgggaaatcggatggatggagggcggtcaactggcattagggaacccggctcccattcctcgacacgccccaatcccccgctacagcacctatctgatgctactcctgatcgtgtcctacgcgtcagcctgtagtgagcttattcaggcttctagcagaataacaacttgctccaccgaaggcgtgaatacaaagtgtaggttgtcaggaactgcactgatccgggccggcagcgctggggccgaggcatgcctcatgctgaagggagtcaaagaagatcagaccaagtttcttaaaattaagacagtttcttccgagctgagttgtcgcgagggtcagagctattggaccggctctttctcccctaaatgcttgtcaagtagaaggtgccatctcgtgggggaatgtcacgtgaaccgttgcctgagctggcgggacaatgagacttcggcggaattttccttcgtaggagagtctacgacaatgcgagaaaacaagtgttttgagcaatgcggcggttgggggtgtggctgcttcaatgtcaacccaagctgtttatttgtgcacacctacctgcagtcagttagaaaggaggccctaagggtgttcaattgcatcgattgggtccataaactcactctggaaattaccgactttgatggaagtgtgtccacaatcgaccttggcgcttctagctcccgcttcaccaactgggggtcagttagcttgagtctggatgccgagggaatatctggctccaatagcttttcgttcatcgaatcacccggtaaggggtatgcaattgtggacgagccgttctctgaaatccctcggcagggatttctcggcgagattagatgtaacagtgagtccagcgtactgtctgctcacgaaagctgcttaagggccccaaatctggtctcctacaaacccatgatcgatcagcttgagtgtactacaaacttgatagaccctttcgtggtgtttgaacgcggttcactcccccaaacgcgaaatgataagaccttcgcagccagtaaaggcaaccgtggggtccaggcttttagcaagggatctgttcaggcggacctgactctaatgttcgataactttgaggtggacttcgtaggcgccgcagtgtcctgcgacgctgcctttctgaatctcacagggtgctattcatgtaacgccggagctcgggtctgcctgagtattaccagcacaggcactggtaccctttccgcacataataaggatgggtctttgcacatcgtgctgccatcggaaaacggaacgaaagaccaatgtcagattttacatttcaccgttcctgaggtggaggaagagtttatgtacagctgcgatggcgacgaaagacccctcctggtcaagggtacacttatcgccatagatccattcgacgataggcgcgaggcgggcggggagtcaactgtggttaatccgaaatccggaagttggaactttttcgactggttctctggcctgatgagctggtttgggggacctttgaagaccatcctcctgatttgtctatacgtggctctgtccatcggcctcttctttctgcttatttatttgggtcggacagggctgtcaaaaatgtggttagccgcaactaagaaggcctcttga

SEQ ID NO: 11190 - RNA, 3480 nt, synthetic construct
  misc_feature 1..3480: note = derived and/or modified CDS sequence (opt3) from RVFV(MP12)__Z30318.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaataatatcacatgtcacggtaaggaccctgaagataaaatttccttaatcaagggcccaccgcataaaaagcgcgtcgggatagttcgatgcgagcgtagaagggacgctaagcaaatcggacggaaaactatggccggcattgcaatgacggtgctgcccgccctagctgtattcgcactcgcccctgtggtctttgctgaagatccacatctgcgcaacagacccggtaaggggcacaattatatcgacggaatgacccaggaggatgccacatgtaaacctgtgacttacgcgggcgcatgttcttcgttcgacgttcttctggagaagggcaaatttccattgttccagtcatatgcccaccataggaccctcctggaagctgtgcacgatacaattatcgccaaggcagatccccctagctgcgacctgctcagtgctcacgggaacccatgcatgaaggagaaattagtcatgaagacccattgtccgaatgactaccagtccgcccaccatctgaacaatgatggaaaaatggcgtctgtgaagtgtccccctaaatatgaacttactgaggactgcaacttttgccggcaaatgacaggtgccagcttgaagaaaggctcctacccactgcaggacctattctgtcagtcaagtgaagatgacgggagcaagctcaagaccaaaatgaagggagtatgcgaggttggcgtgcaggcactgaaaaagtgcgatggtcaactttctacggctcacgaggtcgtgccctttgccgtgttcaaaaattccaagaaggtctatctggacaaattggatctcaagactgaagagaacctgttacctgactcatttgtttgtttcgaacacaaagggcagtacaagggaaccatggatagcggccagacaaaacgcgagctgaagagttttgacatatctcagtgcccaaagattggcgggcatggatccaaaaagtgtactggtgatgctgccttctgcagcgcatacgaatgtaccgcccaatatgctaatgcgtactgctcgcacgcaaacggctctgggatcgtgcagattcaggtatccggagtgtggaaaaagcccctctgtgtcggctatgagcgagtggttgtgaaaagagagctttcagccaagccgatccaaagggtcgaaccttgcacaacctgtatcacgaagtgcgagccccatggtctggtggtacggagtactgggtttaaaattagctccgctgttgcctgtgcatctggcgtgtgcgtcacaggaagccagtcaccaagtaccgaaataactttgaagtaccctggcatctcccagagctctgggggagacattggtgtgcacatggcccatgatgaccagtcagtcagtagcaaaatcgtggctcactgtcccccacaagacccctgcctagttcacgattgcatagtgtgtgcccatggcctgattaattatcagtgccacacagcactctccgcgttcgtagtcgtgttcgtgttttcttcgatcgctatcatttgtctggccatcctttaccgtgttctgaagtgcttgaaaattgcacctcgcaaggtcctcaacccactgatgtggataaccgccttcatcagatggatttataaaaagatggtggctagggtagcccataatatcaaccaggtgaaccgggagatcgggtggatggaaggaggccagttagttctgggtaatccggcacccattcctcgacacgctccaataccccgctacagcacgtacctaatgctcctgcttatcgtctcctatgcctcagcgtgtagtgagttgattcaagcctctagcagaatcaccacatgctccactgagggggtgaacaccaagtgtaggctgtcaggcacagctctcattcgggcaggaagcgtgggcgccgaagcatgcctgatgcttaaaggggtcaaggaggaccagactaaatttctgaagttgaaaaccgtttcttccgaactcagttgtcgcgagggacagagctactggacaggttctttctcccctaagtgcctgtcaagtagaaggtgccacttagtgggcgagtgtcatgtgaatcgttgcctgagctggcgggataacgaaacctcggccgagttttccttcgtaggggaatctactacgatgcgagagaataagtgttttgaacagtgcggaggctggggttgtgggtgcttcaacgtcaatccaagctgtctatttgtgcacacatatctccaatcagttagaaaagaggcactgagggtgttcaactgcatcgactgggtccataaacttaccttggagataactgattttgacggcagtgtgtccaccatcgatctgggagcgtctagctcccgcttcacaaattggggctcagttagcctcagtctggacgccgaagggatttctggatccaacagcttttcgttcatcgagtcacccggcaagggttacgctattgtggatgaaccgttctctgagatccctcggcaggggtttttaggagaaataagatgtaatagtgagtccagcgtactgtctgcccacgagagctgccttagggcaccaaacttgatttcctataagcccatgatcgaccagctcgaatgtaccactaatctgattgatcctttcgtcgtgtttgagcgcggctcactaccccagacacgaaacgacaaaacgttcgctgccagtaagggtaatcggggcgtgcaagcatttagcaaggggtctgtccaggccgatctgaccctcatgttcgacaactttgaagttgacttcgtgggagctgcggtatcctgcgatgccgcatttctgaaccttactggctgctactcatgtaatgctggggcccgtgtgtgcttgagtatcacaagcaccggaacaggctccctgtctgcccataacaaagacggttcgttacacatagtcctcccaagcgagaatgggactaaggatcagtgtcaaatcctgcacttcaccgtgcctgaagttgaggaggaatttatgtattcatgcgacggagatgagagaccccttctggtgaaaggcacgttgattgctatcgacccattcgatgacaggcgcgaagctggtggcgagtccaccgtcgtgaacccgaagagtgggtcttggaactttttcgattggttcagcggactcatgtcctggtttggcgggcctctgaaaacaattctactgatctgtctctacgttgccctgtcaataggacttttctttttgctgatttacttaggcggtactgggctctctaagatgtggctggcggctaccaagaaagccagctga

SEQ ID NO: 11191 - RNA, 3480 nt, synthetic construct
  misc_feature 1..3480: note = derived and/or modified CDS sequence (opt3) from RVFV(BIME-01)__KX609032.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaataatatcacatgtcacggtaaggaccctgaagataaaatttccttaatcaagggcccaccgcataaaaagcgcgtcgggatagttcgatgcgagcgtagaagggacgctaagcaaatcggacgggaaactatggccggcattgcaatgacggtgctgcccgccctagctgtattcgcactcgcccctgtggtctttgctgaggatccacatctgcgcaacagacccggtaaagggcacaattatatcgacggaatgacccaggaggatgccacatgtaagcctgtgacttacgcgggcgcatgttcttcgttcgacgttcttctggaaaaaggcaagtttccattgttccagtcatatgcccaccataggaccctcctggaggctgtgcacgatacaattatcgccaaagcagatccccctagctgcgacctgcagagtgctcacgggaacccatgcatgaaggaaaagctcgtcatgaaaacccattgtccgaatgactaccaatccgcccactatttaaacaatgatggaaagatggcgtctgtgaaatgtccccctaagtacgagctgactgaagactgcaacttttgccggcagatgacaggtgccagccttaaaaagggctcctatccattgcaggacctgttctgtcagtcaagtgaggatgacgggagcaaactaaagaccaagatgaaaggagtatgcgaggttggcgtgcaagcactcaagaaatgcgatggtcagctgtctacggctcatgaagtcgtgccctttgccgtgttcaaaaattccaagaaggtctaccttgacaagctggatttgaaaactgaggaaaacctcctgcctgactcatttgtttgtttcgagcacaaggggcagtacaaaggaaccatggatagcggccagacaaagcgcgaattaaaaagttttgacatatctcaatgcccaaagattggcgggcacggatccaagaaatgtactggtgatgctgccttctgcagcgcatatgagtgtaccgcccagtacgctaatgcgtattgctcgcatgcaaacggctctgggatcgtgcagattcaagtatccggagtgtggaagaaacccctgtgtgtcggctacgagcgagtggttgtgaagagagaactctcagccaaaccgatccagagggtcgagccttgcacaacctgtatcacgaagtgcgaaccccacggtcttgtggtacggagtactgggtttaagattagctccgctgttgcctgtgcatctggcgtgtgcgtcacaggaagccagtcaccaagtaccgagataactctgaaatatcctggcatctcccagagctctgggggagacattggtgtgcatatggcccacgatgaccaatcagtcagtagcaagatcgtggctcattgtcccccacaggacccctgcttggttcacggctgcatagtgtgtgcccacgggctaattaattaccagtgccatacagcactgtccgcgttcgtagtcgtgttcgtgttttcttcggttgctatcatctgtctcgccattctgtataaagtccttcgttgcctgaagatcgcacctaaaaaggtgttgaacccactcatgtggattaccgccttcatacgctgggtatacaaaaagatggtggctagagttgccgataatatcaaccaggtcaacagggaaattggatggatggagggcggtcaactggcattagggaatccggctcccatccctcggcacgccccaatcccccgatacagcacgtatctgatgctactcctgattatatcctacgcgtcagcctgtagtgagcttatccaggcttctagccgcattaccacatgctccactgaaggcgtgaacaccaagtgtagattgtcaggaacagcactgatcagggccggcagcgtgggggctgaggcctgcctcatgctgaaaggagtcaaggaagaccagactaaatttcttaagattaaaaccgtttcttccgagctgagttgtcgggagggtcagagctattggacaggctctttctcccctaagtgcttgtcaagtcgcagatgccatctcgtgggggaatgtcacgtgaataggtgcctgagctggcgtgataacgagacctcggcagaattttccttcgtaggagagtctactacgatgcgggaaaataagtgttttgagcaatgcggcggttgggggtgtggctgcttcaacgtcaatccaagctgtttatttgtgcacacatacctgcagtcagttcgaaaagaggcgctaagagtgttcaactgcatcgactgggtccataagctcaccctggaaataactgattttgacggaagtgtgtccaccatcgatcttggcgcctctagctccaggttcacaaattgggggtcagttagcttgagtctggacgctgagggaatttctggctccaacagcttttcgttcatcgaatcacccggtaaagggtatgccattgtggatgagccgttctctgaaatccctcgccagggatttctcggcgagatacggtgtaatagtgagtccagcgtactgtctgcacacgaaagctgcttaagagctccaaacctgatttcctacaagcccatgatcgaccagcttgagtgtaccactaatttgattgatcctttcgtcgtgtttgaaaggggttcactcccccaaacacgcaacgacaaaacgttcgccgcaagtaagggcaatcgaggggtgcaggcctttagcaagggatctgtccaggctgatctgaccctaatgttcgacaactttgaggttgacttcgtgggcgcggccgtatcctgcgatgcagcttttctgaacctcactgggtgctattcatgtaatgccggagcccgggtgtgcctgagtatcacaagcaccggcacaggtactctttccgctcataacaaagacgggtctttgcacatagtcctgccatcggaaaatggaaccaaggatcaatgtcagatcttacatttcacggtgcctgaggttgaggaagagtttatgtacagctgcgacggcgatgaacgtcccctcctggtgaaaggtacccttattgcaatcgacccattcgatgacagaagggaggccggcggggagtcaacagtcgtgaacccgaagtccggaagttggaactttttcgattggttctctggcctgatgagctggtttgggggacctttgaaaactattctcctgatctgtctatacgttgcgctgtccataggcctcttctttctgcttatttatttgggtcgcaccgggctgtcaaagatgtggttagctgccacaaagaaagcatcttga

SEQ ID NO: 11192 - RNA, 3480 nt, synthetic construct
  misc_feature 1..3480: note = derived and/or modified CDS sequence (opt3) from RVFV(200803166)__JF311381.1__NSm-Gn-Gc
  source 1..3480: mol_type = other RNA
atgatcgagggcgcctgggacagcctgagagaagaggaaatgcccgaggaactctcctgctctgtgtcagggattagggaggtcaagaccagtagccaggagctttaccgggctctgaaagcaataatcgccgcggatggattgaacaatattacatgtcacggtaagaaccctgaagacaaaatctccttaattaagggcccaccgcataaaaagcgcgttgggatcgtgcgatgcgagcgtagaagggatgctaagcaaataggacgggaaactatggccggcatcgcaatgacggtactgcccgccctagctgtgttcgcactcgcccctgtcgtgtttgctgaggacccacatctgcgcaatagacccggtaaagggcacaactatattgatggaatgacccaggaggacgccacatgtaagcctgttacttacgcgggcgcatgttcttcgttcgatgtgcttctgaaaaagggcaaatttccattgttccagtcatatgcccaccataggaccctcctggaagctgtccacgacacaatcattgccaaggcagatccccctagctgcgacctgcagagtgctcacgggaatccatgcatgaaggagaaactcgtgatgaagacccattgtccgaacgattaccaatccgcccactatttaaataacgacggaaaaatggcgtctgtaaagtgtccccctaaatacgaactgactgaggattgcaatttttgccggcagatgacaggtgccagccttaagaaaggctcctatccattgcaggacctgttctgtcagtcaagtgaagacgatgggagcaagctaaagaccaaaatgaagggagtttgcgaggtgggcgtccaagcactcaaaaagtgcgacggtcagctgtctacggctcatgaggtggtgccctttgccgtcttcaaaaactccaagaaggtttaccttgataaactggacttgaagactgaagagaatctcctgcctgattcatttgtgtgtttcgaacacaaagggcagtacaagggaaccatggacagcggccagacaaaacgcgagttaaagagttttgatatctctcaatgcccaaagataggcgggcacggatccaaaaagtgtactggtgacgctgccttctgcagcgcatatgaatgtaccgcccagtacgctaacgcgtattgctcgcatgcaaatggctctgggattgtacagatccaagtgtccggagtctggaaaaagcccctgtgtgtgggctacgagcgagttgtggtcaaaagagagctctcagccaagccgattcagagggtggaaccttgcacaacctgtatcacgaagtgcgagccccacggtcttgtagttcggagtactgggtttaaaatcagctccgctgtggcctgtgcatctggcgtctgcgtgacaggaagccagtcaccaagtaccgaaattactctgaagtatcctggcatatcccagagctctgggggagatatcggtgtccatatggcccacgacgatcaatcagtgagtagcaaaattgttgctcattgtcccccacaggacccctgcttggtgcacggctgcatcgtatgtgcccacgggctaataaactaccagtgccatacagcactgtccgcgttcgtcgtggttttcgtgttttcttcgattgctatcatctgtctcgccattctgtatcgtgtccttaagtgcctgaaaatcgcacctcgcaaggtgttgaatccactcatgtggattaccgccttcataagatgggtatacaaaaagatggtggctagggttgccgacaacatcaaccaggtcaatcgggagattggatggatggaaggcggtcaactggtgttagggaacccggcacccatccctcgacacgctccaatcccccgctacagcacgtatctgatgctactcctgattgtgtcctacgccaccgcgtgttcagagcttatacaggccagttctagaatcacaacttgcagcaccgagggcgtcaatacaaagtgtaggttgtccggaactgctctgattcgggcaggctcagttggggccgaggcttgcctcatgctgaaaggagtgaaggaagatcagaccaaatttcttaagatcaaaacagtgagctctgaactgtcctgtcgcgagggtcagagttattggaccggcagcttctctcctaagtgcttgtcctcaagaaggtgccatctcgtaggggagtgtcacgtcaaccgttgcctgagttggcgggacaatgaaactagcgccgagttttcgttcgtgggagaatccacgacaatgcgagagaacaagtgttttgaacaatgcggcggttgggggtgtggctgcttcaatgttaacccatcttgtttatttgtgcacacctacctgcagagcgtcagaaaagaggcactaagggtgttcaattgcattgattgggttcataagctcactctggagatcaccgactttgatggatcagtgagtacaatagaccttggcgcgtcctctagccgcttcaccaactgggggtccgtatcattgagcctggatgccgaaggaatcagtggctctaattcctttagcttcattgagtcgcccggtaaagggtatgctatcgtcgacgaaccgttctcagagattcctcggcagggatttctcggcgaaatcagatgtaactctgagagttccgtgctgagcgcccacgagtcttgcttaagggcaccaaatctgataagctacaagcccatgattgatcagcttgaatgtactacaaacttgatcgaccctttcgtggtctttgagcgcggttccctcccccaaacgcgaaatgataaaaccttcgctgcctcaaagggcaaccgtggggttcaggcatttagtaagggaagcgtgcaggccgacctgactctaatgttcgataactttgaagtagacttcgtgggcgctgcggtctcttgcgacgccgcatttctgaatctcacagggtgctattcctgtaacgctggagcccgggtgtgcctgtcaattaccagtacaggcactggtacccttagcgcccataataaagatgggtccttgcacgttgtgctgccatctgagaacggaacgaaggaccaatgtcagatcttacatttcaccgtccctgaagtggaggaggaatttatgtactcgtgcgatggcgacgagagacccctcctggttaaaggtacacttatagctatcgatccattcgacgataggcgcgaagcaggcggggagagcactgtggtcaatccgaagtcaggatcctggaactttttcgactggttcagtggcctgatgtcttggtttgggggacctttgaaaaccattctcctgatctgtctatacgtagccctgagcattggcctcttctttctgcttatctatttgggtcggacagggctgtccaagatgtggttagcggctactaagaaagcctcatga

SEQ ID NO: 11193 - RNA, 3480 nt, synthetic construct
  misc_feature 1..3480: note = derived and/or modified CDS sequence (opt3) from RVFV(Kenya 83 (21445))__DQ380198.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaataatatcacatgtcacggtaagaaccctgaaaataaaatttccttaatcaagggcccaccgcataaaaagcgcgtcgggatagttcgatgcgagcgtagaagggacgctaagcaaatcggacgggaaactatggccggcattgcaatgacggtgctgcccgccctagctgtattcgcactcgcccctgtggtctttgctgaggatccacatctgcgcaacagacccggtaaagggcacaattatatcgacggaatgacccaggaggatgccacatgtaagcctgtgacttacgcgggcgcatgttcttcgttcgacgttcttctggaaaaaggcaagtttccattgttccagtcatatgcccaccataggaccctcctggaggctgtgcacgatacaattatcgccaaagcagatccccctagctgcgacctgcagagtgctcacgggaacccatgcatgaaggaaaagctcgtcatgaaaacccattgtccgaatgactaccaatccgcccactatttaaacaatgatggaaagatggcgtctgtgaaatgtccccctaagtacgagctgactgaagactgcaacttttgccggcagatgacaggtgccagccttaaaaagggctcctatccattgcaggatctgttctgtcagtcaagtgaggacgacgggagcaaactaaagaccaagatgaaaggagtatgcgaggttggcgtgcaagcactcaagaaatgcgatggtcagctgtctacggctcatgaagtcgtgccctttgccgtgttcaaaaattccaagaaggtctaccttgacaagctggatttgaaaactgaggaaaacctcctgcctgactcatttgtttgtttcgagcacaaggggcagtacaaaggaaccatggatagcggccagacaaagcgcgaattaaaaagttttgacatatctcaatgcccaaagattggcgggcacggatccaagaaatgtactggtgatgctgccttctgcagcgcatatgagtgtaccgcccagtacgctaatgcgtattgctcgcatgcaaacggctctgggatcgtgcagattcaagtatccggagtgtggaagaaacccctgtgtgtcggctacgagcgagtggttgtgaagagagaactctcagccaaaccgatccagagggtcgagccttgcacaacctgtatcacgaagtgcgaaccccacggtcttgtggtacggagtactgggtttaagattagctccgctgttgcctgtgcatctggcgtgtgcgtcacaggaagccagtcaccaagtaccgagataactctgaaatatcctggcatctcccagagctctgggggagacattggtgtgcatatggcccacgatgaccaatcagtcagtagcaagatcgtggctcattgtcccccacaggatccctgcttggttcacggctgcatagtgtgtgcccacgggctaattaattaccagtgccatacagcactgtccgcgttcgtagtcgtgttcgtgttttcttcgatcgctatcatttgtctcgccatcctgtatcgtgttcttaaatgcctgaagattgcacctcgcaaagtcttgaacccactcatgtggataaccgccttcatcagatgggtgtacaagaaaatggtagctagggtggccgacaacattaatcaggttaaccgggaaatcggatggatggagggcggtcaactggcattagggaatccggctcccatccctcgacacgccccaattccccgctacagcacgtatctgatgctactcctgatagtctcctacgcgtcagcctgtagtgagcttatccaggcttctagcagaattaccacatgctccactgaaggcgtgaacaccaagtgtaggttgtcaggaacagcactgatccgggccggcagcgtgggggctgaggcctgcctcatgctgaagggagtcaaagaagaccagactaagtttcttaaaattaagaccgtttcttccgagctgagttgtcgcgagggtcagagctattggacaggctctttctcccctaaatgcttgtcaagtagaaggtgccatctcgtgggggaatgtcacgtgaatcgttgcctgagctggcgggataacgagacctcggcagaattttccttcgtaggagagtctactacgatgcgagaaaataagtgttttgagcaatgcggcggttgggggtgtggctgcttcaacgtcaatccaagctgtttatttgtgcacacatacctgcagtcagttagaaaggaggcgctaagggtgttcaactgcatcgactgggtccataaactcaccctggaaataactgattttgacggaagtgtgtccaccatcgatcttggcgcctctagctcccgcttcacaaattgggggtcagttagcttgagtctggacgctgagggaatttctggctccaacagcttttcgttcatcgaatcacccggtaaggggtatgccattgtggatgagccgttctctgaaatccctcggcagggatttctcggcgagataagatgtaatagtgagtccagcgtactgtctgcacacgaaagctgcttaagggctccaaacctgatttcctacaaacccatgatcgaccagcttgagtgtaccactaatttgattgatcctttcgtcgtgtttgaacgcggttcactcccccaaacacgaaacgacaagacgttcgccgcaagtaaaggcaaccgtggggtgcaggcctttagcaagggatctgtccaggctgatctgaccctaatgttcgacaattttgaggttgatttcgtgggcgcggccgtatcctgcgacgcagcttttctgaacctcactgggtgctattcatgtaatgccggagcccgggtgtgcctgagtatcacaagcaccggcacaggtactctttccgctcataacaaggacgggtctttgcacatagtcctgccatcggaaaatggaaccaaagatcaatgtcagatcttacatttcacggtgcctgaggttgaggaagagtttatgtacagctgcgacggcgatgaaagacccctcctggtgaagggtacccttattgcaatcgacccattcgatgacaggcgcgaggccggcggggagtcaacagtcgtgaacccgaaatccggaagttggaactttttcgattggttctctggcctgatgagctggtttgggggacctttgaagactattctcctgatctgtctatacgttgcgctgtccataggcctcttctttctgcttatttatttgggtcggaccgggctgtcaaaaatgtggttagctgccacaaagaaggcatcttga

SEQ ID NO: 11194 - RNA, 3480 nt, synthetic construct
  misc_feature 1..3480: note = derived and/or modified CDS sequence (opt3) from RVFV(Entebbe)__DQ380191.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagcttcaccgggctctgaaagcaatcattgccgcggatggattgaataatatcacatgtcatggtaaggaccctgaagataaaatttccttaatcaagggcccaccgcacaaaaagcgcgtcggggttgtgcgatgcgagcgtagaagggacgctaagcaaataggacgggaaactatggccggcatcgcaatgacggtactgcccgccctagctgtgttcgcactcgcccctgtcgtgtttgctgaggatccacatctgcgcaacagacccggtaaagggcacaattacattgacggaatgacccaggaggatgccacatgtaagcctgttacttatgcgggcgcatgttcttcgttcgacgtgcttctggaaaaaggcaagtttccattgttccagtcatacgcccatcacaggaccctcctggaggctgtccacgatacaatcattgccaaagcagatccccctagctgcgacctgcagagtgctcatgggaacccatgcatgaaggaaaagctcgtgatgaaaacccactgtccgaatgactatcaatccgcccattacttaaacaatgatggaaagatggcgtctgtaaaatgtccccctaagtatgagctgactgaagactgcaacttttgccggcagatgacaggtgccagccttaaaaagggctcctacccattgcaggacctgttctgtcagtcaagtgaggatgacgggagcaaactaaagaccaagatgaaaggagtttgcgaggtgggcgtccaagcactcaagaaatgcgatggtcagctgtctacggctcacgaagtggtgccctttgccgtcttcaaaaattccaagaaggtttatcttgacaagctggatttgaaaactgaggaaaacctcctgcctgactcatttgtgtgtttcgagcacaaggggcagtacaaaggaaccatggatagcggccagatcaagcgcgaattaaaaagttttgacatatctcaatgcccaaagattggcgggcatggatccaagaaatgtacaggtgatgctgccttctgcagcgcatacgagtgtactgcccagtatgctaatgcgtactgctcgcacgcaaacggctctgggatcgtacagattcaagtgtccggagtctggaagaaacccctgtgtgtgggctatgagcgagttgtggtcaagagagaactctcagccaaaccgatccagagggtggagccttgcaccacatgtatcaccaagtgcgaaccccatggtcttgtagttcggagtacggggtttaagattagctccgctgtggcctgtgcatctggcgtctgcgtgactggaagccagtcaccaagtacagagataaccctgaaataccctggcatctcccagagctctgggggagacattggtgtccacatggcccatgatgaccaatcagtgagtagcaagatcgttgctcactgtcccccacaggacccctgcttggtgcacggctgcatagtatgtgcccatgggctaattaattatcagtgccacactgcactgtccgcgttcgtcgtggttttcgtgttttcttcggtcgctatcatctgtctcgccattctgtacaaagtgcttaagtgcctgaaaatcgcacctcgtaaggtattgaacccactcatgtggattacagccttcatacgctgggtgtataaaaagatggttgctagagtcgccgataatatcaaccaggtgaacagggaaattggatggatggagggcggtcaactggtgttagggaatccggcacccatccctcggcatgctccaatcccccgatacagcacctacctgatgctactcctgattgtctcctatgcctcagcgtgtagtgagcttatacaggcctctagccgcatcacgacctgctccacagaaggcgttaacactaagtgtagattgtcaggaaccgctctgattagggcaggcagcgtgggggccgaggcttgcctcatgctgaaaggagtgaaggaagaccagacaaaatttcttaagatcaaaactgtatcttccgagctgagttgtcgggagggtcagagctactggaccggctctttctcccctaagtgcttgtcaagtcgcagatgccacctcgtcggggaatgtcacgtgaataggtgcctgagctggcgtgataacgagacatcggccgaattttccttcgttggagagtctaccactatgcgggaaaataagtgttttgagcaatgcggcggttgggggtgtggctgcttcaacgtgaatccaagctgtttatttgtccatacgtatctgcagtcagtgcgaaaagaggcactaagagttttcaactgcattgactgggtgcacaagctcacactggaaatcaccgattttgacggaagtgtatccactgtcgatcttggcgcgtctagctccaggttcaccaattgggggtcagtgagcttgagtctggacgccgagggaatatctggctccaacagcttttcgttcatcgaatcacccggtaaagggtacgctattgtggatgagccgttctctgaaatccctcgccagggatttctcggcgagattcggtgtaatagtgagtccagcgtcctgtctgcccatgaaagctgcttaagagcaccaaacctgatctcctataagcccatgatagaccagcttgagtgtacaaccaatttgattgatcctttcgttgtgtttgaaaggggttcactcccccaaactcgcaacgacaaaacattcgctgccagtaagggcaatcgaggggtacaggcatttagcaagggatctgtgcaggccgatctgacgctaatgttcgacaactttgaggtcgacttcgtgggcgctgcggtttcctgcgatgccgcatttctgaacctcaccgggtgctactcatgtaatgctggagcccgggtgtgcctgagtatcactagcacaggcaccggtacactttccgcccacaacaaagacgggtctttgcatattgtcctgccatcggaaaatggaactaaggatcaatgtcagatcttacacttcaccgtgcctgaggttgaggaagagtttatgtatagctgcgacggcgatgaacgtcccctcctggtgaaaggtacgcttatagctatcgacccattcgatgacagaagggaggcaggcggggagtcaaccgtcgtaaacccgaagtccggaagttggaactttttcgattggttctctggcctgatgagctggtttgggggacctttgaaaacaattctcctgatctgtctatacgtggccctgtccattggcctcttctttctgcttatctacttgggtcgcactgggctgtcaaagatgtggttagcggctaccaagaaagcctcttga

SEQ ID NO: 11195 - RNA, 3480 nt, synthetic construct
  misc_feature 1..3480: note = derived and/or modified CDS sequence (opt3) from RVFV(763/70)__DQ380188.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaataatatcacatgtcacggtaaggaccctgaagataaaatttccttagtcaagggcccaccgcataaaaagcgcgttgggatcgtgcgatgcgagcgtagaagggacgctaagcaaataggacgggaaactatggccggcatcgcaatgacggtactgcccgccctagctgtgttcgcactcgcccctgtcgtgtttgctgaggatccacatctgcgcaacagacccggtaaagggcacaattatattgacggaatgacccaggaggatgccacatgtaagcctgttacttacgcgggcgcatgttcttcgttcgacgtgcttctggaaaaaggcaagtttccattgttccagtcatatgcccaccataggaccctcctggaggctgtccacgatacaatcattgccaaagcagatccccctagctgcgacctgcagagtgctcacgggaacccatgcatgaaggaaaagctcgtgatgaaaacccattgtccgaatgactaccaatccgcccactatttaaacaatgatggaaagatggcgtctgtaaaatgtccccctaagtacggtctgactgaggactgcaacttttgccggcagatgacaggcgccagccttaaaaaggggtcctatccattgcaggacctgttctgtcagtcaagtgaagatgacggaagcaaactaaagaccaagatgaaaggcgtttgcgaggtgggtgtccaagcactcaagaaatgcgatgggcagctgtctacggctcatgaggtggtgccctttgccgtcttcaagaatagcaaaaaggtttaccttgacaagctggatttgaaaactgaagagaacctcctgcctgactcatttgtgtgtttcgaacacaagggacagtacaaaggcaccatggatagcggccagacaaagcgcgagttaaaaagttttgacatctctcaatgcccaaagatagggggacacggttccaagaaatgtactggcgatgctgccttctgcagcgcatatgaatgtaccgcccagtacgctaatgcgtattgctcgcatgcaaacgggtctggaattgtacagatccaagtgtccggcgtctggaagaaacccctgtgtgtgggttacgagcgagttgtggtcaagagagagctctcagccaaaccgattcagagggtggaaccttgcacaacctgtatcacgaagtgcgagccccacgggcttgtagttcggagtactggctttaagatcagctccgctgtggcctgtgcatctggagtctgcgtgacaggcagccagtcaccaagtaccgaaattactctgaaatatcctgggatatcccagagctctggaggtgacatcggcgtccatatggcccacgatgaccaatcagtgagtagcaagattgttgctcattgtcccccacaggacccctgcttggtgcacgggtgcatcgtatgtgcccacggactaataaattaccagtgccatacagcactgtccgcgttcgtcgtggttttcgtgttttcttcggtcgctattatctgtctcgccatcctgtataaagtgcttaagtgcctgaaaattgcacctcgtaaggtattgaacccactcatgtggatcaccgccttcattcgctgggtgtacaaaaagatggttgctagagtcgccgataatataaaccaggtgaacagggagatcggctggatggaaggtgggcaactggcattaggcaatccggctcccattcctcggcacgccccaatcccccgatacagcacgtatctgatgctactcctgatcgtgtcctacgcgtcagcctgtagtgagcttattcaggcttctagccgcataaccacatgctccactgagggagtcaacaccaagtgtagattgtcaggcacagcactgatcagggccgggagcgttggagctgaagcctgcctcatgctgaaaggtgtgaaggaggaccagactaaatttcttaagattaaaaccgtgtcttccgaactgagttgtcgggagggccagagctattggacagggtctttctcccctaagtgcttgtcaagtcgcagatgccatctcgtaggagagtgtcacgtcaataggtgcctgagctggcgtgataacgaaacctcggcagagttttccttcgtgggcgaatctactacgatgcgggagaataagtgttttgaacaatgcggtgggtggggctgtggatgcttcaacgttaatccaagctgtttatttgtgcacacatacctgcagtcagtccgaaaagaggcgctaagagtgttcaactgcatcgactgggttcataagctcaccctggagattactgattttgacggcagtgtgtccaccatcgatcttggggcctctagctccaggttcacaaattggggatcagtatccttgagtctggacgctgaaggcatatctggttccaacagcttttcgttcatcgagtcacccgggaaaggatatgccattgtcgatgaaccgttctctgagatccctcgccagggctttctcggtgaaattcggtgtaatagtgagtccagcgtgctgtctgcacacgagagctgcttaagagctccaaacctgatctcctacaagcccatgatagaccagcttgaatgtaccactaatttgattgatcctttcgtggtctttgagaggggctcactcccccaaacacgcaacgacaaaacgttcgccgcaagtaaggggaatcgaggagttcaggcctttagcaagggctctgtgcaggctgatctgaccctaatgttcgacaactttgaagtagacttcgtgggggcggccgtctcctgcgatgcagcttttctgaacctcactggatgctattcatgtaatgccggcgcccgggtgtgcctgagtatcacaagcaccggtacagggactctttccgctcataacaaagacggatctttgcacattgttctgccatcggagaatggcaccaaggatcaatgtcagatcttacatttcacggtgcctgaagtcgaggaggaatttatgtacagctgcgacggtgatgagcgtcccctcctggtgaaaggcacccttatagcaatcgacccattcgatgacagaagggaagccgggggagagtcaacagttgtgaacccgaagtccggcagttggaactttttcgattggttctctgggctgatgagctggtttggaggccctttgaaaactattctcctgatctgtctatacgtcgcgctgtccattggtctcttctttctgcttatctatttggggcgcaccggactgtcaaagatgtggttagctgccacaaagaaagcatcttga

SEQ ID NO: 11196 - RNA, 3480 nt, synthetic construct
  misc_feature 1..3480: note = derived and/or modified CDS sequence (opt3) from RVFV(OS-1)__DQ380186.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaataatatcacatgtcacggtaaggaccctgaagataaaatttccttaatcaagggcccaccgcataaaaagcgcgtcgggatagttcgatgcgagcgtcaaagagacgctaagcagatcggaagggaaactatggccggcattgcaatgacggtgctgcccgccctagctgtattcgcactcgcccctgtggtctttgctgaggatccacatctgcggaaccgccccggtaaagggcacaattatatcgacggaatgacccaggaggatgccacatgtaagcctgtgacttacgcgggcgcatgttcttcgttcgacgttcttctggaaaaaggcaagtttccattgttccagtcatatgcccaccatagaaccctcctggaggctgtgcacgatacaattatcgccaaagcagatccccctagctgcgacctgcaaagtgctcacgggaacccatgcatgaaggaaaagctcgtcatgaaaacccattgtccgaatgactaccagtccgcccactatttaaacaatgatggaaagatggcgtctgtgaaatgtccccctaagtacgagctgactgaagactgcaacttttgcaggcagatgacaggtgccagccttaaaaagggctcctatccattgcaggacctgttctgtcaatcaagtgaggatgacgggagcaaactaaagaccaagatgaaaggagtatgcgaggttggcgtgcaggcactcaagaaatgcgatggtcagctgtctacggctcatgaagtcgtgccctttgccgtgttcaaaaattccaaaaaggtctaccttgacaagctggatttgaaaactgaggaaaacctcctgcctgactcatttgtttgtttcgagcacaaggggcagtacaaaggaaccatggatagcggccaaacaaagcgggaattaaaaagttttgacatatctcagtgcccaaagattggcgggcacggatccaagaaatgtactggtgatgctgccttctgcagcgcatatgagtgtaccgcccagtacgctaatgcgtattgctcgcatgcaaacggctctggggtggtacaaatccaggtgtccggagtctggaagaaacccctgtgtgtgggctacgagcgcgttgtggtcaagcgagaactctcagccaaaccgattcagagagtggagccttgcacaacctgtatcacgaagtgcgaaccccacggtcttgtagttaggagtactgggtttaagatcagctccgctgtggcctgtgcatctggcgtctgcgtgacaggaagccagtcaccaagtaccgagattactctgaaatatcctggcatatcccaaagctctgggggagacatcggtgtccatatggcccacgatgaccagtcagtgagtagcaagattgttgctcattgtcccccacaggacccctgcttggtgcacggctgcatcgtatgtgcccacgggctaataaattaccagtgccatacagcactgtccgcgttcgtcgtggttttcgtgttttcttcggtcgctattatctgtctcgccatcctgtataaagtgcttaagtgcctgaaaattgcacctcggaaggtattgaacccactcatgtggatcaccgccttcattcgttgggtgtacaaaaagatggttgctcgcgtcgccgataatataaaccaagtgaacagagaaatcggatggatggagggcggtcagctggcattagggaatccggctcccattcctaggcacgccccaatcccccggtacagcacgtatctgatgctactcctgatcgtgtcctacgcgtcagcctgtagtgagcttattcaggcttctagccgaataaccacatgctccactgaaggcgtcaacaccaagtgtcgcttgtcaggaacagcactgatcagagccggcagcgttggggctgaggcctgcctcatgctgaaaggagtgaaggaagaccagactaaatttcttaagattaaaaccgtgtcttccgagctgagttgtagggagggtcaaagctattggacaggctctttctcccctaagtgcttgtcaagtcggcgctgccatctcgtaggggaatgtcacgtcaatagatgcctgagctggagggataacgagacctcggcagaattttccttcgtgggagagtctactacgatgcgtgaaaataagtgttttgagcagtgcggcggttgggggtgtggctgcttcaacgttaatccaagctgtttatttgtgcacacatacctgcagtcagtccggaaagaggcgctaaaggtgttcaactgcatcgactgggttcataaactcaccctggaaattactgattttgacggaagtgtgtccaccatcgatcttggcgcctctagctcccgattcacaaattgggggtcagtcagcttgagtctggacgctgagggaatatctggctccaacagcttttcgttcatcgaatcacccggtaaggggtatgccattgtagatgagccgttctctgaaatccctagacagggatttctcggcgagattaggtgtaatagtgagtccagcgtgctgtctgcacacgaaagctgcttacgcgctccaaacctgatctcctacaaacccatgatagaccaacttgagtgtaccactaatttgattgatcctttcgtggtctttgaacggggttcactcccccagacaagaaacgacaagacgttcgccgcaagtaagggcaatcgcggggttcaggcctttagcaaaggatctgtgcaagctgatctgaccctaatgttcgacaactttgaggtagacttcgtgggcgcggccgtctcctgcgatgcagcttttctgaacctcactgggtgctattcatgtaatgccggagccagggtgtgcctgagtatcacaagcaccggcacaggtactctttccgctcataacaaggacgggtctttgcacattgttctgccatcggaaaatggaaccaaagatcagtgtcagatcttacatttcacggtgcctgaggtcgaggaagagtttatgtacagctgcgacggcgatgaacgacccctcctggtgaagggtacccttatagcaatcgacccattcgatgaccggcgtgaggccggcggggagtcaacagttgtgaacccgaaatccggaagttggaactttttcgattggttctctggcctgatgagctggtttgggggacctttgaagactattctcctgatctgtctatacgtcgcgctgtccattggcctcttctttctgcttatctatttgggtagaaccgggctgtcaaagatgtggttagctgccacaaagaaggcatcttga

SEQ ID NO: 11197 - RNA, 3480 nt, synthetic construct
  misc_feature 1..3480: note = derived and/or modified CDS sequence (opt3) from RVFV(2008/00101)__HE687306.1__NSm-Gn-Gc
  source 1..3480: mol_type = other RNA
atgatcgagggcgcctgggacagcctgagagaagaggaaatgcccgaggaactctcctgctctgtgtcagggattagggaggtcaagaccagtagccaggagctttaccgggctctgaaagcaataatcgccgcggatggattgaacaatattacatgtcacggtaagaaccctgaagacaaaatctccttaattaagggcccaccgcataaaaagcgcgttgggatcgtgcgatgcgagcgtagaagggatgctaagcaaataggacgggaaactatggccggcatcgcaatgacggtactgcccgccctagctgtgttcgcactcgcccctgtcgtgtttgctgaggacccacatctgcgcaatagacccggtaaagggcacaactatattgatggaatgacccaggaggacgccacatgtaagcctgttacttacgcgggcgcatgttcttcgttcgatgtgcttctggaaaaaggcaagtttccattgttccagtcatatgcccaccataggaccctcctggaggctgtccacgacacaatcattgccaaagcagatccccctagctgcgacctgcagagtgctcacgggaatccatgcatgaaggaaaagctcgtgatgaaaacccattgtccgaacgattaccaatccgcccactatttaaataacgacggaaagatggcgtctgtaaaatgtccccctaagtacgagctgactgaagattgcaatttttgccggcagatgacaggtgccagccttaaaaagggctcctatccattgcaggacctgttctgtcagtcaagtgaggacgatgggagcaaactaaagaccaagatgaaaggagtttgcgaggtgggcgtccaagcactcaagaaatgcgacggtcagctgtctacggctcatgaagtggtgccctttgccgtcttcaagaactccaaaaaggtttaccttgataagctggacttgaaaactgaggaaaatctcctgcctgattcatttgtgtgtttcgagcacaaggggcagtacaaaggaaccatggacagcggccagacaaagcgcgaattaaaaagttttgatatctctcaatgcccaaagataggcgggcacggatccaagaaatgtactggtgacgctgccttctgcagcgcatatgagtgtaccgcccagtacgctaacgcgtattgctcgcatgcaaatggctctgggattgtacagatccaagtgtccggagtctggaagaaacccctgtgtgtgggctacgagcgagttgtggtcaagagagaactctcagccaaaccgattcagagggtggagccttgcacaacctgtatcacgaagtgcgaaccccacggtcttgtagttcggagtactgggtttaagatcagctccgctgtggcctgtgcatctggcgtctgcgtgacaggaagccagtcaccaagtaccgagattactctgaaatatcctggcatatcccagagctctgggggagatatcggtgtccatatggcccacgacgatcaatcagtgagtagcaagattgttgctcattgtcccccacaggacccctgcttggtgcacggctgcatcgtatgtgcccacgggctaataaactaccagtgccatacagcactgtccgcgttcgtcgtgattttcgtgttttcttcgaccgctatcatctgtctcgccgttctgtatcgtgtccttaaatgcctgaagattgcacctcgcaaagtgttgaatccactcatgtggatcacggccttcattagatgggtatacaagaaaatggtggctagggttgccgacaacataaaccaggtcaatcgggaaatcggatggatggagggcggtcaactggcattagggaacccggctcccattcctcgacacgccccaatcccccgctacagcacctatctgatgctactcctgatcgtgtcctacgcgtcagcctgtagtgagcttattcaggcttctagcagaataacaacttgctccaccgaaggcgtgaatacaaagtgtaggttgtcaggaactgcactgatccgggccggcagcgtcggggctgaggcctgcctcatgctgaagggagttaaagaagatcagaccaagtttcttaaaattaagacagtgtcttccgagctgagttgtcgcgagggtcagagctattggaccggctctttctcccctaaatgcttgtcaagtagaaggtgccatctcgtgggggaatgtcacgtaaaccgttgcctgagctggcgggacaatgagacttcggcagaattttccttcgtcggagagtctacgacaatgcgagaaaacaagtgttttgagcaatgcggcggttgggggtgtggctgcttcaatgtgaacccaagctgtttatttgttcacacctacctgcagtcagtgagaaaggaggcgctaagggtcttcaattgcatcgattgggtgcataaactcactctggaaattaccgactttgatggaagtgtttccacaatcgaccttggcgcctctagctcccgcttcaccaactgggggtcagtgagcttgagtctggatgctgagggaatatctggctccaatagcttttcgttcatcgaatcacccggtaaggggtatgccattgtagacgagccgttctctgaaatccctcggcagggatttctcggcgagattagatgtaacagtgagtccagcgtcctgtctgcacacgaaagctgcttaagggctccaaatctggtgtcctacaaacccatgatcgatcagcttgagtgtactacaaacttgatagaccctttcgtggtctttgaacgcggttcactcccccaaacgcgaaatgataagaccttcgccgcaagtaaaggcaaccgtggggttcaggcctttagcaagggatctgtgcaggctgacctgactctaatgttcgataactttgaggtagacttcgtgggcgcggccgtctcctgcgacgcagcttttctgaatctcacagggtgctattcatgtaacgccggagcccgggtgtgcctgagtattaccagcacaggcactggtaccctttccgctcataataaggatgggtctttgcacatcgttctgccatcggaaaacggaacgaaagaccaatgtcagattttacatttcaccgtgcctgaggtcgaggaagagtttatgtacagctgcgatggcgacgaaagacccctcctggtgaagggtacacttatcgcaatagatccattcgacgataggcgcgaggccggcggggagtcaactgttgtgaatccgaaatccggaagttggaactttttcgactggttctctggcctgatgagctggtttgggggacctttgaagaccacactcctgatctgtctatacgtcgcgctgtccattggcctcttctttctgcttatctatttgggtcggactgggctgtcaaaaatgtggttagctgccaccaagaaggcatcttga

SEQ ID NO: 11198 - RNA, 3480 nt, synthetic construct
  misc_feature 1..3480: note = derived and/or modified CDS sequence (opt3) from RVFV(200803162)__JF311377.1__NSm-Gn-Gc
  source 1..3480: mol_type = other RNA
atgatcgagggcgcctgggacagcctgagagaagaggaaatgcccgaggaactctcctgctctgtgtcagggattagggaggtcaagaccagtagccaggagctttaccgggctctgaaagcaataatcgccgcggatggattgaacaatattacatgtcacggtaagaaccctgaagacaaaatctccttaattaagggcccaccgcataaaaagcgcgttgggatcgtgcgatgcgagcgtagaagggatgctaagcaaataggacgggaaactatggccggcatcgcaatgacggtactgcccgccctagctgtgttcgcactcgcccctgtcgtgtttgctgaggacccacacctccgcaatagacccggtaaagggcataactatattgatggaatgacccaggaggacgccacatgtaagcctgttacttacgcgggcgcatgttcttcgttcgatgtgcttctggaaaaaggcaagtttccattgttccagtcatatgcccaccataggaccctcctggaggctgtccacgacacaatcattgccaaagcagatccccctagctgcgacctgcagagtgctcacgggaatccatgcatgaaggaaaagctcgtgatgaaaacccattgtccgaacgattaccaatccgcccactatttaaataacgacggaaagatggcgtctgtaaaatgtccccctaagtacgagctgactgaagattgcaatttttgccggcagatgacaggtgccagccttaaaaagggctcctatccattgcaggacctgttctgtcagtcaagtgaggacgatgggagcaaactaaagaccaagatgaaaggagtttgcgaggtgggcgtccaagcactcaagaaatgcgacggtcagctgtctacggctcatgaagtggtgccctttgccgtcttcaagaactccaaaaaggtttaccttgataagctggacttgaaaactgaggaaaatctcctgcctgattcatttgtgtgtttcgagcacaaggggcagtacaaaggaaccatggacagcggccagacaaagcgcgaattaaaaagttttgatatctctcaatgcccaaagataggcgggcacggatccaagaaatgtactggtgacgctgccttctgcagcgcatatgagtgtaccgcccagtacgctaacgcgtattgctcgcatgcaaatggctctgggattgtacagatccaagtgtccggagtctggaagaaacccctgtgtgtgggctacgagcgagttgtggtcaagagagaactctcagccaaaccgattcagagggtggagccttgcacaacctgtatcgctaagtgcgaaccccacggtcttgtagttcggagtacggggtttaagatcagctccgccgtggcatgtgcctctggcgtctgcgtgactggaagccagtcaccaagtacagagattaccctgaaatatcctggcatatcccagagctctgggggagatatcggtgtccatatggctcacgacgatcaatcagtgagtagcaagattgttgcccattgtcccccacaggacccctgcttggtgcacgactgcatcgtatgtgcacacggcctaataaactaccagtgccatactgcgctgtccgctttcgtcgtgattttcgtgttttcttcgacagccatcatctgtctcgcagttctgtatcgtgtccttaaatgcctgaagattgcccctcgcaaagtgttgaatccactcatgtggatcaccgctttcattagatgggtatacaagaaaatggtggccagggttgcagataacataaaccaggtcaatcgggaaatcgggtggatggagggaggccaactggctttacgaaacccggcccccattcctcgccacgcgccaatccccagatacagcacgtatctgatgctactcctgatcgtgtcctacgcctcagcttgtagtgagcttattcaggcatctagcaggataaccacatgctccactgaaggtgtgaataccaagtgtcggttgtcagggacagccctgatccgcgctggcagcgtcggagccgaggcatgcctcatgctgaagggcgttaaagaagaccagactaagtttcttaaaattaagaccgtgtcttccgagctgagttgtagagaggggcagagctattggacaggatctttctcccctaaatgcttgtcaagtaggcgttgccatctcgtgggtgaatgtcacgtaaaccggtgcctgagctggcgagataatgagacctcggcggaattttccttcgtcggcgagtctactacgatgagagaaaacaagtgttttgagcaatgcgggggatggggctgtggttgcttcaatgtgaacccaagctgtttatttgttcacacatacctgcagtcagtgaggaaggaggccctacgcgtcttcaattgcatcgactgggtgcataaactcaccctggaaattactgattttgacgggagtgtttccaccatcgatcttggcgcttctagctcccggttcacaaactggggatcagtgagcttgagtctggacgccgagggcatatctgggtccaatagcttttcgttcatcgaatcacccggaaagggctatgcaattgtagatgagccgttctctgaaatccctagacagggttttctcggggagattaggtgtaacagtgagtccagcgtcctgtctgctcacgaaagctgcttacgcgccccaaatctggtgtcctacaaacccatgatcgaccagcttgagtgtaccactaacttgatagatcctttcgtggtctttgaacgaggatcactcccccaaacacggaatgacaagacgttcgcagccagtaaaggcaaccgtggtgttcaggcttttagcaagggctctgtgcaggcggatctgaccctaatgttcgacaactttgaggtagacttcgtgggggccgcagtctcctgcgatgctgcctttctgaatctcactggatgctattcatgtaacgccggcgctagagtgtgcctgagtattacaagcaccgggacaggaactctttccgcacataataaggacggctctttgcacatcgttctgccatcggaaaacggtaccaaagatcaatgtcagattttacatttcacggtgcctgaggtcgaggaagagtttatgtacagctgcgacggggatgaaaggcccctcctggtgaagggaacccttatcgccatagacccattcgatgaccgccgggaggcgggcggtgagtcaacagttgtgaatccgaaatccggcagttggaactttttcgattggttctctgggctgatgagctggtttggaggccctttgaagactatcctcctgatttgtctatacgtcgctctgtccatcgggctgttctttctgcttatttatttgggaagaaccggcctgtcaaaaatgtggttagccgcaacaaagaaggcctcttga

SEQ ID NO: 11199 - RNA, 3480 nt, synthetic construct
  misc_feature 1..3480: note = derived and/or modified CDS sequence (opt3) from RVFV(2007002060)__EU574039.1__NSm-Gn-Gc
  source 1..3480: mol_type = other RNA
atgatcgagggcgcctgggacagcctgagagaagaggaaatgcccgaggaactctcctgctctgtgtcagggattagggaggtcaagaccagtagccaggagctttaccgggctctgaaagcaataatcgccgcggatggattgaacaatattacatgtcacggtaagaaccctgaagacaaaatctccttaattaagggcccaccgcataaaaagcgcgttgggatcgtgcgatgcgagcgtagaaaggatgctaaacaaataggaagggaaactatggccggcatcgcaatgacggtactgcccgccctagctgtgttcgcactcgcccctgtcgtgtttgctgaggacccacatctgcggaatcgccccggtaaggggcacaactatattgatggaatgacccaggaggacgccacatgtaaacctgttacttacgcgggcgcatgttcttcgttcgatgtgcttctggaaaagggcaaatttccattgttccagtcatatgcccaccatagaaccctcctggaggctgtccacgacacaatcattgccaaggcagatccccctagctgcgacctgcagagtgctcacgggaatccatgcatgaaggaaaaactcgtgatgaagacccattgtccgaacgattaccaatccgcccactatttaaataacgacggaaaaatggcgtctgtaaagtgtccccctaaatacgagctgactgaagattgcaatttttgcaggcagatgacaggtgccagccttaagaaaggctcctatccattgcaggacctgttctgtcagtcaagtgaggacgatgggagcaagctaaagaccaaaatgaagggagtttgcgaggtgggcgtccaagcactcaaaaagtgcgacggtcagctgtctacggctcatgaagtggtgccctttgccgtcttcaaaaactccaagaaggtttaccttgataaactggacttgaagactgaggaaaatctcctgcctgattcatttgtgtgtttcgagcacaaagggcagtacaagggaaccatggacagcggccagacaaaacgggaattaaagagttttgatatctctcaatgcccaaagataggcgggcacggatccaaaaagtgtactggtgacgctgccttctgcagcgcatatgagtgtaccgcccagtacgctaacgcgtattgctcgcatgcaaatggctctgggattgtacagatccaagtgtccggagtctggaaaaagcccctgtgtgtgggctacgagcgcgttgtggtcaaacgagaactctcagccaagccgattcagagagtggagccttgcacaacctgtatcacgaagtgcgaaccccacggtcttgtagttaggagtactgggtttaaaatcagctccgctgtggcctgtgcatctggcgtctgcgtgacaggaagccagtcaccaagtaccgagattactctgaagtatcctggcatatcccagagctctgggggagatatcggtgtccatatggcccacgacgatcaatcagtgagtagcaaaattgttgctcattgtcccccacaggacccctgcttggtgcacggctgcatcgtatgtgcccacgggctaataaactaccagtgccatacagcactgtccgcgttcgtcgtgattttcgtgttttcttcgaccgctatcatctgtctcgccgttctgtatcgggtccttaagtgcctgaaaattgcacctcgtaaggtgttgaatccactcatgtggatcacggccttcattcgctgggtatacaaaaagatggtggctagagttgccgacaacataaaccaggtcaatagggaaatcggatggatggagggcggtcaactggcattagggaacccggctcccattcctcggcacgccccaatcccccgatacagcacctatctgatgctactcctgatcgtgtcctacgcgtcagcctgtagtgagcttattcaggcttctagccgcataacaacttgctccaccgaaggcgtgaatacaaagtgtagattgtcaggaactgcactgatcagggccggcagcgtcggggctgaggcctgcctcatgctgaaaggagttaaggaagatcagaccaaatttcttaagattaaaacagtgtcttccgagctgagttgtcgggagggtcagagctattggaccggctctttctcccctaagtgcttgtcaagtcgcagatgccatctcgtgggggaatgtcacgtaaacaggtgcctgagctggcgtgacaatgagacttcggcagaattttccttcgtcggagagtctacgacaatgcgggaaaacaagtgttttgagcaatgcggcggttgggggtgtggctgcttcaatgtgaacccaagctgtttatttgttcacacctacctgcagtcagtgcgaaaagaggcgctaagagtcttcaattgcatcgattgggtgcataagctcactctggaaattaccgactttgatggaagtgtttccacaatcgaccttggcgcctctagctccaggttcaccaactgggggtcagtgagcttgagtctggatgctgagggaatatctggctccaatagcttttcgttcatcgaatcacccggtaaagggtatgccattgtagacgagccgttctctgaaatccctcgccagggatttctcggcgagattcggtgtaacagtgagtccagcgtcctgtctgcacacgaaagctgcttaagagctccaaatctggtgtcctacaagcccatgatcgatcagcttgagtgtactacaaacttgatagaccctttcgtggtctttgaaaggggttcactcccccaaacgcgcaatgataaaaccttcgccgcaagtaagggcaaccgaggggttcaggcctttagcaagggatctgtgcaggctgacctgactctaatgttcgataactttgaggtagacttcgtgggcgcggccgtctcctgcgacgcagcttttctgaatctcacagggtgctattcatgtaacgccggagcccgggtgtgcctgagtattaccagcacaggcactggtaccctttccgctcataataaagatgggtctttgcacatcgttctgccatcggaaaacggaacgaaggaccaatgtcagattttacatttcaccgtgcctgaggtcgaggaagagtttatgtacagctgcgatggcgacgaacgtcccctcctggtgaaaggtacacttatcgcaatagatccattcgacgatagaagggaggccggcggggagtcaactgttgtgaatccgaagtccggaagttggaactttttcgactggttctctggcctgatgagctggtttgggggacctttgaaaaccatcctcctgatttgtctatacgtcgcgctgtccatcggcctcttctttctgcttatttatttgggtcgcacagggctgtcaaagatgtggttagctgccactaagaaagcatcttga

SEQ ID NO: 11200 - RNA, 3480 nt, synthetic construct
  misc_feature 1..3480: note = derived and/or modified CDS sequence (opt3) from RVFV(2007002476)__EU574036.1__NSm-Gn-Gc
  source 1..3480: mol_type = other RNA
atgatcgagggcgcctgggacagcctgagagaagaggaaatgcccgaggaactctcctgctctgtgtcagggattagggaggtcaagaccagtagccaggagctttaccgggctctgaaagcaataatcgccgcggatggattgaacaatattacatgtcacggtaagaaccctgaagacaaaatctccttaattaagggcccaccgcataaaaagcgcgttgggatcgtgcgatgcgagcgtagaagggatgctaagcaaataggacgggaaactatggccggcatcgcaatgacggtactgcccgccctagctgtgttcgcactcgcccctgtcgtgtttgctgaggacccacatctgcgcaatagacccggtaaagggcacaactatattgatggaatgacccaggaggacgccacatgtaagcctgttacttacgcgggcgcatgttcttcgttcgatgtgcttctggaaaaaggcaagtttccattgttccagtcatatgcccaccataggaccctcctggaggctgtccacgacacaatcattgccaaagcagatccccctagctgcgacctgcagagtgctcacgggaatccatgcatgaaggaaaagctcgtgatgaaaacccattgtccgaacgattaccaatccgcccactatttaaataacgacggaaagatggcgtctgtaaaatgtccccctaagtacgagctgactgaagattgcaatttttgccggcagatgacaggtgccagccttaaaaagggctcctatccattgcaggacctgttctgtcagtcaagtgaggacgatgggagcaaactaaagaccaagatgaaaggagtttgcgaggtgggcgtccaagcactcaagaaatgcgacggtcagctgtctacggctcatgaagtggtgccctttgccgtcttcaagaactccaaaaaggtttaccttgataagctggacttgaaaactgaggaaaatctcctgcctgattcatttgtgtgtttcgagcacaaggggcagtacaaaggaaccatggacagcggccagacaaagcgcgaattaaaaagttttgatatctctcaatgcccaaagataggcgggcacggatccaagaaatgtactggtgacgctgccttctgcagcgcatatgagtgtaccgcccagtacgctaacgcgtattgctcgcatgcaaatggctctgggattgtacagatccaagtgtccggagtctggaagaaacccctgtgtgtgggctacgagcgagttgtggtcaagagagaactctcagccaaaccgattcagagggtggagccttgcacaacctgtatcacgaagtgcgaaccccacggtcttgtagttcggagtactgggtttaagatcagctccgctgtggcctgtgcatctggcgtctgcgtgacaggaagccagtcaccaagtaccgagattactctgaaatatcctggcatatcccagagctctgggggagatatcggtgtccatatggcccacgacgatcaatcagtgagtagcaagattgttgctcattgtcccccacaggacccctgcttggtgcacggctgcatcgtatgtgcccacgggctaataaactaccagtgccatacagcactgtccgcgttcgtcgtgattttcgtgttttcttcgaccgctatcatctgtctcgccgttctgtatcgtgtccttaaatgcctgaagattgcacctcgcaaagtgttgaatccactcatgtggatcacggccttcattaagtgggtatacaaaaagatggtggctagagttgccgacaacataaaccaggtcaatagggaaatcggatggatggagggcggtcaactggcattagggaacccggctcccattcctcggcacgccccaatcccccgatacagcacctatctgatgctactcctgatcgtgtcctacgcgtcagcctgtagtgagcttattcaggcttctagccgcataacaacttgctccaccgaaggcgtgaatacaaagtgtagattgtcaggaactgcactgatcagggccggcagcgtcggggctgaggcctgcctcatgctgaaaggagttaaggaagatcagaccaaatttcttaagattaaaacagtgtcttccgagctgagttgtcgggagggtcagagctattggaccggctctttctcccctaagtgcttgtcaagtcgcagatgccatctcgtgggggaatgtcacgtaaacaggtgcctgagctggcgtgacaatgagacttcggcagaattttccttcgtcggagagtctacgacaatgcgggaaaacaagtgttttgagcaatgcggcggttgggggtgtggctgcttcaatgtgaacccaagctgtttatttgttcacacctacctgcagtcagtgcgaaaagaggcgctaagagtcttcaattgcatcgattgggtgcataagctcactctggaaattaccgactttgatggaagtgtttccacaatcgaccttggcgcctctagctccaggttcaccaactgggggtcagtgagcttgagtctggatgctgagggaatatctggctccaatagcttttcgttcatcgaatcacccggtaaagggtatgccattgtagacgagccgttctctgaaatccctcgccagggatttctcggcgagattcggtgtaacagtgagtccagcgtcctgtctgcacacgaaagctgcttaagagctccaaatctggtgtcctacaagcccatgatcgatcagcttgagtgtactacaaacttgatagaccctttcgtggtctttgaaaggggttcactcccccaaacgcgcaatgataaaaccttcgccgcaagtaagggcaaccgaggggttcaggcctttagcaagggatctgtgcaggctgacctgactctaatgttcgataactttgaggtagacttcgtgggcgcggccgtctcctgcgacgcagcttttctgaatctcacagggtgctattcatgtaacgccggagcccgggtgtgcctgagtattaccagcacaggcactggtaccctttccgctcataataaagatgggtctttgcacatcgttctgccatcggaaaacggaacgaaggaccaatgtcagattttacatttcaccgtgcctgaggtcgaggaagagtttatgtacagctgcgatggcgacgaacgtcccctcctggtgaaaggtacacttatcgcaatagatccattcgacgatagaagggaggccggcggggagtcaactgttgtgaatccgaagtccggaagttggaactttttcgactggttctctggcctgatgagctggtttgggggacctttgaaaaccatcctcctgatttgtctatacgtcgcgctgtccatcggcctcttctttctgcttatttatttgggtcgcacagggctgtcaaagatgtggttagctgccactaagaaagcatcttga

SEQ ID NO: 11201 - RNA, 3480 nt, synthetic construct
  misc_feature 1..3480: note = derived and/or modified CDS sequence (opt3) from RVFV(2269/74)__DQ380222.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaataatatcacatgtcacggtaaggaccctgaagataaaatttccttaatcaagggcccaccgcataaaaagcgcgtcgggatagttcgatgcgagcgtagaagggacgctaagcaaatcggacgggaaactatggccggcattgcaatgacggtgctgcccgccctagctgtattcgcactcgcccctgtggtctttgctgaggatccacatctgcgcaacagacccggtaaagggcacaattatatcgacggaatgacccaggaggatgccacatgtaagcctgtgacttacgcgggcgcatgttcttcgttcgacgttcttctggaaaaaggcaagtttccattgttccagtcatatgcccaccataggaccctcctggaggctgtgcacgatacaattatcgccaaagcagatccccctagctgcgacctgcagagtgctcacgggaacccatgcatgaaggaaaagctcgtcatgaaaacccattgtccgaatgactaccaatccgcccactatttaaacaatgatggaaagatggcgtctgtgaaatgtccccctaagtacgagctgactgaagactgcaacttttgccggcagatgacaggtgccagccttaaaaagggctcctatccattgcaggacctgttctgtcagtcaagtgaggatgacgggagcaaactaaagaccaagatgaaaggagtatgcgaggttggcgtgcaagcactcaagaaatgcgatggtcagctgtctacggctcatgaagtcgtgccctttgccgtgttcaaaaattccaaaaaggtctaccttgacaagctggatttgaaaactgaggaaaacctcctgcctgactcatttgtttgtttcgagcacaaggggcagcacaaaggaaccatggatagcggccagacaaagcgcgaattaaaaagttttgacatatctcaatgcccaaagattggcgggcatggatccaagaaatgtactggtgatgctgccttctgcagcgcatacgagtgtaccgcccagtatgctaatgcgtactgctcgcacgcaaacggctctgggatcgtgcagattcaagtatccggagtgtggaagaaacccctgtgtgtcggctatgagcgagtggttgtgaagagagaactctcagccaaaccgatccagagggtcgagccttgcacaacctgtatcacgaagtgcgaaccccatggtcttgtggtacggagtactgggtttaagattagctccgctgttgcctgtgcatctggcgtgtgcgtcacaggaagccagtcaccaagtaccgagataactctgaaataccctggcatctcccagagctctgggggagacattggtgtgcacatggcccatgatgaccaatcagtcagtagcaagatcgtggctcactgtcccccacaggacccctgcttggttcacggctgcatagtgtgtgcccatgggctaattaattatcagtgccacacagcactgtccgcgttcgtagtcgtgttcgtgttttcttcggttgctatcatctgtctcgccattctgtacaaagtccttaagtgcctgaaaatcgcacctaagaaagtgttgaacccactcatgtggattaccgccttcatacgttgggtatataagaagatggtggctcgcgttgccgataatatcaaccaggtcaacagagaaattggatggatggagggcggtcaactggcattagggaatccggctcccatccctaggcatgccccaatcccccggtacagcacgtacctgatgctactcctgattgtgtcctatgcgtcagcctgtagtgagcttatacaggcttctagccgaatcaccacatgctccactgaaggcgtgaacaccaaatgtcgcttgtcaggaacagcactgattagagccggcagcgtcggggctgaggcctgcctcatgctgaagggagttaaagaagaccagactaagtttcttaaaatcaagaccgtgtcttccgagctgagttgtagggagggtcagagctactggacaggctctttctcccctaagtgcttgtcaagtcggcgctgccacctcgtgggggaatgtcacgtaaatagatgcctgagctggagggataacgagacctcggcagaattttccttcgtcggagagtctactacgatgcgtgaaaataaatgttttgagcaatgcggcggttgggggtgtggctgcttcaacgtgaatccaagctgtttatttgttcatacatatctgcagtcagtgcggaaggaggcgctacgagtcttcaactgcattgactgggtgcacaaactcaccctggaaatcactgattttgacggaagtgtttccaccatagatcttggcgcctctagctccagattcacaaattgggggtcagtgagcttgagtctggacgctgagggaatctctggctccaacagcttttcgttcattgaatcacccggtaaggggtacgccatcgtagatgagccgttctctgaaattcctaggcagggatttctcggcgagatccgctgtaatagtgagtccagcgtcctgtctgcacatgaaagctgcttacgggctccaaacctgatatcctataaacccatgattgaccagcttgagtgtaccactaatttgatcgatcctttcgtggtgtttgaaagaggttcactcccccaaacaaggaacgacaagacgttcgccgcaagtaagggcaatcgcggggtccaggcctttagcaaaggatctgttcaggctgatctgaccctaatgttcgacaactttgaggtggacttcgtaggcgcggccgtgtcctgcgatgcagcttttctgaacctcactgggtgctactcatgtaatgccggagcccgagtctgcctgagtattacaagcaccggcacaggtactctttccgctcacaacaaggacgggtctttgcatatcgtgctgccatcggaaaatggaaccaaagatcaatgtcagatattacacttcacggttcctgaggtggaggaagagtttatgtatagctgcgacggcgatgaacggcccctcctggtcaagggtacccttatcgcaattgacccattcgatgaccgtagagaggccggcggggagtcaacagtggttaacccgaaatccggaagttggaactttttcgattggttctctggcctgatgagctggtttgggggacctttgaagactatcctcctgatttgtctatacgtggcgctgtccatcggcctcttctttctgcttatatacttgggtaggaccgggctgtcaaagatgtggttagctgccacaaagaaggcatcttga

SEQ ID NO: 11202 - RNA, 3480 nt, synthetic construct
  misc_feature 1..3480: note = derived and/or modified CDS sequence (opt3) from RVFV(73HB1449)__DQ380211.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaacaatatcacatgtcacggtaaggaccctgaagataaaatttccttaatcaagggcccaccgcataaaaagcgcgtcgggatagttcgatgcgagcgtagaagggacgctaagcaaatcggacgggaaactatggccggcattgcaatgacggtgctgcccgccctagctgtattcgcactcgcccctgtggtctttgctgaggatccacatctgcgcaacagacccggtaaagggcacaattatatcgacggaatgacccaggaggatgccacatgtaagcctgtgacttacgcgggcgcatgttcttcgttcgacgttcttctggaaaaaggcaagtttccattgttccagtcatatgcccaccataggaccctcctggaggctgtgcacgatacaattatcgccaaagcagatccccctagctgcgacctgcagagtgctcacgggaacccatgcatgaaggaaaagctcgtcatgaaaacccattgtccgaatgactaccaatccgcccactatttaaacaatgatggaaagatggcgtctgtgaaatgtccccctaagtacgagctgactgaagactgcaacttttgccggcagatgacaggtgccagccttaaaaagggctcctatccattgcaggacctgttctgtcagtcaagtgaggatgacgggagcaaactaaagaccaagatgaaaggagtatgcgaggttggcgtgcaagcactcaagaaatgcgatggtcagctgtctacggctcatgaagtcgtgccctttgccgtgttcaaaaattccaagaaggtctaccttgacaagctggatttgaaaactgaggaaaacctcctgcctgactcatttgtttgtttcgagcacaaggggcagtacaaaggaaccatggatagcggccagacaaagcgcgaattaaaaagttttgacatatctcaatgcccaaagattggcgggcacggatccaagaaatgtactggtgatgctgccttctgcagcgcatatgagtgtaccgcccagtacgctaatgcgtattgctcgcatgcaaacggctctgggatcgtgcagattcaagtatccggagtgtggaagaaacccctgtgtgtcggctacgagcgagtggttgtgaagagagaactctcagccaaaccgatccagagggtcgagccttgcacaacctgtatcacgaagtgcgaaccccacggtcttgtggtacggagtactgggtttaagattagctccgctgttgcctgtgcatctggcgtgtgcgtcacaggaagccagaatccatcaaccgagataactctgaaatatcctggcatcagtcagtccagcgggggagacattggtgtgcatatggcccacgatgaccaatctgtctcaagtaagatcgtggctcattgtcccccacaggacccctgcttggttcacggctgcatagtgtgtgcccacgggctaattaactaccagtgccatacagcactgagcgcgttcgtagtcgtgttcgtgttttcctctatcgctatcatttgtctcgccatcctgtatcgtgttcttaaatgcctgaagattgcacctcgcaaagtcttgaatccactcatgtggataaccgccttcatcagatgggtgtacaagaaaatggtagctagggtggccgataacattaaccaggttaatcgggaaatcggatggatggagggcggtcaactggtcttagggaacccggcacccatccctcgacacgctccaattccccgctactcgacgtatctgatgctactcctgatagtgagctacgcctccgcgtgttcagagcttatccaggccagttctagaattaccacatgcagcactgaaggcgtgaataccaagtgtaggttgtccggaacagctctgatccgggcaggctcagtcggggccgaggcttgcctcatgctgaagggagttaaagacgatcagactaagtttcttaaaattaagaccgtgagctctgaactgtcctgtcgcgagggtcagagttattggacaggcagcttctctcctaaatgcttgtcctcaagaaggtgccatctcgtgggggagtgtcacgtaaaccgttgcctgagttggcgggacaatgaaaccagcgccgagttttcgttcgtcggagaatccactacgatgcgagagaacaagtgttttgaacaatgcggcggttgggggtgtggctgcttcaatgtgaacccatcttgtttatttgttcacacatacctgcagagcgtgagaaaggaggcactaagggtcttcaattgcatcgattgggtgcataaactcaccctggagataactgactttgatggatcagttagtaccatcgaccttggcgcgtcctctagccgcttcacaaactgggggtccgtgtcattgagcctggatgccgaaggaattagtggctctaattcctttagcttcatcgagtcgcccggtaaggggtatgctattgtagacgaaccgttctcagagatccctcggcagggatttctcggcgaaataagatgtaactctgagagttccgtcctgagcgcccacgagtcttgcttaagggcaccaaatctgattagctacaaacccatgatcgatcagcttgaatgtaccactaacttgattgaccctttcgtggtgtttgagcgcggttccctcccccaaacacgaaatgaaaagacgttcgctgcctcaaaaggcaaccgtggggtccaggcatttagtaagggaagcgttcaggccgatctgaccctaatgttcgacaactttgaggtggacttcgtaggcgctgcggtgtcttgcgatgccgcatttctgaatctcactgggtgctattcctgtaacgctggagcccgggtctgcctgtcaatcacaagtaccggcacaggtactcttagcgcccataataaggacgggtccttgcacatagtgctgccatctgaaaacggaaccaaagatcaatgtcagatcttacatttcacggttcctgaggtggaggaagagtttatgtactcgtgcgacggcgatgaaagacccctcctggtcaagggtacccttattgctatcgacccattcgatgacaggcgcgaggcaggcggggagagcacagtggttaatccgaaatcaggatcctggaactttttcgattggttcagtggcctgatgtcttggtttgggggacctttgaagactattctcctgatctgtctatacgtggccctgagcataggcctcttctttctgcttatttatttgggtcggaccgggctgtccaaaatgtggttagcggctacaaagaaggcctcatga

SEQ ID NO: 11203 - RNA, 3480 nt, synthetic construct
  misc_feature 1..3480: note = derived and/or modified CDS sequence (opt3) from RVFV(SA-51 (Van Wyck))__DQ380195.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaataatatcacatgtcacggtaaggaccctgaagataaaatttccttaatcaagggcccaccgcataaaaagcgcgtcgggatagttcgatgcgagcgtagaagggacgctaagcaaatcggacgggaaactatggccggcattgcaatgacggtgctgcccgccctagctgtattcgcactcgcccctgtggtctttgctgaggatccacatctgcgcaacagacccggtaaagggcacaattatatcgacggaatgacccaggaggatgccacatgtaagcctgtgacttacgcgggcgcatgttcttcgttcgacgttcttctggaaaaaggcaagtttccattgttccagtcatatgcccaccataggaccctcctggaggctgtgcacgatacaattatcgccaaagcagatccccctagctgcgacctgcagagtgctcacgggaacccatgcatgaaggaaaagctcgtcatgaaaacccattgtccgaatgactaccaatccgcccactatttaaacaatgatggaaagatggcgtctgtgaaatgtccccctaagtacgagctgactgaagactgcaacttttgccggcagatgacaggtgccagccttaaaaagggctcctatccattgcaggacctgttctgtcagtcaagtgaggatgacgggagcaaactaaagaccaagatgaaaggagtatgcgaggttggcgtgcaagcactcaagaaatgcgatggtcagctgtctacggctcatgaagtcgtgccctttgccgtgttcaaaaattccaagaaggtctaccttgacaagctggatttgaaaactgaggaaaacctcctgcctgactcatttgtttgtttcgagcacaaggggcagtacaaaggaaccatggatagcggccagacaaagcgcgaattaaaaagttttgacatatctcaatgcccaaagattggcgggcgaggatccaagaaatgtactggtgatgctgccttctgcagcgcatatgagtgtaccgcccagtacgctaatgcgtattgctcgcacgcaaacggctctgggatcgtgcagattcaagtatccggagtgtggaagaaacccctgtgtgtcggctacgagagagtggttgtgaagagggaactctcagccaaaccgatccagcgggtcgagccttgcacaacctgtatcacgaagtgcgaaccccatggtcttgtggtacgtagtactgggtttaagattagctccgctgttgcctgtgcatctggcgtgtgcgtcacaggaagccagtcaccaagtaccgagataactctgaaatatcctggcatctcccagagctctgggggagacattggtgtgcacatggcccatgatgaccaatcagtcagtagcaagatcgtggctcactgtcccccacaggacccctgcttggttcatggctgcatagtgtgtgcccacgggctaattaattaccagtgccacacagcactgtccgcgttcgtagtcgtgttcgtattttcttcggtggctatcatctgtctcgccattctgtataaagtccttaagtgcctgaaaatcgcacctcgcaaggtgttgaacccactcatgtggattaccgccttcataagatgggtatacaaaaagatggtggctagggttgccgataatatcaaccaggtcaaccgggaaattggatggatggagggcggtcaactggcattagggaatccggctcccatccctcgacatgccccaatcccccgctacagcacgtatctgatgctactcctgattgtgtcctacgcgtcagcctgtagtgagcttatacaggcttctagcagaatcaccacatgctccactgaaggcgtgaacaccaagtgtaggttgtcaggaacagcactgattcgggccggcagcgtcggggctgaggcctgcctcatgctgaaaggagttaaggaagaccagactaaatttcttaagatcaaaaccgtgtcttccgagctgagttgtcgcgagggtcagagctattggacaggctctttctcccctaagtgcttgtcaagtagaaggtgccacctcgtgggggaatgtcatgtaaatcgttgcctgagctggcgggataacgagacctcggcagaattttccttcgtcggagagtctactacgatgcgagaaaataagtgttttgagcaatgcggcggttgggggtgtggctgcttcaacgtgaatccaagctgtttatttgttcacacatacctgcagtcagtgagaaaagaggcgctaagggtcttcaactgcattgactgggtgcacaagctcaccctggaagttactgattttgacggaagtgtgtccaccatcgatcttggcgcctctagctcccgcttcacaaattgggggtcagttagcttgagtctggacgctgagggaatatctggctccaacagcttttcgttcatcgaatcacccggtaaagggtatgccattgtcgatgagccgttctctgaaatccctcggcagggatttctcggcgagattagatgtaatagtgagtccagcgtgctgtctgcacatgaaagctgcttaagggctccaaacctgatctcctacaagcccatgatagaccagcttgagtgtaccactaatttgattgatcctttcgtggtctttgaacgcggttcactcccccaaacacgaaacgacaaaacgttcgccgcaagtaagggcaatcgtggggttcaggcctttagcaagggatctgtgcaggctgatctgaccctaatgttcgacaactttgaggtagacttcgtgggcgcggccgtctcctgcgatgcagcttttctgaacctcactgggtgctattcatgtaatgccggagcccgggtgtgcctgagtatcacaagcaccggcacaggtactctttccgctcacaacaaagacgggtctttgcatattgttctgccatcggaaaatggaaccaaggatcaatgtcagatcttacacttcacggtgcctgaggtcgaggaagagtttatgtacagctgcgacggcgatgaaagacccctcctggtgaaaggtacccttatagcaatcgacccattcgatgacaggcgcgaggccggcggggagtcaacagttgtgaacccgaagtccggaagttggaactttttcgattggttctctggcctgatgagctggtttgggggacctttgaaaactattctcctgatctgtctatacgtcgcgctgtccattggcctcttctttctgcttatctatttgggtcggaccgggctgtcaaagatgtggttagctgccacaaagaaagcatcttga

SEQ ID NO: 11204 - RNA, 3480 nt, synthetic construct
  misc_feature 1..3480: note = derived and/or modified CDS sequence (opt3) from RVFV(KEN/Gar-Msq/131B-04/06)__HM586972.1__NSm-Gn-Gc
  source 1..3480: mol_type = other RNA
atgatcgagggcgcctgggacagcttcagagaagaggaaatgcccgaggaactgtcctgctctgtgtcagggattagggaggtcaagaccagtagccaggagctctaccgggctcttaaagcaataatcgccgcggatggactgaacaatattacatgtcacggtaagaaccctgaagacaaaatctccttgattaagggcccaccgcataaaaagcgcgttgggatcgtgcgatgcgagcgtagaagggatgctaagcaaataggacgggaaactatggccggcatcgcaatgacggtattacccgccctggctgtgtttgcactagcccctgtcgtgttcgctgaggacccacacctccgcaatagacccggtaaagggcataactatattgatggaatgacccaggaggacgccacatgtaagcctgttacttacgcgggcgcatgttcttcgtttgatgtgctgcttgaaaaaggcaagttcccactgtttcagtcatatgcccaccataggaccttgctcgaggctgtccacgacacaatcattgccaaagcagatccccctagctgcgacctgcagagtgctcacgggaatccatgcatgaaggaaaagctggtgatgaaaacccattgtccgaacgattaccaatccgcccactatctcaataacgacggaaagatggcgtctgtaaaatgtccccctaagtacgagttaactgaagattgcaatttctgccggcagatgacaggtgccagcctgaaaaagggctcctatccacttcaggacttgttttgtcagtcaagtgaggacgatgggagcaaactgaagaccaagatgaaaggagtttgcgaggtgggcgtccaagcactaaagaaatgcgacggtcagctctctacggctcatgaagtggtgcccttcgccgtctttaagaactccaaaaaggtttacctggataaacttgacctgaagactgaggaaaatttgctccctgattcattcgtgtgttttgagcacaaggggcagtacaaaggaaccatggacagcggccagacaaagcgcgaactgaaaagtttcgatatctctcaatgcccaaagataggcgggcacggatccaagaaatgtactggtgacgctgccttttgcagcgcatatgagtgtaccgcccagtacgctaacgcgtattgctcgcatgcaaatggctctgggattgtacagatccaagtgtccggagtctggaagaaacccttatgtgtgggctacgagcgagttgtggtcaagagagaactgtcagccaaaccgattcagagggtggagccttgcacaacctgtatcacgaagtgcgaaccccacggtctcgtagttcggagtactgggttcaagatcagctccgctgtggcctgtgcatctggcgtctgcgtgacaggaagccagtcaccaagtaccgagattactcttaaatatcctggcatatcccagagctctgggggagatatcggtgtccatatggcccacgacgatcaatcagtgagtagcaagattgttgctcattgtcccccacaggacccctgcctggtgcacggctgcatcgtatgtgcccacgggttgataaactaccagtgccatacagcactatccgcgttcgtcgtgatttttgttttctcttcgaccgctatcatctgtctggccgtgctctatcgtgtcctgaaatgccttaagattgcacctcgcaaagtgctgaatccattgatgtggatcacggcctttattagatgggtatacaagaaaatggtggctagggttgccgacaacataaaccaggtcaatcgggaaatcggatggatggagggcggtcaactcgcactggggaacccggctcccattcctcgacacgccccaatcccccgctacagcacctatttaatgctgctactcatcgtgtcctacgcgtcagcctgtagtgagctgattcaggcttctagcagaataacaacttgctccaccgaaggcgtgaatacaaagtgtaggctttcaggaactgcattgatccgggccggcagcgtcggggctgaggcctgcctgatgctcaagggagttaaagaagatcagaccaagttcctgaaaattaagacagtgtcttccgagcttagttgtcgcgagggtcagagctattggaccggctctttttcccctaaatgcctgtcaagtagaaggtgccatttggtgggggaatgtcacgtaaaccgttgcctcagctggcgggacaatgagacttcggcagagttctcctttgtcggagaatctacgacaatgcgagaaaacaagtgtttcgagcaatgcggcggttgggggtgtggctgctttaatgtgaacccaagctgtctgttcgttcacacctacttacagtcagtgagaaaggaggcgctgagggtctttaattgcatcgattgggtgcataaactaactctcgaaattaccgacttcgatggaagtgtttccacaatcgacctgggcgcctctagctcccgctttaccaactgggggtcagtgagccttagtttggatgctgagggaatatctggctccaatagcttctcgttcatcgaatcacccggtaaggggtatgccattgtagacgagccgttttctgaaatccctcggcagggattcctgggcgagattagatgtaacagtgagtccagcgtcctctctgcacacgaaagctgcctgagggctccaaatttagtgtcctacaaacccatgatcgatcagctggagtgtactacaaaccttatagacccttttgtggtcttcgaacgcggttcattgccccaaacgcgaaatgataagacctttgccgcaagtaaaggcaaccgtggggttcaggccttcagcaagggatctgtgcaggctgacctcactctgatgtttgataacttcgaggtagactttgtgggcgcggccgtctcctgcgacgcagctttcctaaatctgacagggtgctattcatgtaacgccggagcccgggtgtgcctcagtattaccagcacaggcactggtaccctgtccgctcataataaggatgggtctcttcacatcgttttgccatcggaaaacggaacgaaagaccaatgtcagattctgcattttaccgtgcctgaggtcgaggaagagttcatgtacagctgcgatggcgacgaaagacccttactcgtgaagggtacactgatcgcaatagatccatttgacgataggcgcgaggccggcggggagtcaactgttgtgaatccgaaatccggaagttggaacttcttcgactggttttctggccttatgagctggttcgggggacctctgaagaccatcttgctcatttgtctgtacgtcgcgctatccatcggcctgtttttcctcctgatttatcttggtcggacagggttgtcaaaaatgtggctggctgccactaagaaggcatcttga

SEQ ID NO: 11205 - RNA, 3480 nt, synthetic construct
  misc_feature 1..3480: note = derived and/or modified CDS sequence (opt3) from RVFV(2007001107)__EU574047.1__NSm-Gn-Gc
  source 1..3480: mol_type = other RNA
atgatcgagggcgcctgggacagcctgagagaagaggaaatgcccgaggaactctcctgctctgtgtcagggattagggaggtcaagaccagtaatcaggagctttaccgggctctgaaagcaataatcgccgcggatggattgaataacattacatgtcacggtaagaatcctgaagacaaaatcagcttaattaagggcccaccgcataaaaagcgcgttgggatcgtgcgatgcgagcgtagaagggatgctaagcaaataggacgggaaactatggccggcatcgcaatgacggtactgcccgccctagctgtgttcgcactcgcccctgtcgtgtttgctgaggacccacatctgcgcaacagacccggtaaagggcacaattatattgatggaatgacccaggaggacgccacatgtaagcctgttacttacgcgggcgcatgctcctctttcgatgtgcttctggaaaaaggcaagtttccattgttccagtcgtatgcccaccataggaccctcctggaggctgtccacgacacaatcattgccaaagcagatcccccttcatgtgacctgcagagcgctcacgggaacccatgcatgaaggaaaagctcgtgatgaaaacccattgtccgaatgattaccaaagtgcccactatttaaacaatgacggaaagatggcgtccgtaaaatgtccccctaagtacgagctgactgaagattgcaacttttgccggcagatgacaggtgcctctcttaaaaagggcagctatccattgcaggacctgttctgtcagtcctcagaggacgatgggagtaaactaaagaccaagatgaaaggagtttgcgaggtgggcgtccaagcactcaagaaatgcgacggtcagctgagcacggctcatgaagtggtgccctttgccgtcttcaaaaattctaaaaaggtttaccttgataagctggacttgaaaactgaggaaaacctcctgcctgattcctttgtgtgtttcgagcacaaggggcagtacaaaggaaccatggactcaggccagacaaagcgcgaattaaagagctttgatatcagtcaatgcccaaagataggcgggcacggatctaagaaatgtactggtgacgctgccttctgctccgcatatgagtgtaccgcccagtacgctaatgcgtattgcagccatgcaaacggctcggggattgtacagatccaagtgtctggagtctggaagaaacccctgtgtgtgggctacgagcgagttgtggtcaagagagaactctccgccaaaccgattcagagggtggagccttgcacaacctgtatcacgaagtgcgaaccccacggtcttgtagttcggtcaactgggtttaagatcagtagcgctgtggcctgtgcatccggcgtctgcgtgacaggatctcagagcccatcaaccgagattactctgaaatatcctggcataagtcagtccagcgggggagatatcggtgtccatatggcccacgacgatcaatctgtgtcaagtaagattgttgctcattgtcccccacaggacccctgcttggtgcacggctgcatcgtatgtgcccacgggctaataaattaccagtgccatacagcactgagcgcgttcgtcgtgattttcgtgttttcctctaccgctatcatctgtctcgccgttctgtatcgtgtccttaaatgcctgaagattgcacctcgcaaagtgttgaacccactcatgtggatcacggccttcattagatgggtatacaagaaaatggtggctagggttgccgacaacataaatcaggtcaaccgggaaatcggatggatggagggcggtcaactggcattagggaatccggctcccattcctcgacacgccccaatcccccgctactcgacctatctgatgctactcctgatcgtgagctacgcgtccgcctgttcagagcttattcaggctagttctagaataacaacttgcagcaccgaaggcgtgaacacaaagtgtaggttgtccggaactgcactgatccgggccggctcagtcggggctgaggcctgcctcatgctgaagggagttaaagaagatcagaccaagtttcttaaaattaagacagtgagctctgagctgtcctgtcgcgagggtcagagttattggaccggcagcttctctcctaaatgcttgtcctcaagaaggtgccatctcgtgggggaatgtcacgtaaatcgttgcctgagttggcgggacaacgagactagcgcagaattttcgttcgtcggagagtccacgacaatgcgagaaaataagtgttttgagcaatgcggcggttgggggtgtggctgcttcaacgtgaatccatcttgtttatttgttcacacctacctgcagagcgtgagaaaggaggcgctaagggtcttcaactgcatcgattgggtgcataaactcactctggaaattaccgactttgatggatcagttagtacaatcgaccttggcgcctcctctagccgcttcaccaattgggggtccgtgtcattgagcctggatgctgagggaataagtggctctaactcctttagcttcatcgaatcgcccggtaaggggtatgccattgtagacgagccgttctcagaaatccctcggcagggatttctcggcgagattagatgtaattctgagagttccgtcctgagcgcacacgaatcttgcttaagggctccaaacctggtgagctacaaacccatgatcgatcagcttgagtgtactacaaatttgatagaccctttcgtggtctttgaacgcggttccctcccccaaacgcgaaacgataagaccttcgccgcatcaaaaggcaaccgtggggttcaggcctttagtaagggaagcgtgcaggctgacctgactctaatgttcgataattttgaggtagacttcgtgggcgcggccgtctcttgcgacgcagcttttctgaacctcacagggtgctattcctgtaatgccggagcccgggtgtgcctgtcaattaccagtacaggcactggtacccttagcgctcataacaaggatgggtccttgcacatcgttctgccatctgaaaatggaacgaaagaccaatgtcagattttacatttcaccgtgcctgaggtcgaggaagagtttatgtactcgtgcgatggcgacgaaagacccctcctggtgaagggtacacttatcgcaatagatccattcgacgataggcgcgaggccggcggggagagcactgttgtgaacccgaaatcaggatcctggaactttttcgactggttcagtggcctgatgtcttggtttgggggacctttgaagaccatcctcctgatttgtctatacgtcgcgctgagcatcggcctcttctttctgcttatttatttgggtcggacagggctgtccaaaatgtggttagctgccactaagaaggcatcatga

SEQ ID NO: 11206 - RNA, 3480 nt, synthetic construct
  misc_feature 1..3480: note = derived and/or modified CDS sequence (opt3) from RVFV(ANK-3837)__DQ380215.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaataatatcacatgtcacggtaaggaccctgaagataaaatttccttaatcaagggcccaccgcataaaaagcgcgtcgggatagttcgatgcgagcgtagaagggacgctaagcaaatcggacgggaaactatggccggcattgcaatgacggtgctgcccgccctagctgtattcgcactcgcccctgtggtctttgctgaggatccacatctgcgcaacagacccggtaaagggcacaattatatcgacggaatgacccaggaggatgccacatgtaagcctgtgacttacgcgggcgcatgttcttcgttcgacgttcttctggaaaaaggcaagtttccattgttccagtcatatgcccaccataggaccctcctggaggctgtgcacgatacaattatcgccaaagcagatccccctagctgcgacctgcagagtgctcacgggaacccatgcatgaaggaaaagctcgtcatgaaaacccattgtccgaatgactaccaatccgcccactatttaaacaatgatggaaagatggcgtctgtgaaatgtccccctaagtacgagctgactgaagactgcaacttttgccggcagatgacaggtgccagccttaaaaagggctcctatccattgcaggacctgttctgtcagtcaagtgaggatgacgggagcaaactaaagaccaagatgaaaggagtatgcgaggttggcgtgcaagcactcaagaaatgcgatggtcagctgtctacggctcatgaagtcgtgccctttgccgtgttcaaaaattccaagaaggtctaccttgacaagctggatttgaaaactgaggaaaacctcctgcctgactcatttgtttgtttcgagcacaaggggcagtacaaaggaaagttagatagcggccagaccaaacgcgaactgaagagttttgacatatctcaatgcccaaagattggcgggcacggatccaaaaagtgtacaggtgatgctgccttctgcagcgcatatgagtgtactgcccagtacgctaatgcgtattgctcgcatgcaaacggctctgggatcgtgcagattcaagtatccggagtgtggaaaaagcccctctgtgtcggctacgagcgagtggttgtgaaaagagaactttcagccaagccgatccagagggtcgagccttgcaccacatgtatcaccaagtgcgaaccccacggtctggtggtacggagtacggggtttaaaattagctccgctgttgcctgtgcatctggcgtgtgcgtcactggaagccagtcaccaagtacagagataaccttgaagtatcctggcatctcccagagctctgggggagacattggtgtgcatatggcccacgatgaccaatcagtcagtagcaaaatcgtggctcattgtcccccacaggacccctgcctagttcacggctgcatagtgtgtgcccacgggctgattaattaccagtgccatactgcactctccgcgttcgtagtcgtgttcgtgttttcttcgatcgctatcatttgtctggccatcctttatcgtgttctgaagtgcttgaaaattgcacctcgcaaggtcctcaacccactgatgtggataacagccttcatcagatgggtgtacaggaaaatggtagctcgggtggccgataatattaaccaggttaaccgagaaatcggatggatggagggcggtcaattagtcctggggaatccggcacccatccctcgccacgtgccaattcccagatacagcacctatctaatgctcctgcttatagtgtcctacgcttcagcctgtagtgagttgatccaggcgtctagcaggattacgacctgctccacagaaggcgtcaacactaagtgtcggctgtcaggaaccgccctcatccgcgctggcagcgttggggcagaggcctgcctgatgcttaagggagtgaaagaagaccagacaaagtttctgaaaattaagactgtgtcttccgagttgagttgtagagagggtcagagctattggaccggctctttctcccctaaatgcctctcaagtaggcgttgccatctggtaggggaatgtcacgtcaatcggtgcttaagctggcgagataacgagacatcggctgaattttccttcgtgggagagtctaccactatgagagaaaataagtgttttgagcaatgcggcggttgggggtgtggctgcttcaacgttaatccaagctgtctgtttgtgcacacgtacctacagtcagtcaggaaggaggccctccgcgtgttcaactgcatcgactgggttcataaactgacacttgaaataaccgattttgacggaagtgtgtccactatcgatttgggcgcatctagctcccggttcaccaattgggggtcagtaagcctgagtctcgacgcggagggaatttctggctccaacagcttttcgttcatcgaatcacccggtaaggggtatgccattgtcgatgagccgttctctgaaatccctagacagggatttctgggcgagataaggtgtaatagtgagtccagcgtgttatctgctcacgaaagctgcctgcgcgccccaaaccttatttcctacaaacccatgatcgaccagttggagtgtacaaccaatctcattgatcctttcgtggtctttgaacgaggttcactgccccaaactcggaacgacaagacattcgcagctagtaaaggcaatcgtggggttcaggcctttagcaagggatctgtgcaggcagatctaacgctgatgttcgacaactttgaggtagacttcgtgggcgccgctgtctcctgcgatgcggcctttctcaacctgaccgggtgctattcatgtaatgcaggagctagagtgtgccttagtatcactagcacaggcaccggtacattgtccgcccataacaaggacgggtctctgcacatagttttaccatcggaaaatggaactaaagatcaatgtcagatcctccatttcaccgtgcctgaggtcgaggaagagtttatgtacagctgcgacggcgatgaaaggcccctgcttgtgcgcggtacgctgattgccatcgacccattcgatgaccggagagaggctggcggggagtcaaccgttgtgaacccgaagtccggaagttggaactttttcgattggttctctggcttgatgagctggtttgggggacctctcaaaacaattctgctaatctgtctgtacgtcgcactctccataggcctgttctttcttttgatttatctgggtaggactgggttatcaaagatgtggctcgccgcgaccaaaaaggcttcttga

SEQ ID NO: 11207 - RNA, 3480 nt, synthetic construct
  misc_feature 1..3480: note = derived and/or modified CDS sequence (opt3) from RVFV(Lunyo)__KU167026.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaataatatcacatgtcacggtaaggaccctgaagataaaatttccttaatcaagggcccaccgcataaaaagcgcgtcgggatagttcgatgcgagcgtagaagggacgctaagcaaatcggacgggaaactatggccggcattgcaatgacggtgctgcccgccctagctgtattcgcactcgcccctgtggtctttgctgaggatccacatctgcgcaacagacccggtaaagggcacaattatatcgacggaatgacccaggaggatgccacatgtaagcctgtgacttacgcgggcgcatgttcttcgttcgacgttcttctggaaaaaggcaagtttccattgttccagtcatatgcccaccataggaccctcctggaggctgtgcacgatacaattatcgccaaagcagatccccctagctgcgacctgcagagtgctcacgggaacccatgcatgaaggaaaagctcgtcatgaaaacccattgtccgaatgactaccaatccgcccactatttaaacaatgatggaaagatggcgtctgtgaaatgtccccctaagtacgagctgactgaagactgcaacttttgccggcagatgacaggtgccagccttaaaaagggctcctatccattgcaggacctgttctgtcagtcaagtgaggatgacgggagcaaactaaagaccaagatgaaaggagtatgcgaggttggcgtgcaagcactcaagaaatgcgatggtcagctgtctacggctcatgaagtcgtgccctttgccgtgttcaagaatagcaaaaaggtctaccttgacaagctggatttgaaaactgaggaaaacctcctgcctgactcatttgtttgtttcgagcacaaggggcagtacaaaggaaccatggtgagcggccagacaaagcgcgaattaaaaagttttgatatatctcaatgcccaaagattggcgggcacggatccaagaaatgtactggtgacgctgccttctgcagcgcatatgagtgtaccgcccagtacgctaatgcgtattgctcgcatgcaaacggctctgggatcgtacagattcaagtgtccggagtctggaagaaacccctgtgtgtgggctacgagcgagttgtggtcaagagagaactctcagccaaaccgatccagagggtggagccttgcacaacctgtatcacgaagtgcgaaccccacggtcttgtagttcggagtactgggtttaagattagctccgctgtggcctgtgcatctggcgtctgcgtgacaggaagccagtcaccaagtaccgagataactctgaaatatcctggcatctcccagagctctgggggagatattggtgtccatatggcccacgacgatcaatcagtgagtagcaagatcgttgctcattgtcccccacaggacccctgcttggtgcacggctgcatagtatgtgcccacgggctaattaattaccagtgccatacagcactgtccgcgttcgtcgtggttttcgtgttttcttcggtcgctatcatctgtctcgccattctgtataaagtgcttaagtgcctgaaaatcgcacctcgtaaggtattgaacccactcatgtggattaccgccttcatacgctgggtgtacaaaaagatggttgctagagtcgccgacaatatcaaccaggtgaacagggaaattggatggatggagggcggtcaactggcattagggaatccggctcccatccctcggcacgccccaatcccccgatacagcacgtatctgatgctactcctgattgtgtcctacgcgtcagcctgtagtgagcttatacaggcttctagccgcatcaccacatgctccactgaaggcgtcaacaccagatgtaggttgtcaggaacagcactgattcgggccggcagcgttggggctgaggcctgcctcatgctgaagggagtgaaagaagatcagactaagtttcttaaaatcaagaccgtgtcttccgagctgagttgtcgcgagggtcagagctattggacaggctctttctcccctaaatgcttgtcaagtagaaggtgccatctcgtaggggaatgtcacgtcaatcgttgcctgagctggcgggacaacgagacctcggcagaattttccttcgtgggagagtctactacgatgcgagaaaataagtgttttgagcaatgcggcggttgggggtgtggctgcttcaacgttaatccaagctgtttatttgtgcacacatacctgcagtcagtcagaaaggaggcgctaagggtgttcaactgcattgattgggttcataaactcaccctggaaatcactgactttgatggaagtgtgtccaccatagaccttggcgcctctagctcccgcttcacaaattgggggtcagtatccttgagtctggatgctgagggaatctctggctccaacagcttttcgttcattgaatcacccggtaaggggtatgccatcgtcgacgagccgttctctgaaattcctcggcagggatttctcggcgagatcagatgtaatagtgagtccagcgtgctgtctgcacacgaaagctgcttaagggctccaaacctgatatcctacaaacccatgattgatcagcttgagtgtaccactaatttgatcgaccctttcgtggtctttgaacgcggttcactcccccaaacacgaaacgataagacgttcgccgcaagtaaaggcaatcgtggggttcaggcctttagcaagggatctgtgcaggctgacctgaccctaatgttcgataactttgaggtagacttcgtgggcgcggccgtctcctgcgacgcagcttttctgaacctcactgggtgctattcatgtaatgccggagcccgggtgtgcctgagtattacaagcaccggcacaggtactctttccgctcataacaaggatgggtctttgcacatcgttctgccatcggaaaatggaaccaaagaccaatgtcagatattacatttcacggtgcctgaggtcgaggaagagtttatgtacagctgcgatggcgacgaaagacccctcctggtgaagggtacccttatcgcaattgatccattcgacgataggcgcgaggccggcggggagtcaacagttgtgaacccgaaatccggaagttggaactttttcgactggttctctggcctgatgagctggtttgggggacctttgaagactatcctcctgatttgtctatacgtcgcgctgtccatcggcctcttctttctgcttatatatttgggtcggaccgggctgtcaaaaatgtggttagctgccacaaagaaggcatcttga

SEQ ID NO: 11208 - RNA, 3480 nt, synthetic construct
  misc_feature 1..3480: note = derived and/or modified CDS sequence (opt3) from RVFV(RVFBJ01/2016)__KX785331.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaataatatcacatgtcacggtaaggaccctgaagataaaatttccttaatcaagggcccaccgcataaaaagcgcgtcgggatagttcgatgcgagcgtagaagggacgctaagcaaatcggacgggaaactatggccggcattgcaatgacggtgctgcccgccctagctgtattcgcactcgcccctgtggtctttgctgaggatccacatctgcgcaacagacccggtaaagggcacaattatatcgacggaatgacccaggaggatgccacatgtaagcctgtgacttacgcgggcgcatgttcttcgttcgacgttcttctggaaaaaggcaagtttccattgttccagtcatatgcccaccataggaccctcctggaggctgtgcacgatacaattatcgccaaagcagatccccctagctgcgacctgcagagtgctcacgggaacccatgcatgaaggaaaagctcgtcatgaaaacccattgtccgaatgactaccaatccgcccactatttaaacaatgatggaaagatggcgtctgtgaaatgtccccctaagcatgagctgactgaagactgcaacttttgccggcagatgacaggtgccagccttaaaaagggctcctacccattgcaggacctgttctgtcagtcaagtgaggatgacgggagcaaactaaagaccaagatgaaaggagtatgcgaggttggcgtgcaagcactcaagaaatgcgatggtcagctgtctacggctcacgaagtcgtgccctttgccgtgttcaaaaattccaagaaggtctatcttgacaagctggatttgaaaactgaggaaaacctcctgcctgactcatttgtttgtttcgagcacaaggggcagtacaaaggaaccatggatagcggccagacaaagcgcgaattaaaaagttttgacatatctcaatgcccaaagattggcgggcatggatccaagaaatgtactggtgatgctgccttctgcagcgcatacgagtgtaccgcccagtatgctaatgcgtactgctcgcacgcaaacggctctgggatcgtgcagattcaagtatccggagtgtggaagaaacccctgtgtgtcggctatgagcgagtggttgtgaagagagaactctcagccaaaccgatccagagggtcgagccttgcacaacctgtatcacgaagtgcgaaccccatggtcttgtggtacggagtactgggtttaagattagctccgctgttgcctgtgcatctggcgtgtgcgtcacaggaagccagtcaccaagtaccgagataactctgaaataccctggcatctcccagagctctgggggagacattggtgtgcacatggcccatgatgaccaatcagtcagtagcaagatcgtggctcactgtcccccacaggacccctgcttggttcacggctgcatagtgtgtgcccatgggctaattaattatcagtgccacacagcactgtccgcgttcgtagtcgtgttcgtgttttcttcggttgctatcatctgtctcgccattctgtacaaagtccttcgttgcctgaagatcgcacctaaaaaggtgttgaacccactcatgtggattaccgccttcatacgctgggtatataaaaagatggtggctagagttgccgataatatcaaccaggtcaacagggaaattggatggatggagggcggtcaactggcattagggaatccggctcccatccctcggcatgccccaatcccccgatacagcacgtacctgatgctactcctgattatatcctatgcgtcagcctgtagtgagcttatccaggcttctagccgcattaccacatgctccactgaaggcgtgaacaccaagtgtagattgtcaggaacagcactgatcagggccggcagcgtgggggctgaggcctgcctcatgctgaaaggagtcaaggaagaccagactaaatttcttaagattaaaaccgtttcttccgagctgagttgtcgggagggtcagagctactggacaggctctttctcccctaagtgcttgtcaagtcgcagatgccacctcgtgggggaatgtcacgtgaataggtgcctgagctggcgtgataacgagacctcggcagaattttccttcgtaggagagtctactacgatgcgggaaaataagtgttttgagcaatgcggcggttgggggtgtggctgcttcaacgtcaatccaagctgtttatttgtgcatacatatctgcagtcagttcgaaaagaggcgctaagagtgttcaactgcatcgactgggtccacaagctcaccctggaaataactgattttgacggaagtgtgtccaccatcgatcttggcgcctctagctccaggttcacaaattgggggtcagttagcttgagtctggacgctgagggaatttctggctccaacagcttttcgttcatcgaatcacccggtaaagggtacgccattgtggatgagccgttctctgaaatccctcgccagggatttctcggcgagatacggtgtaatagtgagtccagcgtactgtctgcacatgaaagctgcttaagagctccaaacctgatttcctataagcccatgatcgaccagcttgagtgtaccactaatttgattgatcctttcgtcgtgtttgaaaggggttcactcccccaaacacgcaacgacaaaacgttcgccgcaagtaagggcaatcgaggggtgcaggcctttagcaagggatctgtccaggctgatctgaccctaatgttcgacaactttgaggttgacttcgtgggcgcggccgtatcctgcgatgcagcttttctgaacctcactgggtgctactcatgtaatgccggagcccgggtgtgcctgagtatcacaagcaccggcacaggtactctttccgctcacaacaaagacgggtctttgcatatagtcctgccatcggaaaatggaaccaaggatcaatgtcagatcttacacttcacggtgcctgaggttgaggaagagtttatgtatagctgcgacggcgatgaacgtcccctcctggtgaaaggtacccttattgcaatcgacccattcgatgacagaagggaggccggcggggagtcaacagtcgtgaacccgaagtccggaagttggaactttttcgattggttctctggcctgatgagctggtttgggggacctttgaaaactattctcctgatctgtctatacgttgcgctgtccataggcctcttctttctgcttatttacttgggtcgcaccgggctgtcaaagatgtggttagctgccacaaagaaagcatcttga

SEQ ID NO: 11209 - RNA, 3480 nt, synthetic construct
  misc_feature 1..3480: note = derived and/or modified CDS sequence (opt3) from RVFV(Ken 199800523)__KU978777.1__NSm-Gn-Gc
  source 1..3480: mol_type = other RNA
atgatcgagggcgcctgggacagcctgagagaagaggaaatgcccgaggaactctcctgctctgtgtcagggattagggaggtcaagaccagtagccaggagctttaccgggctctgaaagcaataatcgccgcggatggattgaacaatattacatgtcacggtaagaaccctgaagacaaaatctccttaattaagggcccaccgcataaaaagcgcgttgggatcgtgcgatgcgagcgtagaagggatactaagcaaataggacgggaaacgatggctggcatcgccatgaccgtactgcccgcactagccgtgttcgctctcgcacctgtcgtgtttgccgaggacccacatctgcgcaatagacccggtaaagggcacaactatattgatggaatgacacaggaggacgctacttgtaagcctgttacctacgccggcgcgtgcagctcgttcgatgtgcttctggaaaaaggcaagtttccattgttccagtcatatgcacaccataggacactcctggaggccgtccacgacaccatcattgctaaagccgatccccctagctgtgacctgcagagtgcacacgggaatccatgcatgaaggaaaagctcgtgatgaaaactcattgtccgaacgattaccaatccgctcactatttaaataacgacggaaagatggcctctgtaaaatgtccccctaagtacgagctgacagaagattgcaatttttgccggcagatgaccggtgcgagccttaaaaagggctcctatccattgcaggacctgttctgtcagtcaagtgaggacgatgggagcaaactaaagacgaagatgaaaggagtttgcgaggtgggcgtccaagccctcaagaaatgcgacggtcagctgtctactgcacatgaagtggtgccctttgctgtcttcaagaactccaaaaaggtttaccttgataagctggacttgaaaaccgaggaaaatctcctgcctgattcatttgtgtgtttcgagcacaaggggcagtacaaaggaacaatggacagcggccagactaagcgcgaattaaaaagttttgatatctctcaatgcccaaagataggcgggcacggatccaagaaatgtaccggtgacgccgctttctgcagcgcctatgagtgtacagcacagtacgccaacgctttttgctcgcatgcgaatggctctgggattgtacagatccaagtgtccggagtctggaagaaacccctgtgtgtgggctatgagcgagttgtggtcaagagagaactctcagcaaaaccgattcagagggtggagccttgcaccacgtgtatcactaagtgcgaaccccacggtcttgtagttcggagtacagggttcaagatcagctccgccgtggcttgtgcctctggcgtctgcgtgaccggaagccagtcaccaagtactgagattacactgaaataccctggcatatcccagagctctgggggagatatcggtgtccatatggcacacgacgatcaatcagtgagtagcaagattgttgcccattgtcccccacaggacccctgcttggtgcacggctgcatcgtatgtgctcacgggctaataaactatcagtgccataccgccctgtccgcattcgtcgtggtttttgtgttctcttcgattgcgatcatctgtctcgctattctgtaccgtgtccttaaatgcctgaagatcgcccctcgcaaagtgttgaatccactcatgtggattacggcatttataagatgggtatataagaaaatggtggccagggttgctgacaacatcaaccaggtcaatcgggaaattggatggatggagggcggtcaactggtgttagggaacccggcccccatccctcgacacgcaccaatcccccgctacagcacctacctgatgctactcctgattgtgtcctatgcttcagcctgtagtgagcttatacaggcgtctagcagaatcacaacttgctccaccgaaggcgtcaatacaaagtgtaggttgtcaggaactgccctgattcgggctggcagcgttggggcagaggcctgcctcatgctgaagggagtgaaagaagatcagaccaagttccttaaaatcaagacagtgtcttccgagctgagttgtcgcgagggtcagagctactggaccggctctttttcccctaaatgcttgtcaagtagaaggtgccatctcgtaggggaatgtcacgtcaaccgttgcctgagctggcgggacaatgagacttcggctgagttctcctttgtgggagaatctacgacaatgcgagaaaacaagtgtttcgagcaatgcggcggttgggggtgtggctgctttaatgttaacccaagctgtttattcgtgcacacctatctgcagtcagtcagaaaggaggccctaagggtgtttaattgcattgattgggttcataaactcactctggaaatcaccgacttcgatggaagtgtgtccacaatagaccttggcgcatctagctcccgctttaccaactgggggtcagtatctttgagtctggatgcggagggaatctctggctccaatagcttctcgttcattgaatcacccggtaaggggtacgccatcgtcgacgagccgttttctgaaattcctcggcagggattcctcggcgagatcagatgtaacagtgagtccagcgtgctgaatgctcacgaatcttgcttaagggccccaaacctgataagctataaacccatgattgatcagcttgagtgtactacaaatttgatcgacccttttgtggtcttcgaacgcggttccctcccccaaacgcgaaacgataagacctttgcagcttcaaaaggcaaccgtggggttcaggccttcagtaagggaagcgtgcaggcagacctgactctaatgtttgataatttcgaggtagactttgtgggcgccgctgtctcttgcgacgcggccttcctgaacctcacagggtgctactcctgtaatgcaggagctcgggtgtgcctgtcaattaccagtacaggcactggtacccttagcgcccataacaaggaagggtccttgcacatcgttctgccatctgagaatggaacgaaagatcaatgtcagatattacattttaccgtgcctgaggtcgaagaggagttcatgtattcgtgcgacggcgatgaaagacccctcctggtgaagggtacacttatcgccattgacccatttgatgacaggcgcgaggctggcggggaaagcactgttgtgaacccgaaatcaggatcctggaatttcttcgattggtttagtggcctgatgtcttggttcgggggacctttgaagaccatcctcctgatttgtctatacgtcgcactgagcatcggcctctttttcctgcttatatacttgggtcggacagggctgtccaaaatgtggttagccgcgactaagaaggcttcatga

SEQ ID NO: 11210 - RNA, 3480 nt, synthetic construct
  misc_feature 1..3480: note = derived and/or modified CDS sequence (opt3) from RVFV__JQ068143.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaataatatcacatgtcacggtaaggaccctgaagataaaatttccttaatcaagggcccaccgcataaaaagcgcgtcgggatagttcgatgcgagcgtagaagggacgctaagcaaatcggacgggaaactatggccggcattgcaatgacggtgctgcccgccctagctgtattcgcactcgcccctgtggtctttgctgaggatccacatctgcgcaacagacccggtaaagggcacaattatatcgacggaatgacccaggaggatgccacatgtaagcctgtgacttacgcgggcgcatgttcttcgttcgacgttcttctggaaaaaggcaagtttccattgttccagtcatatgcccaccataggaccctcctggaggctgtgcacgatacaattatcgccaaagcagatccccctagctgcgacctgcagagtgctcacgggaacccatgcatgaaggaaaagctcgtcatgaaaacccattgtccgaatgactaccaatccgcccactatttaaacaatgatggaaagatggcgtctgtgaaatgtccccctaagtacgagctgactgaagactgcaacttttgccggcagatgacaggtgccagccttaaaaagggctcctatccattgcaggacctgttctgtcagtcaagtgaggatgacgggagcaaactaaagaccaagatgaaaggagtatgcgaggttggcgtgcaagcactcaagaaatgcgatggtcagctgtctacggctcatgaagtcgtgccctttgccgtgttcaaaaattccaagaaggtctaccttgacaagctggatttgaaaactgaggaaaacctcctgcctgactcatttgtttgtttcgagcacaaggggcagtacaaaggaaccatagatagcggccagacaaagcgcgaattaaaaagttttgacatttctcaatgcccaaagatcggcgggcacggatccaagaaatgtactggtgatgctgccttctgcagcgcatatgagtgtaccgcccagtacgctaatgcgtattgctcgcatgcaaacggctctgggattgtgcagatccaagtatccggagtgtggaagaaacccctgtgtgtcggctacgagcgagtggttgtgaagagagaactctcagccaaaccgatccagagggtcgagccttgcacaacctgtattacgaagtgcgaaccccacggtcttgtggtacggagtactgggtttaagataagctccgctgttgcctgtgcatctggcgtgtgcgtcacaggaagccagtcaccaagtaccgagatcactctgaaatatcctggcatttcccagagctctgggggagacatcggtgtgcatatggcccacgatgaccaatcagtcagtagcaagatagtggctcattgtcccccacaggacccctgcttggttcacggctgcattgtgtgtgcccacgggctaatcaattaccagtgccatacagcactgtccgcgttcgtagtcgtgttcgtgttttcttcggttgctatcatttgtctcgccatcctgtataaagtccttcgttgcctgaagattgcacctaaaaaggtgttgaacccactcatgtggataaccgccttcatccgctgggtatacaaaaagatggtggctagagttgccgataatattaaccaggtcaacagggaaatcggatggatggagggcggtcaactggcattagggaatccggctcccatccctcggcacgccccaattccccgatacagcacgtatctgatgctactcctgataatctcctacgcgtcagcctgtagtgagcttattcaggcttctagccgcatcaccacatgctccactgaaggcgtgaacaccaagtgtagattgtcaggaacagcactgattagggccggcagcgtgggggctgaggcctgcctcatgctgaaaggagtcaaggaagaccagactaaatttcttaagatcaaaaccgtttcttccgagctgagttgtcgggagggtcagagctattggacaggctctttctcccctaagtgcttgtcaagtcgcagatgccatctcgtgggggaatgtcacgtgaataggtgcctgagctggcgtgataacgagacctcggcagaattttccttcgtaggagagtctactacgatgcgggaaaataagtgttttgagcaatgcggcggttgggggtgtggctgcttcaacgtcaatccaagctgtttatttgtgcacacatacctgcagtcagttcgaaaagaggcgctaagagtgttcaactgcatagactgggtccataagctcaccctggaaatcactgattttgacggaagtgtgtccaccattgatcttggcgcctctagctccaggttcacaaattgggggtcagttagcttgagtctggacgctgagggaatctctggctccaacagcttttcgttcattgaatcacccggtaaagggtatgccatcgtggatgagccgttctctgaaatacctcgccagggatttctcggcgagattcggtgtaatagtgagtccagcgtactgtctgcacacgaaagctgcttaagagctccaaacctgatctcctacaagcccatgattgaccagcttgagtgtaccactaatttgatcgatcctttcgtcgtgtttgaaaggggttcactcccccaaacacgcaacgacaaaacgttcgccgcaagtaagggcaatcgaggggtgcaggcctttagcaagggatctgtccaggctgatctgaccctaatgttcgacaactttgaggttgacttcgtgggcgcggccgtatcctgcgatgcagcttttctgaacctcactgggtgctattcatgtaatgccggagcccgggtgtgcctgagtataacaagcaccggcacaggtactctttccgctcataacaaagacgggtctttgcacatcgtcctgccatcggaaaatggaaccaaggatcaatgtcagattttacatttcacggtgcctgaggttgaggaagagtttatgtacagctgcgacggcgatgaacgtcccctcctggtgaaaggtacccttatcgcaattgacccattcgatgacagaagggaggccggcggggagtcaacagtcgtgaacccgaagtccggaagttggaactttttcgattggttctctggcctgatgagctggtttgggggacctttgaaaactatcctcctgatatgtctatacgttgcgctgtccattggcctcttctttctgcttatctatttgggtcgcaccgggctgtcaaagatgtggttagctgccacaaagaaagcatcttga

SEQ ID NO: 11211 - RNA, 3480 nt, synthetic construct
  misc_feature 1..3480: note = derived and/or modified CDS sequence (opt3) from RVFV(200803169)__JF311384.1__NSm-Gn-Gc
  source 1..3480: mol_type = other RNA
atgatcgagggcgcctgggacagcctgagagaagaggaaatgcccgaggaactctcctgctctgtgtcagggattagggaggtcaagaccagtagccaggagctttaccgggctctgaaagcaataatcgccgcggatggattgaacaatattacatgtcacggtaagaaccctgaagacaaaatctccttaattaagggcccaccgcataaaaagcgcgttgggatcgtgcgatgcgagcgtagaagggatgctaagcaaataggacgggaaactatggccggcatcgcaatgacggtactgcccgccctagctgtgttcgcactcgcccctgtcgtgtttgctgaggacccacatctgcgcaatagacccggtaaagggcacaactatattgatggaatgacccaggaggacgccacatgtaagcctgttacttacgcgggcgcatgttcttcgttcgatgtgcttctggaaaaaggcaagtttccattgttccagtcatatgcccaccataggaccctcctggaggctgtccacgacacaatcattgccaaagcagatccccctagctgcgacctgcagagtgctcacgggaatccatgcatgaaggaaaagctcgtgatgaaaacccattgtccgaacgattaccaatccgcccactatttaaataacgacggaaagatggcgtctgtaaaatgtccccctaagtacgagctgactgaagattgcaatttttgccggcagatgacaggtgccagccttaaaaagggctcctatccattgcaggacctgttctgtcagtcaagtgaggacgatgggagcaaactaaagaccaagatgaaaggagtttgcgaggtgggcgtccaagcactcaagaaatgcgacggtcagctgtctacggctcatgaagtggtgccctttgccgtcttcaagaactccaaaaaggtttaccttgataagctggacttgaaaactgaggaaaatctcctgcctgattcatttgtgtgtttcgagcacaaggggcagtacaaaggaaccatggacagcggccagacaaagcgcgaattaaaaagttttgatatctctcaatgcccaaagataggcgggcacggatccaagaaatgtactggtgacgctgccttctgcagcgcatatgagtgtaccgcccagtacgctaacgcgtattgctcgcatgcaaatggctctgggattgtacagatccaagtgtccggagtctggaagaaacccctgtgtgtgggctacgagcgagttgtggtcaagagagaactctcagccaaaccgattcagagggtggagccttgcacaacctgtatcacgaagtgcgaaccccacggtcttgtagttcggagtactgggtttaagatcagctccgctgtggcctgtgcatctggcgtctgcgtgacaggaagccagtcaccaagtaccgagattactctgaaatatcctggcatatcccagagctctgggggagatatcggtgtccatatggcccacgacgatcaatcagtgagtagcaagattgttgctcattgtcccccacaggacccctgcttggtgcacggctgcatcgtatgtgcccacgggctaataaactaccagtgccatacagcactgtccgcgttcgtcgtgattttcgtattttcttcgaccgctatcatctgtctcgccgtgctgtatcgtgtccttaaatgcctgaagattgcacctcgcaaagtgttgaatccactcatgtggatcacggccttcattagatgggtatacaagaaaatggtggctagggttgccgacaacataaaccaggtcaatcgggaaatcggatggatggagggcggtcaactggcattagggaacccggctcccattcctcgacacgccccaatcccccgctacagcacctatctgatgctactcctgatcgtgtcctacgcgtcagcctgtagtgagcttattcaggcttctagcagaataacaacttgctccaccgaaggcgtgaatacaaagtgtaggttgtcaggaactgcactgatccgggccggcagcgtcggggctgaggcctgcctcatgctgaagggagttaaagtggatcagaccaagtttcttaaaattaagacagtgtcttccgaactgagttgtcgcgagggtcagagctattggaccggctctttctcccctaaatgcttgtcaagtagaaggtgccatctcgtaggggagtgtcacgtcaaccgttgcctgagctggcgggacaatgaaacttcggcagagttttccttcgtgggagaatctacgacaatgcgagagaacaagtgttttgaacaatgcggcggttgggggtgtggctgcttcaatgttaacccaagctgtttatttgtgcacacctacctgcagtcagtcagaaaggaggcgctaagggtgttcaattgcatcgattgggttcataaactcactctggagattaccgactttgatggaagtgtgtccacaatcgaccttggcgcctctagctcccgcttcaccaactgggggtcagttagcttgagtctggatgctgaaggaatatctggctccaatagcttttcgttcatcgagtcacccggtaaggggtatgccattgtcgacgaaccgttctctgagatccctcggcagggatttctcggcgaagtgagatgtaacagtgagtccagcgtgctgtctgcacacgagagctgcttaagggctccaaatctggtctcctacaaacccatgattgatcagcttgaatgtactacaaacttgatcgaccctttcgttgtgtttgagcgcggttcactcccccaaacgcgaaatgataagaccttcgccgcaagtaaaggcaaccgtggggtacaggcctttagcaagggatctgtgcaggctgacctgactctaatgttcgataactttgaagtcgacttcgtgggcgcggccgtttcctgcgacgcagcttttctgaatctcacagggtgctattcatgtaacgccggagcccgggtgtgcctgagtataaccagcacaggcactggtaccctttccgctcataataaggatgggtctttgcacattgtcctgccatcggagaacggaacgaaagaccaatgtcagatcttacatttcaccgtgcctgaagttgaggaggaatttatgtacagctgcgatggcgacgagagacccctcctggtgaagggtacacttattgcaatcgatccattcgacgataggcgcgaagccggcggggagtcaactgtcgtaaatccgaaatccggaagttggaactttttcgactggttctctggcctgatgagctggtttgggggacctttgaagaccatactcctgatctgtctatacgtggcgctgtccattggcctcttctttctgcttatctatttgggtcggacagggctgtcaaaaatgtggttagctgccactaagaaggcatcttga

SEQ ID NO: 11212 - RNA, 3480 nt, synthetic construct
  misc_feature 1..3480: note = derived and/or modified CDS sequence (opt3) from RVFV(2007002445)__EU574037.1__NSm-Gn-Gc
  source 1..3480: mol_type = other RNA
atgatcgagggcgcctgggacagcctgagagaagaggaaatgcccgaggaactctcctgctctgtgtcagggattagggaggtcaagaccagtagccaggagctttaccgggctctgaaagcaataatcgccgcggatggattgaacaatattacatgtcacggtaagaaccctgaagacaaaatctccttaattaagggcccaccgcataaaaagcgcgttgggatcgtgcgatgcgagcgtagaagggatgctaagcaaataggacgggaaactatggccggcatcgcaatgacggtactgcccgccctagctgtgttcgcactcgcccctgtcgtgtttgctgaggacccacatctgcgcaatagacccggtaaagggcacaactatattgatggaatgacccaggaggacgccacatgtaagcctgttacttacgcgggcgcatgttcttcgttcgatgtgcttctggaaaaaggcaagtttccattgttccagtcatatgcccaccataggaccctcctggaggctgtccacgacacaatcattgccaaagcagatccccctagctgcgacctgcagagtgctcacgggaatccatgcatgaaggaaaagctcgtgatgaaaacccattgtccgaacgattaccaatccgcccactatttaaataacgacggaaagatggcgtctgtaaaatgtccccctaagtacgagctgactgaagattgcaatttttgccggcagatgacaggtgccagccttaaaaagggctcctatccattgcaggacctgttctgtcagtcaagtgaggacgatgggagcaaactaaagaccaagatgaaaggagtttgcgaggtgggcgtccaagcactcaagaaatgcgacggtcagctgtctacggctcatgaagtggtgccctttgccgtcttcaagaactccaaaaaggtttaccttgataagctggacttgaaaactgaggaaaatctcctgcctgattcatttgtgtgtttcgagcacaaggggcagtacaaaggaaccatggacagcggccagacaaagcgcgaattaaaaagttttgatatctctcaatgcccaaagataggcgggcacggatccaagaaatgtactggtgacgctgccttctgcagcgcatatgagtgtaccgcccagtacgctaacgcgtattgctcgcatgcaaatggctctgggattgtacagatccaagtgtccggagtctggaagaaacccctgtgtgtgggctacgagcgagttgtggtcaagagagaactctcagccaaaccgattcagagggtggagccttgcacaacctgtatcacgaagtgcgaaccccacggtcttgtagttcggagtactgggtttaagatcagctccgctgtggcctgtgcatctggcgtctgcgtgacaggaagccagtcaccaagtaccgagattactctgaaatatcctggcatatcccagagctctgggggagatatcggtgtccatatggcccacgacgatcaatcagtgagtagcaagattgttgctcattgtcccccacaggacccctgcttggtgcacggctgcatcgtatgtgcccacgggctaataaactaccagtgccatacagcactgtccgcgttcgtcgtgattttcgtgttttcttcgaccgctatcatctgtctcgccgttctgtatcgtgtccttaaatgcctgaagattgcacctcgcaaagtgttgaatccactcatgtggatcacggccttcattagatgggtatacaagaaaatggtggctagggttgccgacaacataaaccaggtcaatcgggaaatcggatggatggagggcggtcaactggcattagggaacccggctcccattcctcgacacgccccaatcccccgctacagcacctatctgatgctactcctgatcgtgtcctacgcgtcagcctgtagtgagcttattcaggcttctagcagaataacaacttgctccaccgaaggcgtgaatacaaagtgtaggttgtcaggaactgcactgatccgggccggcagcgtcggggctgaggcctgcctcatgctgaagggagttaaagaagatcagaccaagtttcttaaaattaagacagtgtcttccgagctgagttgtcgcgagggtcagagctattggaccggctctttctcccctaaatgcttgtcaagtagaaggtgccatctcgtgggggaatgtcacgtaaaccgttgcctgagctggcgggacaatgagacttcggcagaattttccttcgtcggagagtctacgacaatgcgagaaaacaagtgttttgagcaatgcggcggttgggggtgtggctgcttcaatgtgaacccaagctgtttatttgttcacacctacctgcagtcagtgagaaaggaggcgctaagggtcttcaattgcatcgattgggtgcataaactcactctggaaattaccgactttgatggaagtgtttccacaatcgaccttggcgcctctagctcccgcttcaccaactgggggtcagtgagcttgagtctggatgctgagggaatatctggctccaatagcttttcgttcatcgaatcacccggtaaggggtatgccattgtagacgagccgttctctgaaatccctcggcagggatttctcggcgagattagatgtaacagtgagtccagcgtcctgtctgcacacgaaagctgcttaagggctccaaatctggtgtcctacaaacccatgatcgatcagcttgagtgtactacaaacttgatagaccctttcgtggtctttgaacgcggttcactcccccaaacgcgaaatgagaagaccttcgccgcaagtaaaggcaaccgtggggttcaggcctttagcaagggatctattcaggctgatctgactctaatgttcgacaactttgaagtggatttcgtaggcgcggccgtgtcctgcgacgcagcttttctgaatctcacagggtgctattcatgtaacgccggagcccgggtctgcctgagtatcaccagcacaggcactggtaccctttccgctcataataaggacgggtctttgcacattgtgctgccatcggagaacggaacgaaagatcaatgtcagatcttacatttcaccgttcctgaggtggaagaggaatttatgtacagctgcgacggcgatgagagacccctcctggtcaagggtacacttatagcaatcgacccattcgatgacaggcgcgaggccggcggggaatcaactgtggttaatccgaaatccggaagttggaactttttcgattggttctctggcctgatgagctggtttgggggacctttgaagaccattctcctgatctgtctatacgtggcgctgtccattggcctcttctttctgcttatctatttgggtcggacagggctgtcaaaaatgtggttagctgccactaagaaggcatcttga

SEQ ID NO: 11213 - RNA, 3480 nt, synthetic construct
  misc_feature 1..3480: note = derived and/or modified CDS sequence (opt3) from RVFV(Hv-B375)__DQ380218.1__NSm-Gn-Gc
  source 1..3480: mol_type = other RNA
atgatcgagggcgcctgggacagcctgagagaaggggagatgcccgaagaactctcctgctctatttcaggaataagggaagtgaagaccagtagccaggagctttaccgggctctgaaagcaatcattgccgcggatggtttgaacaatatcacatgtcacggcaaggaccctgaggataaaatttccttaatcaaggggccaccgcataaaaagcgcgtcggaatagttcgatgcgaacgtagaagggacgctaagcaaatcggccgggagactatggccggtattgcaatgacggtgctgcccgccctagctgtattcgcactcgcccctgtggtctttgctgaagatccacatctgcgcaacagacccgggaaaggacacaattatatcgacggcatgacccaggaggatgccacatgtaagcctgtgacttacgcgggcgcatgttcttcgttcgacgttcttctggagaaagggaagtttccattgttccagtcatatgcccaccataggaccctcctggaagctgtgcacgatacaattatcgccaaagcagatccccctagctgcgacctgcagagtgctcacggaaacccatgcatgaaggagaagctcgtcatgaaaacccattgtccgaatgactaccaatccgcccactatttaaacaatgatggtaagatggcgtctgtgaaatgtccccctaagaacgaactgactgaggactgcaatttttgccggcagatgacaggcgccagccttaaaaaggggtcctacccattgcaggacctgttctgtcagtcaagtgaagatgacggaagcaaactaaagaccaagatgaaaggcgtatgcgaggttggtgtgcaagcactcaagaaatgcgatgggcagctgtctacggctcatgaggtcgtgccctttgccgtgttcaagaactccaaaaaggtctatcttgacaagctggatttgaaaactgaagagaatctcctgcctgactcatttgtttgtttcgaacacaagggacagtacaaaggcaccatggatagcggccagacaaagcgcgagttaaaaagttttgacatatctcaatgcccaaagattgggggacacggttccaagaaatgtactggcgatgctgccttctgcagcgcatacgaatgtaccgcccagtatgctaacgcgtactgctcgcatgcaaatgggtctggaatcgtgcagattcaagtatccggcgtgtggaagaaacccctgtgtgtcggttatgagcgagtggttgtgaagagagagctctcagccaaaccgatccagagggtcgaaccttgcacaacctgtatcacgaagtgcgagccccacgggcttgtggtacggagtactggctttaagattagctccgctgttgcctgtgcatctggagtgtgcgtcacaggcagccagtcaccaagtaccgaaataactctgaaataccctgggatctcccagagctctggaggtgacattggcgtgcatatggcccacgatgaccaatcagtcagtagcaagatcgtggctcattgtcccccacaggacccctgcttggttcacgggtgcatagtgtgtgcccacggactaattaactatcagtgccatacagcactgtccgcgttcgtagtcgtgttcgtgttttcttcgatcgctatcatttgtctcgccatcctgtaccgtgttcttaaatgcctgaagattgcacctcgcaaagtcttgaatccactcatgtggataaccgccttcatcagatgggtgtataagaaaatggtagctagggtggccgataacattaaccaggttaatcgggagatcggctggatggaaggtgggcaactggtcttaggcaacccggcacccatccctcgacacgctccaattccccgctacagcacgtacctgatgctactcctgatagtgtcctatgcctcagcgtgtagtgagcttatccaggcctctagcagaattaccacatgctccactgagggagtgaataccaagtgtaggttgtcaggcacagctctgatccgggcagggagcgtcggagccgaggcttgcctcatgctgaagggtgttaaagaggaccagactaagtttcttaaaattaagaccgtgtcttccgaactgagttgtcgcgagggccagagctactggacagggtctttctcccctaaatgcttgtcaagtagaaggtgccatctcgtgggagagtgtcacgtaaaccgttgcctgagctggcgggataatgaaacctcggccgagttttccttcgtcggcgaatctactacgatgcgagagaacaagtgttttgaacaatgcggtgggtggggctgtggatgcttcaatgtgaacccaagctgtttatttgttcacacatatctgcagtcagtgagaaaggaggcactaagggtcttcaattgcatcgactgggtgcataaactcaccctggagataactgattttgacggcagtgtttccaccatcgatcttggggcgtctagctcccgcttcacaaactggggatcagtgagcttgagtctggacgccgaaggcatttctggttccaatagcttttcgttcatcgagtcacccgggaagggatacgctattgtagatgaaccgttctctgagatccctcggcagggctttctcggtgaaataagatgtaacagtgagtccagcgtcctgtctgcccacgagagctgcttaagggcaccaaatctgatttcctataaacccatgatcgaccagcttgaatgtaccactaacttgattgatcctttcgtggtgtttgagcgcggctcactcccccaaacacgaaatgacaagacgttcgctgccagtaaagggaaccggggagtccaggcatttagcaagggctctgttcaggccgatctgaccctaatgttcgacaactttgaagtggacttcgtaggggctgcggtgtcctgcgatgccgcatttctgaatctcactggatgctactcatgtaacgctggcgcccgtgtctgcctgagtatcacaagcaccggtacagggactctttccgcccataataaggacggatctttgcacatagtgctgccatcggagaacggcaccaaagatcaatgtcagatcttacatttcacggttcctgaagtggaggaggaatttatgtatagctgcgacggtgatgagagacccctcctggtcaagggcacccttattgctatcgacccattcgatgacaggcgcgaagcagggggagagtcaacagtggttaatccgaaatccggcagttggaactttttcgattggttctctgggctgatgagctggtttggaggccctttgaagactattctcctgatctgtctatacgtggccctgtccataggtctcttctttctgcttatttacttggggcggaccggactgtcaaaaatgtggttagcggctacaaagaaggcctcttga

SEQ ID NO: 11214 - RNA, 3480 nt, synthetic construct
  misc_feature 1..3480: note = derived and/or modified CDS sequence (opt3) from RVFV(clone 13)__DQ380213.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaacaatatcacatgtcacggtaaggaccctgaagataaaatttccttaatcaagggcccaccgcataaaaagcgcgtcgggatagttcgatgcgagcgtagaagggacgctaagcaaatcggacgggaaactatggccggcattgcaatgacggtgctgcccgccctagctgtattcgcactcgcccctgtggtctttgctgaggatccacatctgcgcaacagacccggtaaagggcacaattatatcgacggaatgacccaggaggatgccacatgtaagcctgtgacttacgcgggcgcatgttcttcgttcgacgttcttctggaaaaaggcaagtttccattgttccagtcatatgcccaccataggaccctcctggaggctgtgcacgatacaattatcgccaaagcagatccccctagctgcgacctgcagagtgctcacgggaacccatgcatgaaggaaaagctcgtcatgaaaacccattgtccgaatgactaccaatccgcccactatttaaacaatgatggaaagatggcgtctgtgaaatgtccccctaagcatgagctgactgaagactgcaacttttgccggcagatgacaggtgccagccttaaaaagggctcctacccattgcaggacctgttctgtcagtcaagtgaggatgacgggagcaaactaaagaccaagatgaaaggagtatgcgaggttggcgtgcaagcactcaagaaatgcgatggtcagctgtctacggctcacgaagtcgtgccctttgccgtgttcaaaaattccaagaaggtctatcttgacaagctggatttgaaaactgaggaaaacctcctgcctgactcatttgtttgtttcgagcacaaggggcagtacaaaggaaccatggatagcggccagacaaagcgcgaattaaaaagttttgacatatctcaatgcccaaagattggcgggcatggatccaagaaatgtactggtgatgctgccttctgcagcgcatacgagtgtaccgcccagtatgctaatgcgtactgctcgcacgcaaacggctctgggatcgtgcagattcaagtatccggagtgtggaagaaacccctgtgtgtcggctatgagcgagtggttgtgaagagagaactctcagccaaaccgatccagagggtcgagccttgcacaacctgtatcacgaagtgcgaaccccatggtcttgtggtacggagtactgggtttaagattagctccgctgttgcctgtgcatctggcgtgtgcgtcacaggaagccagaatccatcaaccgagataactctgaaataccctggcatcagtcagtccagcgggggagacattggtgtgcacatggcccatgatgaccaatctgtctcaagtaagatcgtggctcactgtcccccacaggacccctgcttggttcacggctgcatagtgtgtgcccatgggctaattaactatcagtgccacacagcactgagcgcgttcgtagtcgtgttcgtgttttcctctatcgctatcatttgtctcgccatcctgtaccgtgttcttaaatgcctgaagattgcacctcgcaaagtcttgaatccactcatgtggataaccgccttcatcagatgggtgtataagaaaatggtagctagggtggccgataacattaaccaggttaatcgggaaatcggatggatggagggcggtcaactggtcttagggaacccggcacccatccctcgacatgctccaattccccgctactcgacgtacctgatgctactcctgatagtgagctatgcctccgcgtgttcagagcttatccaggccagttctagaattaccacatgcagcactgaaggcgtgaataccaagtgtaggttgtccggaacagctctgatccgggcaggctcagtcggggccgaggcttgcctcatgctgaagggagttaaagacgatcagactaagtttcttaaaattaagaccgtgagctctgaactgtcctgtcgcgagggtcagagttactggacaggcagcttctctcctaaatgcttgtcctcaagaaggtgccacctcgtgggggagtgtcacgtaaaccgttgcctgagttggcgggacaatgaaaccagcgccgagttttcgttcgtcggagaatccactacgatgcgagagaacaagtgttttgaacaatgcggcggttgggggtgtggctgcttcaatgtgaacccatcttgtttatttgttcatacatatctgcagagcgtgagaaaggaggcactaagggtcttcaattgcatcgattgggtgcacaaactcaccctggagataactgactttgatggatcagttagtaccatcgaccttggcgcgtcctctagccgcttcacaaactgggggtccgtgtcattgagcctggatgccgaaggaattagtggctctaattcctttagcttcatcgagtcgcccggtaaggggtacgctattgtagacgaaccgttctcagagatccctcggcagggatttctcggcgaaataagatgtaactctgagagttccgtcctgagcgcccatgagtcttgcttaagggcaccaaatctgattagctataaacccatgatcgatcagcttgaatgtaccactaacttgattgaccctttcgtggtgtttgagcgcggttccctcccccaaacacgaaatgaaaagacgttcgctgcctcaaaaggcaaccgtggggtccaggcatttagtaagggaagcgttcaggccgatctgaccctaatgttcgacaactttgaggtggacttcgtaggcgctgcggtgtcttgcgatgccgcatttctgaatctcactgggtgctactcctgtaacgctggagcccgggtctgcctgtcaatcacaagtaccggcacaggtactcttagcgcccacaataaggacgggtccttgcatatagtgctgccatctgaaaacggaaccaaagatcaatgtcagatcttacacttcacggttcctgaggtggaggaagagtttatgtattcgtgcgacggcgatgaaagacccctcctggtcaagggtacccttattgctatcgacccattcgatgacaggcgcgaggcaggcggggagagcacagtggttaatccgaaatcaggatcctggaactttttcgattggttcagtggcctgatgtcttggtttgggggacctttgaagactattctcctgatctgtctatacgtggccctgagcataggcctcttctttctgcttatttacttgggtcggaccgggctgtccaaaatgtggttagcggctacaaagaaggcctcatga

SEQ ID NO: 11215 - RNA, 3480 nt, synthetic construct
  misc_feature 1..3480: note = derived and/or modified CDS sequence (opt3) from RVFV(Kenya 57 (Rintoul))__DQ380192.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagcttcaccgggctctgaaagcaatcattgccgcggatggattgaataatatcacatgtcatggtaaggaccctgaagataaaatttccttaatcaagggcccaccgcacaaaaagcgcgtcggggttgtgcgatgcgagcgtagaagggacgctaagcaaataggacgggaaactatggccggcatcgcaatgacggtactgcccgccctagctgtgttcgcactcgcccctgtcgtgtttgctgaggatccacatctgcgcaacagacccggtaaagggcacaattacattgacggaatgacccaggaggatgccacatgtaagcctgttacttatgcgggcgcatgttcttcgttcgacgtgcttctggaaaaaggcaagtttccattgttccagtcatacgcccatcacaggaccctcctggaggctgtccacgatacaatcattgccaaagcagatccccctagctgcgacctgcagagtgctcatgggaacccatgcatgaaggaaaagctcgtgatgaaaacccactgtccgaatgactatcaatccgcccattacttaaacaatgatggaaagatggcgtctgtaaaatgtccccctaagtatgagctgactgaagactgcaacttttgccggcagatgacaggtgccagccttaaaaagggctcctacccattgcaggacctgttctgtcagtcaagtgaggatgacgggagcaaactaaagaccaagatgaaaggagtttgcgaggtgggcgtccaagcactcaagaaatgcgatggtcagctgtctacggctcacgaagtggtgccctttgccgtcttcaaaaattccaagaaggtttatcttgacaagctggatttgaaaactgaggaaaacctcctgcctgactcatttgtgtgtttcgagcacaaggggcagtacaaaggaaccatggatagcggccagatcaagcgcgaattaaaaagttttgacatatctcaatgcccaaagattggcgggcatggatccaagaaatgtacaggtgatgctgccttctgcagcgcatacgagtgtactgcccagtatgctaatgcgtactgctcgcacgcaaacggctctgggatcgtacagattcaagtgtccggagtctggaagaaacccctgtgtgtgggctatgagcgagttgtggtcaagagagaactctcagccaaaccgatccagagggtggagccttgcaccacatgtatcaccaagtgcgaaccccatggtcttgtagttcggagtacggggtttaagattagctccgctgtggcctgtgcatctggcgtctgcgtgactggaagccagtcaccaagtacagagataaccctgaaataccctggcatctcccagagctctgggggagacattggtgtccacatggcccatgatgaccaatcagtgagtagcaagatcgttgctcactgtcccccacaggacccctgcttggtgcacggctgcatagtatgtgcccatgggctaattaattatcagtgccacactgcactgtccgcgttcgtcgtggttttcgtgttttcttcggtcgctatcatctgtctcgccattctgtacaaagtgcttaagtgcctgaaaatcgcacctcgtaaggtattgaacccactcatgtggattacagccttcatacgctgggtgtataaaaagatggttgctagagtcgccgataatatcaaccaggtgaacagggaaattggatggatggagggcggtcaactggtgttagggaatccggcacccatccctcggcatgctccaatcccccgatacagcacctacctgatgctactcctgattgtctcctatgcctcagcgtgtagtgagcttatacaggcctctagccgcatcacgacctgctccacagaaggcgttaacactaagtgtagattgtcaggaaccgctctgattagggcaggcagcgtgggggccgaggcttgcctcatgctgaaaggagtgaaggaagaccagacaaaatttcttaagatcaaaactgtatcttccgagctgagttgtcgggagggtcagagctactggaccggctctttctcccctaagtgcttgtcaagtcgcagatgccacctcgtcggggaatgtcacgtgaataggtgcctgagctggcgtgataacgagacatcggccgaattttccttcgttggagagtctaccactatgcgggaaaataagtgttttgagcaatgcggcggttgggggtgtggctgcttcaacgtgaatccaagctgtttatttgtccatacgtatctgcagtcagtgcgaaaagaggcactaagagttttcaactgcattgactgggtgcacaagctcacactggaaatcaccgattttgacggaagtgtatccactgtcgatcttggcgcgtctagctccaggttcaccaattgggggtcagtgagcttgagtctggacgccgagggaatatctggctccaacagcttttcgttcatcgaatcacccggtaaagggtacgctattgtggatgagccgttctctgaaatcagtcgccagggatttctcggcgagattcggtgtaattccgagagctctgtcctgagcgcccatgaatcctgcttaagagcacctaacctgatctcatataagccaatgatagaccagcttgagtgtacaaccaatttgattgatcccttcgttgtgtttgaaaggggtagtctccctcaaactcgcaacgacaaaacattcgctgccagcaagggcaatcgaggggtacaggcattttctaagggatccgtgcaggccgatctgacgctaatgttcgacaactttgaggtcgacttcgtgggcgctgcggtttcatgcgatgccgcatttctgaacctcaccgggtgctacagttgtaatgctggagcccgggtgtgcctgagcatcacttccacaggcaccggtacactttctgcccacaacaaagacgggtcgttgcatattgtcctgcccagcgaaaatggaactaaggatcaatgtcagatcttacacttcaccgtgccagaggttgaggaagagtttatgtattcatgcgacggcgatgaacgtcctctcctggtgaaaggtacgcttatagctatcgaccccttcgatgacagaagggaggcaggcggggagtccaccgtcgtaaacccaaagagtggatcttggaactttttcgattggttcagcggcctgatgtcctggtttgggggaccgttgaaaacaattctcctgatctgtctatacgtggccctgtcaattggcctcttctttctgcttatctacttgggtcgcactgggctgtctaagatgtggttagcggctaccaagaaagccagctga

SEQ ID NO: 11216 - RNA, 3480 nt, synthetic construct
  misc_feature 1..3480: note = derived and/or modified CDS sequence (opt3) from RVFV(2007001292)__EU574046.1__NSm-Gn-Gc
  source 1..3480: mol_type = other RNA
atgatcgagggcgcctgggacagcctgagagaagaggaaatgcccgaggaactctcctgctctgtgtcagggattagggaggtcaagaccagtagccaggagctttaccgggctctgaaagcaataatcgccgcggatggattgaacaatattacatgtcacggtaagaaccctgaagacaaaatctccttaattaagggcccaccgcataaaaagcgcgttgggatcgtgcgatgcgagcgtagaagggatgctaagcaaataggacgggaaactatggccggcatcgcaatgacggtactgcccgccctagctgtgttcgcactcgcccctgtcgtgtttgctgaggacccacatctgcgcaatagacccggtaaagggcacaactatattgatggaatgacccaggaggacgccacatgtaagcctgttacttacgcgggcgcatgttcttcgttcgatgtgcttctggaaaaaggcaagtttccattgttccagtcatatgcccaccataggaccctcctggaggctgtccacgacacaatcattgccaaagcagatccccctagctgcgacctgcagagtgctcacgggaatccatgcatgaaggaaaagctcgtgatgaaaacccattgtccgaacgattaccaatccgcccactatttaaataacgacggaaagatggcgtctgtaaaatgtccccctaagtacgagctgactgaagattgcaatttttgccggcagatgacaggtgccagccttaaaaagggctcctatccattgcaggacctgttctgtcagtcaagtgaggacgatgggagcaaactaaagaccaagatgaaaggagtttgcgaggtgggcgtccaagcactcaagaaatgcgacggtcagctgtctacggctcatgaagtggtgccctttgccgtcttcaagaactccaaaaaggtttaccttgataagctggacttgaaaactgaggaaaatctcctgcctgattcatttgtgtgtttcgagcacaaggggcagtacaaaggaaccatggacagcggccagacaaagcgcgaattaaaaagttttgatatctctcaatgcccaaagataggcgggcacggatccaagaaatgtactggtgacgctgccttctgcagcgcatatgagtgtaccgcccagtacgctaacgcgtattgctcgcatgcaaatggctctgggattgtacagatccaagtgtccggagtctggaagaaacccctgtgtgtgggctacgagcgagttgtggtcaagagagaactctcagccaaaccgattcagagggtggagccttgcacaacctgtatcacgaagtgcgaaccccacggtcttgtagttcggagtactgggtttaagatcagctccgctgtggcctgtgcatctggcgtctgcgtgacaggaagccagtcaccaagtaccgagattactctgaaatatcctggcatatcccagagctctgggggagatatcggtgtccatatggcccacgacgatcaatcagtgagtagcaagattgttgctcattgtcccccacaggacccctgcttggtgcacggctgcatcgtatgtgcccacgggctaataaactaccagtgccatacagcactgtccgcgttcgtcgtgattttcgtgttttcttcgaccgctatcatctgtctcgccgttctgtatcgtgtccttaaatgcctgaagattgcacctcgcaaagtgttgaatccactcatgtggatcacggccttcattagatgggtatacaagaaaatggtggctagggttgccgacaacataaaccaggtcaatcgggaaatcggatggatggagggcggtcaactggcattagggaacccggctcccattcctcgacacgccccaatcccccgctacagcacctatctgatgctactcctgatcgtgtcctacgcgtcagcctgtagtgagcttattcaggcttctagcagaataacaacttgctccaccgaaggcgtgaatacaaagtgtaggttgtcaggaactgcactgatccgggccggcagcgtcggggctgaggcctgcctcatgctgaagggagttaaagaagatcagaccaagtttcttaaaattaagacagtgtcttccgagctgagttgtcgcgagggtcagagctattggaccggctctttctcccctaaatgcttgtcaagtagaaggtgccatctcgtgggggaatgtcacgtaaaccgttgcctgagctggcgggacaatgagacttcggcagaattttccttcgtcggagagtctacgacaatgcgagaaaacaagtgttttgagcaatgcggcggttgggggtgtggctgcttcaatgtgaacccaagctgtttatttgttcacacctacctgcagtcagtgagaaaggaggcgctaagggtcttcaattgcatcgattgggtgcataaactcactctggaaattaccgactttgatggaagtgtttccacaatcgaccttggcgcctctagctcccgcttcaccaactgggggtcagtgagcttgagtctggatgctgagggaatatctggctccaatagcttttcgttcatcgaatcacccggtaaggggtatgccattgtagacgagccgttctctgaaatccctcggcagggatttctcggcgagattagatgtaacagtgagtccagcgtcctgtctgcacacgaaagctgcttaagggctccaaatctggtgtcctacaaacccatgatcgatcagcttgagtgtactacaaacttgatagaccctttcgtggtctttgaacgcggttcactcccccaaacgcgaaatgataagaccttcgccgcaagtaaaggcaaccgtggggttcaggcctttagcaagggatctgtgcaggctgacctgactctaatgttcgataactttgaggtagacttcgtgggcgcggccgtctcctgcgacgcagcttttctgaatctcacagggtgctattcatgtaacgccggagcccgggtgtgcctgagtattaccagcacaggcactggtaccctttccgctcataataaggatgggtctttgcacatcgttctgccatcggaaaacggaacgaaagaccaatgtcagattttacatttcaccgtgcctgaggtcgaggaagagtttatgtacagctgcgatggcgacgaaagacccctcctggtgaagggtacacttatcgcaatagatccattcgacgataggcgcgaggccggcggggagtcaactgttgtgaatccgaaatccggaagttggaacctgtttgactggttctctggcttgatgagctggttcgggggacctctcaagaccatcctgctaatttgtctgtacgtcgcgctctccatcggcctgtttttccttttgatttatctgggtcggacagggttatcaaaaatgtggctcgctgccactaagaaggcatcttga

SEQ ID NO: 11217 - RNA, 3480 nt, synthetic construct
  misc_feature 1..3480: note = derived and/or modified CDS sequence (opt3) from RVFV(2007001811)__EU574040.1__NSm-Gn-Gc
  source 1..3480: mol_type = other RNA
atgatcgagggcgcctgggacagcctgagagaagaggaaatgcccgaggaactctcctgctctgtgtcagggattagggaggtcaagacaagtagccaggagctttaccgggctctgaaagcaataatcgccgcggatggattgaacaatattacatgtcacggtaagaaccctgaagacaaaatctccttaattaagggcccaccgcataaaaagcgcgttgggatcgtgcgatgcgagcgtagaagggatgctaagcaaataggacgggaaactatggccggcatcgcaatgacggtactgcccgccctagctgtgttcgcactcgcccctgtcgtgtttgctgaggacccacatctgcgcaatagacccggtaaagggcacaactatattgatggaatgacccaggaggacgccacatgtaagcctgttacttacgcgggcgcatgcagctcgttcgatgtgcttctggaaaaaggcaagtttccattgttccagtcatatgcccaccataggaccctcctggaggctgtccacgacacaatcattgccaaagcagatccccctagctgtgacctgcagagtgctcacgggaatccatgcatgaaggaaaagctcgtgatgaaaacccattgtccgaacgattaccaatccgcccactatttaaataacgacggaaagatggcgtctgtaaaatgtccccctaagtacgagctgactgaagattgcaatttttgccggcagatgacaggtgccagccttaaaaagggctcctatccattgcaggacctgttctgtcagtcaagtgaggacgatgggagcaaactaaagaccaagatgaaaggagtttgcgaggtgggcgtccaagcactcaagaaatgcgacggtcagctgtctacggctcatgaagtggtgccctttgccgtcttcaagaactccaaaaaggtttaccttgataagctggacttgaaaactgaggaaaatctcctgcctgattcatttgtgtgtttcgagcacaaggggcagtacaaaggaaccatggacagcggccagacaaagcgcgaattaaaaagttttgatatctctcaatgcccaaagataggcgggcacggatccaagaaatgtactggtgacgctgccttctgcagcgcatatgagtgtaccgcccagtacgctaacgcgtattgctcgcatgcaaatggctctgggattgtacagatccaagtgtccggagtctggaagaaacccctgtgtgtgggctacgagcgagttgtggtcaagagagaactctcagccaaaccgattcagagggtggagccttgcacaacctgtatcacgaagtgcgaaccccacggtcttgtagttcggagtactgggtttaagatcagctccgctgtggcctgtgcatctggcgtctgcgtgacaggaagccagtcaccaagtaccgagattactctgaaatatcctggcatatcccagagctctgggggagatatcggtgtccatatggcccacgacgatcaatcagtgagtagcaagattgttgctcattgtcccccacaggacccctgcttggtgcacggctgcatcgtatgtgcccacgggctaataaactaccagtgccatacagcactgtccgcgttcgtcgtggttttcgtgttttcttcgattgctatcatctgtctcgccattctgtatcgtgtccttaaatgcctgaagatcgcacctcgcaaagtgttgaatccactcatgtggattaccgccttcataagatgggtatacaagaaaatggtggctagggttgccgacaacatcaaccaggtcaatcgggaaattggatggatggagggcggtcaactggtgttagggaacccggcacccatccctcgacacgctccaatcccccgctacagcacgtatctgatgctactcctgattgtgtcctacgcctcagcgtgtagtgagcttatacaggcctctagcagaatcaccacatgctccactgaaggcgtcaataccaagtgtaggttgtcaggaacagctctgattcgggcaggcagcgttggggccgaggcttgcctcatgctgaagggagtgaaagaagatcagactaagtttcttatgatcaaaaccgtgtcttccgagctgagttgtcgcgagggtcagagctattggacaggctctttctcccctaagtgcttgtcaagtagaaggtgccatctcgtaggggaatgtcacgtcaaccgttgcctgagctggcgggacaatgagacctcggccgaattttccttcgtgggagagtctactacgatgcgagaaaacaaatgttttgagcaatgcggcggttgggggtgtggctgcttcaatgttaacccaagctgtttatttgtgcacacatacctgcagtcagtcagaaaggaggcactaagggtgttcaattgcattgattgggttcataagctcaccctggaaatcactgactttgatggaagtgtgtccaccatagaccttggcgcgtctagctcccgcttcacaaactgggggtcagtatctttgagtctggatgccgagggaatctctggctccaatagcttttcgttcattgaatcacccggtaaagggtatgctatcgtcgacgagccgttctctgaaattcctcggcagggatttctcggcgagatcagatgtaacagtgagtccagcgtgctgtctgcccacgaaagctgcttaagggcaccaaatctgatatcctacaagcccatgattgatcagcttgagtgtaccactaacttgatcgaccctttcgtggtctttgaacgcggttcactcccccaaacacgaaatgagaaaacgttcgctgccagtaagggcaaccgtggggttcaggcatttagcaaaggatctgtgcaggccgatctgaccctaatgttcgacaactttgaagtagatttcgtgggcgctgcggtctcctgcgacgccgcatttctgaatctcactgggtgctattcatgtaacgctggagcccgggtgtgcctgagtattacaagcaccggcacaggtactctttccgcccataataaggacgggtctttgcacatcgttctgccatcggagaacggaaccaaggatcaatgtcagatattacatttcacggtgcctgaggtcgaagaggaatttatgtacagctgcgacggcgatgagagacccctcctggtgaaaggtacccttatcgctattgacccattcgatgacaggcgcgaggcaggcggggaatcaacagttgtgaatccgaagtccggaagttggaactttttcgattggttctctggcctgatgagctggtttgggggacctttgaaaactatcctcctgatttgtctatacgtcgccctgtccatcggcctcttctttctgcttatatatttgggtcggaccgggctgtcaaagatgtggttagcggctaccaaaaaggcctcttga

SEQ ID NO: 11218 - RNA, 3480 nt, synthetic construct
  misc_feature 1..3480: note = derived and/or modified CDS sequence (opt3) from RVFV(ANK-6087)__DQ380216.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaataatatcacatgtcacggtaaggaccctgaagataaaatttccttaatcaagggcccaccgcataaaaagcgcgtcgggatagttcgatgcgagcgtagaagggacgctaagcaaatcggacgggaaactatggccggcattgcaatgacggtgctgcccgccctagctgtattcgcactcgcccctgtggtctttgctgaggatccacatctgcgcaacagacccggtaaagggcacaattatatcgacggaatgacccaggaggatgccacatgtaagcctgtgacttacgcgggcgcatgttcttcgttcgacgttcttctggaaaaaggcaagtttccattgttccagtcatatgcccaccataggaccctcctggaggctgtgcacgatacaattatcgccaaagcagatccccctagctgcgacctgcagagtgctcacgggaacccatgcatgaaggaaaagctcgtcatgaaaacccattgtccgaatgactaccaatccgcccactatttaaacaatgatggaaagatggcgtctgtgaaatgtccccctaagtacgagctgactgaagactgcaacttttgccggcagatgacaggtgccagccttaaaaagggctcctatccattgcaggacctgttctgtcagtcaagtgaggatgacgggagcaaactaaagaccaagatgaaaggagtatgcgaggttggcgtgcaagcactcaagaaatgcgatggtcagctgtctacggctcatgaagtcgtgccctttgccgtgttcaaaaattccaagaaggtctaccttgacaagctggatttgaaaactgaggaaaacctcctgcctgactcatttgtttgtttcgagcacaaggggcagtacaaaggaaagttagatagcggccagaccaaacgcgaactgaagagttttgacatatctcaatgcccaaagattggcgggcacggatccaaaaagtgtacaggtgatgctgccttctgcagcgcatatgagtgtactgcccagtacgctaatgcgtattgctcgcatgcaaacggctctgggatcgtgcagattcaagtatccggagtgtggaaaaagcccctctgtgtcggctacgagcgagtggttgtgaaaagagaactttcagccaagccgatccagagggtcgagccttgcaccacatgtatcaccaagtgcgaaccccacggtctggtggtacggagtacggggtttaaaattagctccgctgttgcctgtgcatctggcgtgtgcgtcactggaagccagtcaccaagtacagagataaccttgaagtatcctggcatctcccagagctctgggggagacattggtgtgcatatggcccacgatgaccaatcagtcagtagcaaaatcgtggctcattgtcccccacaggacccctgcctagttcacggctgcatagtgtgtgcccacgggctgattaattaccagtgccatactgcactctccgcgttcgtagtcgtgttcgtgttttcttcgatcgctatcatttgtctggccatcctttatcgtgttctgaagtgcttgaaaattgcacctcgcaaggtcctcaacccactgatgtggataacagccttcatcagatgggtgtacaggaaaatggtagctcgggtggccgataatattaaccaggttaaccgagaaatcggatggatggagggcggtcaattagtcctggggaatccggcacccatccctcgccacgtgccaattcccagatacagcacctatctaatgctcctgcttatagtgtcctacgcttcagcctgtagtgagttgatccaggcgtctagcaggattacgacctgctccacagaaggcgtcaacactaagtgtcggctgtcaggaaccgccctcatccgcgctggcagcgttggggcagaggcctgcctgatgcttaagggagtgaaagaagaccagacaaagtttctgaaaattaagactgtgtcttccgagttgagttgtagagagggtcagagctattggaccggctctttctcccctaaatgcctctcaagtaggcgttgccatctggtaggggaatgtcacgtcaatcggtgcttaagctggcgagataacgagacatcggctgaattttccttcgtgggagagtctaccactatgagagaaaataagtgttttgagcaatgcggcggttgggggtgtggctgcttcaacgttaatccaagctgtctgtttgtgcacacgtacctacagtcagtcaggaaggaggccctccgcgtgttcaactgcatcgactgggttcataaactgacacttgaaataaccgattttgacggaagtgtgtccactatcgatttgggcgcatctagctcccggttcaccaattgggggtcagtaagcctgagtctcgacgcggagggaatttctggctccaacagcttttcgttcatcgaatcacccggtaaggggtatgccattgtcgatgagccgttctctgaaatccctagacagggatttctgggcgagataaggtgtaatagtgagtccagcgtgttatctgctcacgaaagctgcctgcgcgccccaaaccttatttcctacaaacccatgatcgaccagttggagtgttcaacaaatctcattgatcctttcgtggtctttaagcgaggtagtctgccccaaacccggaacgacaaaactttcgcagctagcaagggcaatcgtggggttcaggccttttctaagggatccgtgcaggcagatctaacactgatgttcgacaactttgaagtagacttcgtgggcgccgctgtctcatgcgatgcggcctttctcaacctgacggggtgctatagttgtaatgcaggagctagagtgtgccttagcatcacctccactggcacaggtaccttgtctgcccataacaaagacgggtcgctgcacatagttttaccaagcgagaatggaacaaaggatcaatgtcagatcctccatttcactgtgcctgaagtcgaggaggaatttatgtactcatgcgacggcgatgagaggcccctgcttgtgcgcggtaccctgattgccatcgacccattcgatgaccggagagaagctggcggggagtccacggttgtgaacccgaaaagtggatcttggaactttttcgattggttcagcggcttgatgtcctggtttgggggacctctcaagaccattctgctaatctgtctgtacgtcgcactctcaataggcctgttctttcttttgatttatctgggtaggacagggttatctaaaatgtggctcgccgcgactaagaaggctagctga

SEQ ID NO: 11219 - RNA, 3480 nt, synthetic construct
  misc_feature 1..3480: note = derived and/or modified CDS sequence (opt3) from RVFV(2007000234)__JF326191.1__NSm-Gn-Gc
  source 1..3480: mol_type = other RNA
atgatcgagggcgcctgggacagcctgagagaagaggaaatgcccgaggaactctcctgctctgtgtcagggattagggaggtcaagaccagtagccaggagctttaccgggctctgaaagcaataatcgccgcggatggattgaacaatattacatgtcacggtaagaaccctgaagacaaaatctccttaattaagggcccaccgcataaaaagcgcgttgggatcgtgcgatgcgagcgtagaagggatgctaagcaaatacggcgcgaaactatggccggaatcgcaatgacggtactgcccgccctagctgtgttcgcactcgcccctgtcgtgtttgctgaggacccacacctgagaaataggcccggcaaaggtcataactatattgatgggatgacccaggaggacgccacatgtaagcctgttacttacgcgggagcatgttcttcgttcgatgtgcttctggaaaaaggcaagtttccattgttccagtcatatgcccaccatcggaccctcctggaggctgtccacgacacaatcattgccaaagcagatccccctagctgcgacctgcagagtgctcacggcaatccatgcatgaaggaaaagctcgtgatgaaaacccattgtccgaacgattaccaatccgcccactatttaaataacgacgggaagatggcgtctgtaaaatgtccccctaagtacgagctgactgaagattgcaatttttgccgccagatgacaggagccagccttaaaaagggttcctatccattgcaggacctgttctgtcagtcaagtgaggacgatggcagcaaactaaagaccaagatgaaaggggtttgcgaggtgggagtccaagcactcaagaaatgcgacggccagctgtctacggctcatgaagtggtgccctttgccgtcttcaagaactccaaaaaggtttaccttgataagctggacttgaaaactgaggaaaatctcctgcctgattcatttgtgtgtttcgagcacaagggtcagtacaaagggaccatggacagcggacagacaaagcgagaattaaaaagttttgatatctctcaatgcccaaagataggcggccacgggtccaagaaatgtactggagacgctgccttctgcagcgcatatgagtgtaccgcccagtacgctaacgcgtattgctcgcatgcaaatggttctggcattgtacagatccaagtgtccggggtctggaagaaacccctgtgtgtgggatacgagagagttgtggtcaagagggaactctcagccaaaccgattcagcgggtggagccttgcacaacctgtatcacgaagtgcgaaccccacggccttgtagttcgtagtactggttttaagatcagctccgctgtggcctgtgcatctggggtctgcgtgacaggcagccagtcaccaagtaccgagattactctgaaatatcctggaatatcccagagctctggcggggatatcggagtccatatggcccacgacgatcaatcagtgagtagcaagattgttgctcattgtcccccacaggacccctgcttggtgcacggttgcatcgtatgtgcccacggcctaataaactaccagtgccatacagcactgtccgcgttcgtcgtgattttcgtgttttcttcgaccgctatcatctgtctcgccgttctgtatcgcgtccttaaatgcctgaagattgcacctagaaaagtgttgaatccactcatgtggatcacggccttcattaggtgggtatacaagaaaatggtggctcgggttgccgacaacataaaccaggtcaatcgagaaatcgggtggatggagggaggccaactggcattaggtaacccggctcccattcctcgccacgccccaatccccagatacagcacctatctgatgctactcctgatcgtgtcctacgcgtcagcctgtagtgagcttattcaggcttctagcaggataacaacttgctccaccgaaggggtgaatacaaagtgtcggttgtcaggcactgcactgatccgcgccggaagcgtcggcgctgaggcctgcctcatgctgaagggggttaaagaagatcagaccaagtttcttaaaattaagacagtgtcttccgagctgagttgtagagagggacagagctattggaccggttctttctcccctaaatgcttgtcaagtaggcgttgccatctcgtgggcgaatgtcacgtaaaccggtgcctgagctggcgagacaatgagacttcggcagaattttccttcgtcggggagtctacgacaatgagagaaaacaagtgttttgagcaatgcggaggctggggttgtgggtgcttcaatgtgaacccaagctgtttatttgttcacacctacctgcagtcagtgaggaaggaggcgctacgcgtcttcaattgcatcgattgggtgcataaactcactctggaaattaccgactttgatggcagtgtttccacaatcgaccttggagcctctagctcccggttcaccaactggggctcagtgagcttgagtctggatgctgaggggatatctggatccaatagcttttcgttcatcgaatcacccggcaagggttatgccattgtagacgagccgttctctgaaatccctagacaggggtttctcggagagattaggtgtaacagtgagtccagcgtcctgtctgcacacgaaagctgcttacgcgctccaaatctggtgtcctacaaacccatgatcgatcagcttgagtgtactacaaacttgatagaccctttcgtggtctttgaacgaggctcactcccccaaacgcggaatgataagaccttcgccgcaagtaaaggtaaccgtggcgttcaggcctttagcaaggggtctgtgcaggctgacctgactctaatgttcgataactttgaggtagacttcgtgggagcggccgtctcctgcgacgcagcttttctgaatctcacaggctgctattcatgtaacgccggggccagagtgtgcctgagtattaccagcacaggaactggcaccctttccgctcataataaggatggttctttgcacatcgttctgccatcggaaaacgggacgaaagaccaatgtcagattttacatttcaccgtgcctgaggtcgaggaagagtttatgtacagctgcgatggagacgaaaggcccctcctggtgaagggcacacttatcgcaatagatccattcgacgatcgccgggaggccggtggcgagtcaactgttgtgaatccgaaatccgggagttggaactttttcgactggttctctggactgatgagctggtttggcgggcctttgaagaccatcctcctgatttgtctatacgtcgcgctgtccatcggactcttctttctgcttatttatttgggcagaacaggtctgtcaaaaatgtggttagctgccactaagaaggcatcttga

SEQ ID NO: 11220 - RNA, 3480 nt, synthetic construct
  misc_feature 1..3480: note = derived and/or modified CDS sequence (opt3) from RVFV(SA-75)__DQ380189.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaataatatcacatgtcacggtaaggaccctgaagataaaatttccttagtcaagggcccaccgcataaaaagcgcgttgggatcgtgcgatgcgagcgtagaagggacgctaagcaaataggacgggaaactatggcccgcatcgcaatgacggtactgcccgccctagctgtgttcgcactcgcccctgtcgtgtttgctgaggatccacacctgagaaacaggcccggcaaaggtcataattatattgacgggatgacccaggaggatgccacatgtaagcctgttacttacgcgggagcatgttcttcgttcgacgtgcttctggaaaaaggcaagtttccattgttccagtcatatgcccaccatcggaccctcctggaggctgtccacgatacaatcattgccaaagcagatccccctagctgcgacctgcagagtgctcacggcaacccatgcatgaaggaaaagctcgtgatgaaaacccattgtccgaatgactaccaatccgcccactatttaaacaatgatgggaagatggcgtctgtaaaatgtccccctaagtacgagctgactgaagactgcaacttttgccgccagatgacaggagccagccttaaaaagggttcctatccattgcaggacctgttctgtcagtcaagtgaggatgacggcagcaaactaaagaccaagatgaaaggggtttgcgaggtgggagtccaagcactcaagaaatgcgatggccagctgtctacggctcatgaagtggtgccctttgccgtcttcaaaaattccaagaaggtttaccttgacaagctggatttgaaaactgaggaaaacctcctgcctgactcatttgtgtgtttcgagcacaagggtcagtacaaagggaccatggatagcggacagacaaagcgagaattaaaaagttttgacatctctcaatgcccaaagataggcggccacgggtccaagaaatgtactggagatgctgccttctgcagcgcatatgagtgtaccgcccagtacgctaatgcgtattgctcgcatgcaaacggttctggcgtagtgcagattcaagtctccggggtgtggaagaaacccctgtgtgttggatacgagagagtggtcgtgaagagggaactctcagccaaaccgatccagcgggtagagccttgcacaacctgtattacgaagtgcgaaccccacggccttgttgtgcgtagtactggttttaagatcagctccgctgtcgcctgtgcatctggggtgtgcgtcacaggcagccagtcaccaagtaccgagatcactctgaaatatcctggaatttcccagagctctggcggggacataggagtgcatatggcccacgatgaccaatcagttagtagcaagatcgtggctcattgtcccccacaggacccctgcttggtacacggttgcattgtctgtgcccacggcctaatcaattaccagtgccatacagcactgtccgcgttcgtggttgtgttcgtcttttcttcggtggctataatttgtctcgccatcctgtataaagtacttaagtgcctgaaaatcgcacctcgcaaggtgttgaacccactcatgtggattaccgttttcatcagatgggtctacaaaaagatggtggccagggtggctgataatattaaccaggtcaaccgggaaatagggtggatggagggaggccaactggccttaggtaatccggcacccatccctcgacacgctccaattccccgctacagcacgtatctgatgctactcctgatcgtttcctacgcctcagcgtgtagtgagcttatccaggcctctagcagaattaccacatgctccactgaaggggtgaacaccaagtgtaggttgtcaggcacagctctgatacgggcaggaagcgtgggcgccgaggcttgcctcatgctgaaaggggtaaaggaagaccagactaaatttcttaagatcaaaaccgtctcttccgagctgagttgtcgcgagggacagagctattggacaggttctttctcccctaagtgcttgtcaagtagaaggtgccatctcgtgggcgaatgtcacgttaatcgttgcctgagctggcgggataacgagacctcggccgaattttccttcgtgggggagtctactacgatgcgagaaaataagtgttttgagcaatgcggaggctggggttgtgggtgcttcaacgtcaatccaagctgtttatttgtgcacacatacctgcagtcagttagaaaagaggcactaagggtgttcaactgcattgactgggtacataagctcaccctggaaatcactgattttgacggcagtgtctccaccattgatcttggagcgtctagctcccgcttcacaaattggggctcagtgagcttgagtctggacgccgaggggatctctggatccaacagcttttcgttcatagaatcacccggcaaaggttatgctatcgtggatgagccgttctctgaaattcctcggcaggggtttctcggagagatcagatgtaatagtgagtccagcgtcctgtctgcccacgaaagctgcttaagggcaccaaacctgatttcctacaagcccatgatcgaccagcttgagtgtaccactaatttgatagatcctttcgttgtgtttgaacgcggctcactcccccaaacacgaaacgacaaaacgttcgctgccagtaagggtaatcggggcgtacaggcatttagcaaggggtctgtgcaggccgatctgaccctaatgttcgacaactttgaggtcgacttcgtgggagctgcggtttcctgcgatgccgcatttctgaacctcactggctgctattcatgtaatgctggggcccgtgtgtgcctgagtattacaagcaccggaacaggcactctttccgcccataacaaagacggttctttgcacatcgtcctgccatcggaaaatgggaccaaggatcaatgtcagattttacatttcacggtgcctgaggttgaggaagagtttatgtacagctgcgacggagatgaaagacccctcctggtgaaaggcacccttatcgctatagacccattcgatgacaggcgcgaggccggtggcgagtcaacagtcgtaaacccgaagtccgggagttggaactttttcgattggttctctggactgatgagctggtttggcgggcctttgaaaactatcctcctgatttgtctatacgtggcactgtccatcggactcttctttctgcttatttatttgggccggaccggtctgtcaaagatgtggttagcggctacaaagaaagcctcttga

SEQ ID NO: 11221 - RNA, 3480 nt, synthetic construct
  misc_feature 1..3480: note = derived and/or modified CDS sequence (opt3) from RVFV(KEN07-KUR340)__EF460404.1__NSm-Gn-Gc
  source 1..3480: mol_type = other RNA
atgatcgagggcgcctgggacagcctgagagaagaggaaatgcccgaggaactctcctgctctgtgtcagggattagggaggtcaagaccagtagccaggagctttaccgggctctgaaagcaataatcgccgcggatggattgaacaatattacatgtcacggtaagaaccctgaagacaaaatctccttaattaagggcccaccgcataaaaagcgcgttgggatcgtgcgatgcgagcgtagaagggatgctaagcaaataggacgggaaactatggccggcatcgcaatgacggtactgcccgccctagctgtgttcgcactcgcccctgtcgtgtttgctgaggacccacatctgcgcaatagacccggtaaagggcacaactatattgatggaatgacccaggaggacgccacatgtaagcctgttacttacgcgggcgcatgttcttcgttcgatgtgcttctggaaaaaggcaagtttccattgttccagtcatatgcccaccataggaccctcctggaggctgtccacgacacaatcattgccaaagcagatccccctagctgcgacctgcagagtgctcacgggaatccatgcatgaaggaaaagctcgtgatgaaaacccattgtccgaacgattaccaatccgcccactatttaaataacgacggaaagatggcgtctgtaaaatgtccccctaagtacgagctgactgaagattgcaatttttgccggcagatgacaggtgccagccttaaaaagggctcctatccattgcaggacctgttctgtcagtcaagtgaggacgatgggagcaaactaaagaccaagatgaaaggagtttgcgaggtgggcgtccaagcactcaagaaatgcgacggtcagctgtctacggctcatgaagtggtgccctttgccgtcttcaagaactccaaaaaggtttaccttgataagctggacttgaaaactgaggaaaatctcctgcctgattcatttgtgtgtttcgagcacaaggggcagtacaaaggaaccatggacagcggccagacaaagcgcgaattaaaaagttttgatatctctcaatgcccaaagataggcgggcacggatccaagaaatgtactggtgacgctgccttctgcagcgcatatgagtgtaccgcccagtacgctaacgcgtattgctcgcatgcaaatggctctgggattgtacagatccaagtgtccggagtctggaagaaacccctgtgtgtgggctacgagcgagttgtggtcaagagagaactctcagccaaaccgattcagagggtggagccttgcacaacctgtatcacgaagtgcgaaccccacggtcttgtagttcggagtactgggtttaagatcagctccgctgtggcctgtgcatctggcgtctgcgtgacaggaagccagtcaccaagtaccgagattactctgaaatatcctggcatatcccagagctctgggggagatatcggtgtccatatggcccacgacgatcaatcagtgagtagcaagattgttgctcattgtcccccacaggacccctgcttggtgcacggctgcatcgtatgtgcccacgggctaataaactaccagtgccatacagcactgtccgcgttcgtcgtgattttcgtgttttcttcgaccgctatcatctgtctcgccgttctgtatcgtatgcttaaatgcctgaagattgcacctcgcatcgtcttgaatccactcatgtggattacggccttcataagatgggtgtacaaaaagatggtagctagggtggccgacaacatcaaccaggttaatcgggaaattggatggatggagggcggtcaactggcattagggaacccggctcccatccctcgacacgccccaatcccccgctacagcacctatctgatgctactcctgattgtctcctacgcgtcagcctgtagtgagcttatacaggcttctagcagaatcacaacttgctccaccgaaggcgtgaatacaaaatgtaggttgtcaggaactgcactgattcgggccggcagcgtgggggctgaggcctgcctcatgctgaagggagtcaaggaagatcagaccaaatttcttaagatcaaaacagtttcttccgagctgagttgtcgcgagggtcagagctattggaccggctctttctcccctaagtgcttgtcaagtagaaggtgccatctcgtgggggaatgtcacgtgaaccgttgcctgagctggcgggacaatgagacttcggcagaattttccttcgtaggagagtctacgacaatgcgagaaaacaaatgttttgagcaatgcggcggttgggggtgtggctgcttcaatgtcaacccaagctgtttatttgtgcacacctacctgcagtcagttagaaaggaggcgctaagggtgttcaattgcattgattgggtccataagctcactctggaaatcaccgactttgatggaagtgtgtccacaatagaccttggcgcctctagctcccgcttcaccaactgggggtcagttagcttgagtctggatgctgagggaatctctggctccaatagcttttcgttcattgaatcacccggtaaagggtatgccatcgtggacgagccgttctctgaaattcctcggcagggatttctcggcgagatcagatgtaacagtgagtccagcgtactgtctgcacacgaaagctgcttaagggctccaaatctggtctcctacaagcccatgatagatcagcttgagtgtactacaaacttgattgaccctttcgtggtgtttgaacgcggttcactcccccaaacgcgaaatgataaaaccttcgccgcaagtaagggcaaccgtggggtccaggcctttagcaaaggatctgttcaggctgacctgactctaatgttcgataactttgaggtggacttcgtaggcgcggccgtgtcctgcgacgcagcttttctgaatctcacagggtgctattcatgtaacgccggagcccgggtctgcctgagtatcaccagcacaggcactggtaccctttccgctcataataaggatgggtctttgcacattgtgctgccatcggaaaacggaacgaaggaccaatgtcagatcttacatttcaccgttcctgaggtggaggaagagtttatgtacagctgcgatggcgacgaaagacccctcctggtcaaaggtacacttatagcaatcgatccattcgacgataggcgcgaggccggcggggagtcaactgtggttaatccgaagtccggaagttggaactttttcgactggttctctggcctgatgagctggtttgggggacctttgaaaaccattctcctgatctgtctatacgtggcgctgtccattggcctcttctttctgcttatctatttgggtcggacagggctgtcaaagatgtggttagctgccactaaaaaggcatcttga

SEQ ID NO: 11222 - RNA, 3480 nt, synthetic construct
  misc_feature 1..3480: note = derived and/or modified CDS sequence (opt3) from RVFV(35/74)__JF784387.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaacaatatcacatgtcacggtaaggaccctgaagataaaatttccttagtcaagggcccaccgcataaaaagcgcgttgggatcgtgcgatgcgagcgtagaagggacgctaagcaaataggacgggaaactatggccggcatcgcaatgacggtactgcccgccctagctgtgttcgcactcgcccctgtcgtgtttgctgaggatccacatctgcgcaacagacccggtaaagggcacaattatattgacggaatgacccaggaggatgccacatgtaagcctgttacttacgcgggcgcatgttcttcgttcgacgtgcttctggaaaaaggcaagtttccattgttccagtcatatgcccaccataggaccctcctggaggctgtccacgatacaatcattgccaaagcagatccccctagctgcgacctgcagagtgctcacgggaacccatgcatgaaggaaaagctcgtgatgaaaacccattgtccgaatgactaccaatccgcccactatttaaacaatgatggaaagatggcgtctgtaaaatgtccccctaagtacgagctgactgaagactgcaacttttgccggcagatgacaggtgccagccttaaaaagggctcctatccattgcaggacctgttctgtcagtcaagtgaggatgacgggagcaaactaaagaccaagatgaaaggagtttgcgaggtgggcgtccaagcactcaagaaatgcgatggtcagctgtctacggctcatgaagtggtgccctttgccgtcttcaaaaattccaagaaggtttaccttgacaagctggatttgaaaactgaggaaaacctcctgcctgactcatttgtgtgtttcgagcacaaggggcagtacaaaggaaccatggatagcggccagacaaagcgcgaattaaaaagttttgacatctctcaatgcccaaagataggcgggcacggatccaagaaatgtactggtgatgctgccttctgcagcgcatatgagtgtaccgcccagtacgctaatgcgtattgctcgcatgcaaacggctctggggtagtgcagattcaagtctccggagtgtggaagaaacccctgtgtgttggctacgagcgagtggtcgtgaagagagaactctcagccaaaccgatccagagggtagagccttgcacaacctgtattacgaagtgcgaaccccacggtcttgttgtgcggagtactgggtttaagatcagctccgctgtcgcctgtgcatctggcgtgtgcgtcacaggaagccagtcaccaagtaccgagatcactctgaaatatcctggcatttcccagagctctgggggagacataggtgtgcatatggcccacgatgaccaatcagttagtagcaagatcgtggctcattgtcccccacaggacccctgcttggtacacggctgcattgtctgtgcccacgggctaatcaattaccagtgccatacagcactgtccgcgttcgtggttgtgttcgtcttttcttcggtggctataatttgtctcgccatcctgtataaagtacttaagtgcctgaaaatcgcacctcgtaaggtgttggatccactcatgtggattaccgttttcatccgctgggtctacaaaaagatggtggccagagtggctgacaacattaatcaggtcaacagggaaataggatggatggagggcggtcaactggccttagggaacccggcacccatccctcggcacgctccaattccccgatacagcacgtatctgatgctactcctgatcgtttcctacgcctcagcgtgtagtgagcttatccaggcctctagccgcattaccacatgctccactgaaggcgtgaataccaagtgtagattgtcaggaacagctctgataagggcaggcagcgtgggggccgaggcttgcctcatgctgaaaggagtaaaggaagatcagactaaatttcttaagatcaaaaccgtctcttccgagctgagttgtcgggagggtcagagctattggacaggctctttctcccctaagtgcttgtcaagtcgcagatgccatctcgtgggggaatgtcacgttaacaggtgcctgagctggcgtgacaatgagacctcggccgaattttccttcgtgggagagtctactacgatgcgggaaaacaagtgttttgagcaatgcggcggttgggggtgtggctgcttcaatgtcaacccaagctgtttatttgtgcacacatacctgcagtcagttcgaaaagaggcactaagagtgttcaattgcattgattgggtacataagctcaccctggaaatcactgactttgatggaagtgtctccaccattgaccttggcgcgtctagctccaggttcacaaactgggggtcagtgagcttgagtctggatgccgagggaatctctggctccaatagcttttcgttcatagaatcacccggtaaagggtatgctatcgtggacgagccgttctctgaaattcctcgccagggatttctcggcgagatccggtgtaacagtgagtccagcgtcctgtctgcccacgaaagctgcttaagagcaccaaatctgatttcctacaagcccatgatcgatcagcttgagtgtaccactaacttgatagaccctttcgttgtgtttgaaaggggttcactcccccaaacacgcaatgataaaacgttcgctgccagtaagggcaaccgaggggtacaggcatttagcaagggatctgtgcaggccgacctgaccctaatgttcgacaattttgaggtcgatttcgtgggcgctgcggtttcctgcgacgccgcatttctgaacctcactgggtgctattcatgtaacgctggagcccgggtgtgcctgagtattacaagcaccggcacaggtactctttccgcccataataaagatgggtctttgcacatcgtcctgccatcggaaaacggaaccaaggaccaatgtcagattttacatttcacggtgcctgaggttgaggaagagtttatgtacagctgcgatggcgacgaacgtcccctcctggtgaaaggtacccttatcgctatagatccattcgacgatagaagggaggcaggcggggagtcaacagtcgtaaatccgaagtccggaagttggaactttttcgactggttctctggcctgatgagctggtttgggggacctttgaaaactatcctcctgatttgtctatacgtggccctgtccatcggcctcttctttctgcttatttatttgggtcgcaccgggctgtcaaagatgtggttagcggctacaaagaaagcctcttga

SEQ ID NO: 11223 - RNA, 3480 nt, synthetic construct
  misc_feature 1..3480: note = derived and/or modified CDS sequence (opt3) from RVFV(200803167)__JF311382.1__NSm-Gn-Gc
  source 1..3480: mol_type = other RNA
atgatcgagggcgcctgggacagcctgagagaagaggaaatgcccgaggaactctcctgctctgtgtcagggattagggaggtcaagaccagtagccaggagctttaccgggctctgaaagcaataatcgccgcggatggattgaacaatattacatgtcacggtaagaaccctgaagacaaaatctccttaattaagggcccaccgcataaaaagcgcgttgggatcgtgcgatgcgagcgtagaagggatgctaagcaaataggacgggaaactatggccggcatcgcaatgacggtactgcccgccctagctgtgttcgcactcgcccctgtcgtgtttgctgaggacctgcaccttcgcaatagaccaggtaaagggcataactatattgatggaatgacccaggaggacgccacatgtaagcccgttacttacgcgggcgcatgttcttcgttcgatgtgctgttggaaaaaggcaagtttcctctcttccagtcatatgcccaccataggaccctgctggaggctgtccacgacacaatcattgccaaagcagatccacccagctgcgacctccagagtgctcacgggaatccttgcatgaaggaaaagttagtgatgaaaacccattgtccaaacgattaccaatccgcccactatctgaataacgacggaaagatggcgtctgtaaaatgcccgcccaagtacgagcttactgaagattgtaatttttgccggcagatgacaggtgccagcttgaaaaagggctcctatcctctgcaggacctattctgtcagtcaagtgaggacgatgggagcaaactcaagaccaagatgaaaggagtttgcgaggtgggcgtccaagcactgaagaaatgcgacggtcagctttctacggctcatgaagtggtgccatttgccgtcttcaagaactccaaaaaggtttacctggataagttggacctcaaaactgaggaaaatctgttacccgattcatttgtgtgtttcgagcacaaggggcagtacaaaggaaccatggacagcggccagacaaagcgcgaactgaaaagttttgatatctctcaatgccctaagataggcgggcacggatccaagaaatgtactggtgacgctgccttctgcagcgcatatgagtgtaccgcccagtacgctaacgcgtattgctcgcatgcaaatggctctgggattgtacagatccaagtgtccggagtctggaagaaaccactctgtgtgggctacgagcgagttgtggtcaagagagaactttcagccaaacccattcagagggtggagccgtgcacaacctgtatcacgaagtgcgaacctcacggtctggtagttcggagtactgggtttaagatcagctccgctgtggcctgtgcatctggcgtctgcgtgacaggaagccagtcacccagtaccgagattgccttgaaatatccaggcatatcccagagctctgggggagatatcggtgtccatatggctcacgacgatcaatcagtgagtagcaagattgttgcccattgccctccccaggacccatgtctagtgcacggctgcatcgtatgtgcacacgggctgataaactaccagtgccatactgcgctctccgctttcgtcgtggttttcgtgttttcttcgattgccatcatctgtctggcaattctttatcgtgtcctgaaatgcttgaagatcgctccccgcaaagtgctcaatcctctgatgtggattacagccttcataagatgggtatacaagaaaatggtggccagggttgcagacaacatcaaccaggtcaatcgggaaattggatggatggagggcggtcaattagtgctggggaacccagctccgatcccccgacacgcccctatcccacgctacagcacctatctaatgctcctgcttattgtgtcctacgcgtcagcctgtagtgagttgatacaggcttctagcagaatcacgacctgctccacagaaggcgtcaatactaagtgtaggctgtcaggaaccgcactcattcgggccggcagcgttggggctgaggcctgcctgatgcttaagggagtgaaagaagatcagacaaagtttctgaaaatcaagactgtgtcttccgagttgagttgtcgcgagggtcagagctattggaccggctctttctcccccaaatgcctctcaagtagaaggtgccatctggtaggggaatgtcacgtcaaccgttgcttaagctggcgggacaatgagacatcggcagaattttccttcgtgggagagtctaccactatgcgagaaaacaagtgttttgagcaatgcggcggttgggggtgtggctgcttcaatgttaaccctagctgtctgtttgtgcacacgtacctacagtcagtcagaaaggaggcgctcagggtgttcaattgcattgattgggttcataaactgacacttgaaatcaccgactttgatggaagtgtgtccactatagacttgggcgcctctagctcccgcttcaccaactgggggtcagtaagcctgagtctcgatgctgagggaatctctggctccaatagcttttcgttcattgaatcaccaggtaaggggtatgccatcgtcgacgagcccttctctgaaattccgcggcagggatttctgggcgagatcagatgtaacagtgagtccagcgtgttatctgcacacgaaagctgcctgagggctcctaatcttatatcctacaaaccaatgattgatcagttggagtgtacaaccaacctcatcgaccccttcgtggtctttgaacgcggttcactgcctcaaactcgaaatgataagacattcgccgcaagtaaaggcaaccgtggggttcaggcctttagcaagggatctgtgcaggctgacctaacgctgatgttcgataactttgaggtagacttcgtgggcgcggccgtctcctgcgacgcagcttttctcaatctgaccgggtgctattcatgtaacgccggagcccgggtgtgccttagtattactagcacaggcaccggtacattgtccgctcataataaggatgggtctctgcacatcgttttaccctcggaaaacggaactaaagaccaatgtcagatactccatttcaccgtgccagaggtcgaggaagagtttatgtacagctgcgatggcgacgaaagacctctgcttgtgaagggtacgctgatcgcaattgatcccttcgacgataggcgcgaggccggcggggagtcaaccgttgtgaatccaaaatccggaagttggaactttttcgactggttctctggcttgatgagctggtttgggggaccgctcaagacaatgctgctaatctgtctgtacgtcgcgctctccattggcctgttctttcttttgatctatctgggtcggactgggttatcaaaaatgtggctcgctgccaccaagaaggcatcttga

SEQ ID NO: 11224 - RNA, 3480 nt, synthetic construct
  misc_feature 1..3480: note = derived and/or modified CDS sequence (opt3) from RVFV(25010-24)__KM210509.1__NSm-Gn-Gc
  source 1..3480: mol_type = other RNA
atgatcgagagagcctgggacagcctgagggaagaggaaatgcccgaggaactctcctgctctatttcaggcatacgggaggtgaagaccagtagccaggagctttaccgcgctctgaaagcaatcattgccgcggatgggttgaataatatcacatgtcacggaaaggaccctgaagataaaatttccttaatcaagggtccaccgcataaaaagcgagtcggcatagttcgttgcgagagaaggcgggacgctaagcaagtggggcgcgaaactatggccggaatcgcaatgacggtactgcccgccctagctgtgttcgcactcgcccctgtcgtgtttgctgaggatccacacctgagaaacaggcccggcaaaggtcataattatattgacgggatgacccaggaggatgccacatgtaagcctgttacttacgcgggagcatgttcttcgttcgacgtgcttctggaaaaaggcaagtttccattgttccagtcatatgcccaccatcggaccctcctggaggctgtccacgatacaatcattgccaaagcagatccccctagctgcgacctgcagagtgctcacggcaacccatgcatgaaggaaaagctcgtgatgaaaacccattgtccgaatgactaccaatccgcccactatttaaacaatgatgggaagatggcgtctgtaaaatgtccccctaagtacgagctgactgaagactgcaacttttgccgccagatgacaggagccagccttaaaaagggttcctatccattgcaggacctgttctgtcagtcaagtgaggatgacggcagcaaactaaagaccaagatgaaaggggtttgcgaggtgggagtccaagcactcaagaaatgcgatggccagctgtctacggctcatgaagtggtgccctttgccgtcttcaaaaattccaaaaaggtttaccttgacaagctggatttgaaaactgaggaaaacctcctgcctgactcatttgtgtgtttcgagcacaagggtcagtacaaagggaccatggatagcggacagacaaagcgagaattaaaaagttttgacatctctcaatgcccaaagataggcggccacgggtccaagaaatgtactggagatgctgccttctgcagcgcatatgagtgtaccgcccagtacgctaatgcgtattgctcgcatgcaaacggttctggcattgtacagatccaagtgtccggggtctggaagaaacccctgtgtgtgggatacgagagagttgtggtcaagagggaactctcagccaaaccgattcagcgggtggagccttgcacaacctgtatcacgaagtgcgaaccccacggccttatcgtacgtagtactggttttaagattagctccgctgttgcctgtgcatctggggtgtgcgtcacaggcagccagtcaccaagtaccgagataactctgaaatatcctggaatctcccagagctctggcggggacattggagtgcatatggcccacgatgaccaatcagtcagtagcaagatcgtggctcattgtcccccacaggacccctgcttggttcacggttgcatagtgtgtgcccacggcctaattaattaccagtgccatacagcactgtccgcgttcgtagtcgtgttcgtgttttcttcggttgctatcatctgtctcgccattctgtataaagtccttaagtgcctgaaaatcgcacctaagaaagtgttgaacccactcatgtggattaccgccttcatacgctgggtatacaagaagatggtggctagagttgccgataatatcaaccaggtcaacagggaaattgggtggatggagggaggccaactggcattaggtaatccggctcccatccctcggcacgccccaatcccccgatacagcacgtatctgatgctactcctgattgtgtcctacgcgtcagcctgtagtgagcttatacaggcttctagccgcatcaccacatgctccactgaaggggtgaacaccaaatgtagattgtcaggcacagcactgattagggccggaagcgtcggcgctgaggcctgcctcatgctgaagggggttaaagacgatcagactaagtttcttaaaatcaagaccgtgtcttccgaactgagttgtcgggagggacagagctattggacaggttctttctcccctaagtgcttgtcaagtcgcagatgccatctcgtgggcgagtgtcacgtaaataggtgcctgagctggcgtgacaacgaaacctcggcagagttttccttcgtcggggaatctactacgatgcgggagaataaatgttttgaacaatgcggaggctggggttgtgggtgcttcaacgtgaatccaagctgtttatttgttcacacatacctgcagtcagtgcgaaaggaggcgctaagagtcttcaactgcattgattgggtgcataaactcaccctggagatcactgactttgatggcagtgtttccaccatagaccttggagcctctagctccaggttcacaaattggggctcagtgagcttgagtctggatgctgaagggatctctggatccaacagcttttcgttcattgagtcacccggcaagggttatgccatcgtagacgaaccgttctctgagattcctcgccaggggtttctcggagaaatccggtgtaatagtgagtccagcgtcctgtctgcacacgagagctgcttaagagctccaaacctgatatcctacaaacccatgattgatcagcttgaatgtaccactaatttgatcgaccctttcgtggtgtttgagaggggctcactcccccaaacacgcaacgataagacgttcgccgcaagtaagggtaatcgaggcgtccaggcctttagcaaagggtctgttcaggctgacctgaccctaatgttcgacaactttgaagtggatttcgtaggagcggccgtgtcctgcgacgcagcttttctgaacctcactggctgctattcatgtaatgccggggcccgggtctgcctgagtattacaagcaccggaacaggcactctttccgctcataacaaggatggttctttgcacatcgtgctgccatcggagaatgggaccaaagaccaatgtcagatattacatttcacggttcctgaagtggaggaggaatttatgtacagctgcgatggagacgagcgtcccctcctggtcaagggcacccttatcgcaattgatccattcgacgatagaagggaagccggtggcgagtcaacagtggttaacccgaaatccgggagttggaactttttcgactggttctctggactgatgagctggtttggcgggcctttgaagactatcctcctgatttgtctatacgtggcgctgtccatcggactcttctttctgcttatatatttgggccgcaccggtctgtcaaagatgtggttagctgccacaaagaaggcatcttga

SEQ ID NO: 11225 - RNA, 3480 nt, synthetic construct
  misc_feature 1..3480: note = derived and/or modified CDS sequence (opt3) from RVFV(Sudan 2V-2007)__JQ820490.1__NSm-Gn-Gc
  source 1..3480: mol_type = other RNA
atgatcgagggcgcctgggacagcctgagagaagaggaaatgcccgaggaactctcctgctctgtgtcagggattagggaggtcaagaccagtagccaggagctttaccgggctctgaaagcaataatcgccgcggatggattgaacaatattacatgtcacggtaagaaccctgaagacaaaatctccttaattaagggcccaccgcataaaaagcgcgttgggatcgtgcgatgcgagcgtagaagggatgctaagcaaataggacgggaaactatggccggcatcgcaatgacggtactgcccgccctagctgtgttcgcactcgcccctgtcgtgtttgctgaggacccacatctgcgcaatagacccggtaaagggcacaactatattgatggaatgacccaggaggacgccacatgtaagcctgttacttacgcgggcgcatgttcttcgttcgatgtgcttctggaaaaaggcaagtttccattgttccagtcatatgcccaccataggaccctcctggaggctgtccacgacacaatcattgccaaagcagatccccctagctgcgacctgcagagtgctcacgggaatccatgcatgaaggaaaagctcgtgatgaaaacccattgtccgaacgattaccaatccgcccactatttaaataacgacggaaagatggcgtctgtaaaatgtccccctaagtacgagctgactgaagattgcaatttttgccggcagatgacaggtgccagccttaaaaagggctcctatccattgcaggacctgttctgtcagtcaagtgaggacgatgggagcaaactaaagaccaagatgaaaggagtttgcgaggtgggcgtccaagcactcaagaaatgcgacggtcagctgtctacggctcatgaagtggtgccctttgccgtcttcaagaactccaaaaaggtttaccttgataagctggacttgaaaactgaggaaaatctcctgcctgattcatttgtgtgtttcgagcacaaggggcagtacaaaggaaccatggacagcggccagacaaagcgcgaattaaaaagttttgatatctctcaatgcccaaagataggcgggcacggatccaagaaatgtactggtgacgctgccttctgcagcgcatatgagtgtaccgcccagtacgctaacgcgtattgctcgcatgcaaatggctctgggattgtacagatccaagtgtccggagtctggaagaaacccctgtgtgtgggctacgagcgagttgtggtcaagagagaactctcagccaaaccgattcagagggtggagccttgcacaacctgtatcacgaagtgcgaaccccacggtcttgtagttcggagtactgggtttaagatcagctccgctgtggcctgtgcatctggcgtctgcgtgacaggaagccagtcaccaagtaccgagattactctgaaatatcctggcatatcccagagctctgggggagatatcggtgtccatatggcccacgacgatcaatcagtgagtagcaagattgttgctcattgtcccccacaggacccctgctccgtgcacggctgcatcgtatgtgcccacgggttgataaactaccagtgccatacagcactatctgcgttcgtcgtggttttcgtgttttcgagcattgctatcatctgtctggccattctctatcgtgtcctgaaatgccttaagatcgcacctcgcaaagtgctgaatccattgatgtggattaccgccttcataagatgggtatacaagaaaatggtggctagggttgccgacaacatcaaccaggtcaatcgggaaattggatggatggagggcggtcaactcgtgctggggaacccggcacccatccctcgacacgctccaatcccccgctactccacgtatttaatgctgctactcattgtgtcacatgccagtgcgtgttctgagctgatacaggccagctccagaatcaccacatgctcaactgaaggcgtcaataccaagtgtaggcttagcggaacagctttgattcgggcaggctctgttggggccgaggcttgcctgatgctcaagggagtgaaagaagatcagactaagtttctgaaaatcaagaccgtgtccagtgagcttagctgtcgcgagggtcagtcttactggacaggctccttctcacctaaatgcctgagtagcagaaggtgccacttggtaggggaatgtcacgtcaaccgttgcctctcgtggcgggacaatgagacctccgccgaattttctttcgtgggagagagcactacgatgcgagaaaacaagtgttttgagcaatgcggcggttgggggtgtggctgcttcaatgttaacccatcatgtctgtttgtgcatacatatttacagagtgtcagaaaggaggcactgagggtgttcaattgcattgattgggttcacaaactaaccctcgaaatcactgactttgatggatccgtgtctaccatagacctgggcgcgagctcctcacgcttcacaaactgggggagcgtaagtctttctttggatgccgagggaatctccggcagcaattcgttttcattcattgaatctcccggtaaggggtacgctatcgtcgacgagccgttcagtgaaattcctcggcagggatttctgggcgagatcagatgtaactccgagagctctgtgctcagcgcccatgaatcctgcctgagggcaccaaatttaatatcatataaacccatgattgatcagctggagtgtaccactaaccttatcgaccctttcgtggtctttgaacgcggtagtttgccccaaacacgaaatgataagacgttcgctgccagcaaaggcaaccgtggggttcaggcattttctaagggatccgtgcaggccgacctcaccctgatgttcgataactttgaggtagacttcgtgggcgctgcggtctcatgcgacgccgcatttctaaatctgactgggtgctacagttgtaacgctggagcccgggtgtgcctcagcattacatccaccggcacaggtactctgtctgcccacaataaggatgggtcgcttcatatcgttttgccaagcgaaaacggaaccaaagaccaatgtcagatactgcacttcacggtgcctgaggtcgaggaagagtttatgtattcatgcgatggcgacgaaagacccttactcgtgaagggtaccctgatggctatcgatccattcgacgataggcgcgaggcaggcggggagtccacagttgtgaatccgaaaagtggatcttggaactttttcgactggttcagcggccttatgtcctggtttgggggacctctgaagactattttgctcatctgtctgtacgtcgccctatcaattggcctgttctttctcctgatctaccttggtcggaccgggttgtctaaaatgtggctggcggctacaaagaaggccagctga

SEQ ID NO: 11226 - RNA, 3480 nt, synthetic construct
  misc_feature 1..3480: note = derived and/or modified CDS sequence (opt3) from RVFV(SAUDI 200010901)__KU978778.1__NSm-Gn-Gc
  source 1..3480: mol_type = other RNA
atgatcgagggcgcctgggacagcctgagagaagaggaaatgcccgaggaactctcctgctctgtgtcagggattagggaggtcaagaccagtagccaggagctttaccgggctctgaaagcaataatcgccgcggatggattgaacaatattacatgtcacggtaagaaccctgaagacaaaatctccttaattaagggcccaccgcataaaaagcgcgttgggatcgtgcgatgcggacgtagaagggatactaagcaaataggccgggagacgatggctggtatcgccatgaccgtactgcccgcactagccgtgttcgctctcgcacctgtcgtgtttgccgaagacccacatctgcgcaatagacccgggaaaggacacaactatattgatggcatgacacaggaggacgctacttgtaagcctgttacctacgccggcgcgtgttcttcgttcgatgtgcttctggagaaagggaagtttccattgttccagtcatatgcacaccataggacactcctggaagccgtccacgacaccatcattgctaaagccgatccccctagctgcgacctgcagagtgcacacggaaatccatgcatgaaggagaagctcgtgatgaaaactcattgtccgaacgattaccaatccgctcactatttaaataacgacggtaagatggcctctgtaaaatgtccccctaagtacgaactgacagaggattgcaatttttgccggcagatgaccggcgcgagccttaaaaaggggtcctatccattgcaggacctgttctgtcagtcaagtgaagacgatggaagcaaactaaagacgaagatgaaaggcgtttgcgaggtgggtgtccaagccctcaagaaatgcgacgggcagctgtctactgcacatgaggtggtgccctttgctgtcttcaagaactccaaaaaggtttaccttgataagctggacttgaaaaccgaagagaatctcctgcctgattcatttgtgtgtttcgaacacaagggacagtacaaaggcacaatggacagcggccagactaagcgcgagttaaaaagttttgatatctctcaatgcccaaagatagggggacacggttccaagaaatgtaccggcgacgccgctttctgcagcgcctatgaatgtacagcacagtacgccaacgctttttgctcgcatgcgaatgggtctggaattgtacagatccaagtgtccggcgtctggaagaaacccctgtgtgtgggttatgagcgagttgtggtcaagagagagctctcagcaaaaccgattcagagggtggaaccttgcaccacgtgtatcactaagtgcgagccccacgggcttgtagttcggagtacaggcttcaagatcagctccgccgtggcttgtgcctctggagtctgcgtgaccggcagccagtcaccaagtactgaaattacactgaaataccctgggatatcccagagctctggaggtgatatcggcgtccatatggcacacgacgatcaatcagtgagtagcaagattgttgcccattgtcccccacaggacccctgcttggtgcacgggtgcatcgtatgtgctcacggactaataaactatcagtgccataccgccctgtccgcattcgtcgtggtttttgtgttctcttcgattgcgatcatctgtctcgctattctgtaccgtgtccttaaatgcctgaagatcgcccctcgcaaagtgttgaatccactcatgtggattacggcatttataagatgggtatataagaaaatggtggccagggttgctgacaacatcaaccaggtcaatcgggagattggctggatggaaggtgggcaactggtgttaggcaacccggcccccatccctcgacacgcaccaatcccccgctacagcacctacctgatgctactcctgattatatcctatgcttcagcctgtagtgagcttatccaggcgtctagcagaattacaacttgctccaccgagggagtgaatacaaagtgtaggttgtcaggcactgccctgatccgggctgggagcgtcggagcagaagcctgcctcatgctgaagggtgttaaagaggatcagaccaagttccttaaaattaagacagtgtcttccgaactgagttgtcgcgagggccagagctactggaccgggtctttttcccctaaatgcttgtcaagtagaaggtgccatctcgtgggagagtgtcacgtaaaccgttgcctgagctggcgggacaatgaaacttcggctgagttctcctttgtcggcgaatctacgacaatgcgagagaacaagtgtttcgaacaatgcggtgggtggggctgtggatgctttaatgtgaacccaagctgtttattcgttcacacctatctgcagtcagtgagaaaggaggccctaagggtctttaattgcatcgattgggtgcataaactcactctggagataaccgacttcgatggcagtgtttccacaatcgaccttggggcatctagctcccgctttaccaactggggatcagtgagcttgagtctggatgcggaaggcatttctggttccaatagcttctcgttcatcgagtcacccgggaagggatacgccattgtagacgaaccgttttctgagatccctcggcagggcttcctcggtgaaataagatgtaacagtgagtccagcgtcctgtctgctcacgagagctgcttaagggccccaaatctgatttcctataaacccatgatcgatcagcttgaatgtactacaaacttgattgacccttttgtggtgttcgagcgcggctcactcccccaaacgcgaaatgaaaagacctttgcagctagtaaagggaaccggggagtccaggccttcagcaagggctctgttcaggcagatctgactctaatgtttgacaacttcgaggtggattttgtaggggccgctgtgtcctgcgacgcggccttcctgaatctcacaggatgctactcatgtaacgcaggcgctcgtgtctgcctgagtatcaccagcacaggtactgggaccctttccgcccataataaggacggatctttgcacatagtgctgccatcggaaaacggcacgaaagatcaatgtcagatcttacattttaccgttcctgaggtggaggaagagttcatgtatagctgcgacggtgatgaaagacccctcctggtcaagggcacacttattgccatcgacccatttgatgacaggcgcgaggctgggggagagtcaactgtggttaatccgaaatccggcagttggaacttcttcgattggttttctgggctgatgagctggttcggaggccctttgaagaccattctcctgatctgtctatacgtggcactgtccataggtctctttttcctgcttatttacttggggcggacaggactgtcaaaaatgtggttagccgcgactaagaaggcttcttga

SEQ ID NO: 11227 - RNA, 3480 nt, synthetic construct
  misc_feature 1..3480: note = derived and/or modified CDS sequence (opt3) from RVFV(2373/74)__DQ380194.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaataatatcacatgttatggtaaggaccctgaagataaaatttccttaatcaagggcccaccgcacaaaaagcgcgtcgggatagttcgatgcgagcgtagaagggacgctaagcaaatcggacgggaaactatggccggcattgcaatgacggtgctgcccgccctagctgtattcgcactcgcccctgtggtctttgctgaggatccacatctgcgcaacagacccggtaaagggcacaattacatcgacggaatgacccaggaggatgccacatgtaagcctgtgacttatgcgggcgcatgttcttcgttcgacgttcttctggaaaaaggcaagtttccattgttccagtcatacgcccatcacaggaccctcctggaggctgtgcatgatacaattatcgccaaagcagatccccctagctgcgacctgcagagtgctcacgggaacccatgcatgaaggaaaagctcgtcatgaaaacccactgtccgaatgactatcaatccgcccattacttaaacaatgatggaaagatggcgtctgtgaaatgtccccctaagtatgagctgactgaagactgcaacttttgccggcagatgacaggtgccagccttaaaaagggctcctacccattgcaggacctgttctgtcagtcaagtgaggatgacgggagcaaactaaagaccaagatgaaaggagtatgcgaggttggcgtgcaagcactcaagaaatgcgatggtcagctgtctacggctcacgaagtcgtgccctttgccgtgttcaaaaattccaagaaggtctaccttgacaagctggatttgaaaactgaggaaaacctcctgcctgactcatttgtttgtttcgagcataaggggcagtataaaggaaccatggatagcggccagacaaagcgcgaattaaaaagttttgacatatctcaatgcccaaagattggcgggcacggatccaagaaatgtactggtgatgctgccttctgcagcgcatacgagtgtaccgcccagtatgctaatgcgtactgctcgcacgcaaacggctctgggatcgtgcagattcaagtatccggagtgtggaagaaacccctgtgtgtcggctatgagcgagtggttgtgaagagagaactctcagccaaaccgatccagagggtcgagccttgcacaacctgtatcacgaagtgcgaaccccatggtcttgtggtacggagtactgggtttaagattagctccgctgttgcctgtgcatctggcgtgtgcgtcacaggaagccagtcaccaagtaccgagataactctgaaataccctggcatctcccagagctctgggggagacattggtgtgcacatggcccatgatgaccaatcagtcagtagcaagatggtggctcactgtcccccacaggacccctgcttggttcatggctgcatcgtgtgtgcccacgggctaataaattatcagtgccacacagcactgtccgcgttcgtagtcgtgttcgtgttttcttcggttgctattatctgtctcgccatcctgtacaaagtccttaagtgcctgaaaattgcacctcgtaaggtgttgaacccactcatgtggatcaccgccttcattcgctgggtatacaaaaagatggtggctagagttgccgataatataaaccaggtcaacagggaaatcggatggatggagggcggtcaactggcattagggaatccggctcccattcctcggcatgccccaatcccccgatatagcacgtacctgatgctactcctgatcgtgtcctatgcgtcagcctgtagtgagcttattcaggcttctagccgcataaccacatgctccactgaaggcgtgaacaccaagtgtagattgtcaggaacagcactgatcagggccggcagcgtcggggctgaggcctgcctcatgctgaaaggagttaaggaagaccagactaaatttcttaagattaaaaccgtgtcttccgagctgagttgtcgggagggtcagagctactggacaggctctttctcccctaagtgcttgtcaagtcgcagatgccacctcgtgggggaatgtcatgtaaataggtgcctgagctggcgtgataacgagacctcggcagaattttccttcgtcggagagtctactacgatgcgggaaaataagtgttttgagcaatgcggcggttgggggtgtggctgcttcaacgtgaatccaagctgtttatttgttcacacatatctgcagtcagtgcgaaaagaggcgctaagagtcttcaactgcatcgactgggtgcacaagctcaccctggaaattactgattttgacggaagtgtttccacccttgatttgggcgcctctagctccaggttcacaaattgggggtcagtgagcctgagtctcgacgctgagggaatctctggctccaacagcttttcgttcatagaatcacccggtaaagggtacgccatcgtagatgagccgttctctgaaattcctcgccagggatttctgggcgagatccggtgtaatagtgagtccagcgtcttatctgcacatgaaagctgcctgagagctccaaaccttatttcctataagcccatgatcgaccagttggagtgtaccactaatctcatagatcctttcgtggtgtttgaaaggggttcactgccccaaacacgcaacgagaaaacgttcgccgcaagtaagggcaatcgaggggtccaggcctttagcaagggatctgttcaggctgacctaaccctgatgttcgataactttgaagtggacttcgtaggcgcggccgtgtcctgcgacgcagcttttctcaacctgactgggtgctactcatgtaatgccggagcccgggtctgccttagtattacaagcaccggcacaggtactttgtccgctcacaacaaagatgggtctctgcatatcgtgttaccatcggagaatggaaccaaggaccaatgtcagattctccacttcacggttcctgaggtggaagaggaatttatgtacagctgcgatggcgacgagcgtcccctgcttgtcaaaggtaccctgatcgcaatagatccattcgacgatagaagggaggccggcggggaatcaacagtggttaacccgaagtccggaagttggaactttttcgactggttctctggcttgatgagctggtttgggggacctctcaaaactatcctgctaatttgtctgtatgtggcgctctccatcggcctgttctttcttttgatttacctgggtcgcaccgggttatcaaagatgtggctcgctgccacaaagaaagcatcttga

SEQ ID NO: 11228 - RNA, 3480 nt, synthetic construct
  misc_feature 1..3480: note = derived and/or modified CDS sequence (opt3) from RVFV(KEN/Kil-006/07)__HM586966.1__NSm-Gn-Gc
  source 1..3480: mol_type = other RNA
atgatcgagggcgcctgggacagcctgagagaagaggaaatgcccgaggaactctcctgctctgtgtcagggattagggaggtcaagaccagtagccaggagctttaccgggctctgaaagcaataatcgccgcggatggattgaacaatattacatgtcacggtaagaaccctgaagacaaaatctccttaattaagggcccaccgcataaaaagcgcgttggggtggtacgatgcgagcgtagaagggatgctaagcaaatcggacgggaaactatggccggcatagcaatgacggtgctgcccgccctagctgtcttcgcactcgcccctgtggtttttgctgaggacccacatctgcgcaatagacccggtaaagggcacaactatatcgatggaatgacccaggaggacgccacatgtaagcctgtgacttacgcgggcgcatgcagctcgttcgatgtccttctggaaaaaggcaagtttccattgttccagtcatatgcccaccataggaccctcctggaggctgtgcacgacacaattatcgccaaagcagatccccctagctgtgacctgcagagtgctgatgggaataagtgcatgaaggaaaaactcgtaatgaagacccactgtccaaacgactaccaatccgcccattatttaaataacgatggaaaaatggcgtctgttaagtgcccgcccaaatacgagctgactgaagactgtaatttttgccggcagatgacaggtgccagccttaagaaaggctcctatcctttgcaggacctgttctgtcagtcaagtgaggatgacgggagcaagctaaagaccaaaatgaagggagtgtgcgaggtcggcgtgcaagcactcaaaaagtgcgatggtcagctgtctacggctcacgaagtggtcccatttgccgttttcaaaaactccaagaaggtgtaccttgacaaactggatttgaagactgaggaaaatctcctgcccgactcatttgtatgtttcgagcataaagggcagtacaagggaaccatggatagcggccagacaaaacgcgaattaaagagttttgacatttctcaatgccctaagatcggcgggcacggatccaaaaagtgtactggtgatgctgccttctgcagcgcatatgagtgtaccgcccagtacgctaacgcgtattgctcgcacgcaaatggctctgggatagtgcagattcaagtctccggagtgtggaaaaagccactgtgtgttggctacgagcgagtggtcgtgaaaagagaactctcagccaagcccatccagagggtagagccgtgcacaacctgtattacgaagtgcgaacctcatggtcttgttgtgcggagtactgggtttaaaatcagctccgctgtcgcctgtgcatctggcgtgtgcgtcacaggaagccagtcacccagtaccgagatcactctgaagtatccaggcatttcccagagctctgggggagacataggtgtgcacatggcccatgatgaccaatcagttagtagcaaaatcgtggctcactgccctccccaggacccatgtttggtacatggctgcattgtctgtgcccacgggctaatcaactaccagtgccacacagcactgtccgcgttcgtggttatattcgtgttttcttcgaccgctattatctgtctcgccgtcctgtatcgtgtgcttaagtgcctgaaaatcgcaccccgcaaggtattgaatcctctcatgtggattacggccttcatcagatgggtgtacaaaaagatggttgctagggtcgccgataacattaaccaggtgaatcgggaaataggatggatggagggcggtcaactggcattagggaacccagctccgatcccccgacatgcccctattccacgctacagcacctatctgatgctactcctgatcgtgtcctacgcgtcagcctgtagtgagcttatccaggcttctagcagaattacaacttgctccaccgaaggcgtcaatacaaagtgtaggttgtcaggaactgcactgatacgggccggcagcgttggggctgaggcctgcctcatgctgaaaggagtgaaggaagaccagaccaaatttcttaagatcaaaacagtgtcttccgagctgagttgtcgcgagggtcagagctattggaccggctctttctcccccaagtgcttgtcaagtagaaggtgccacctcgtaggggaatgtcatgtcaaccgttgcctgagctggcgggataatgagacttcggcagaattttccttcgtgggagagtctacgacaatgcgagaaaacaagtgttttgagcaatgcggcggttgggggtgtggctgcttcaatgttaaccctagctgtttatttgtgcacacctacctgcagtcagtcagaaaagaggcgctaagggtgttcaattgcattgactgggttcacaagctcactctggaaatcaccgattttgacggaagtgtgtccacaattgatcttggcgcctctagctcccgcttcaccaactgggggtcagtatctttgagtctggacgctgagggaatctctggctccaatagcttttcgttcatagaatcaccaggtaaagggtatgccatcgtcgatgagcccttctctgaaattccgcggcagggatttctcggcgagatcagatgtaacagtgagtccagcgtgctgtctgcacatgaaagctgcttaagggctcctaatctggtgtcctacaagccaatgattgaccagcttgagtgtactacaaacttgatcgatcccttcgtcgtttttgaacgcggttcactccctcaaacgcgaaatgacaaaaccttcgccgcaagtaagggcaaccgtggggtgcaggcctttagcaagggatctgtacaggctgatctgactctaatgttcgacaactttgaggtggacttcgtcggcgcggccgtgtcctgcgatgcagcttttctgaatctcacagggtgctattcatgtaacgccggagcccgggtttgcctgagtataaccagcacaggcactggtaccctttccgctcacaataaagacgggtctttgcatattgtgctgccctcggaaaacggaacgaaggatcaatgtcagatcttacacttcaccgtcccagaggtggaggaagagtttatgtacagctgcgacggcgatgaaagacctctcctggttaaaggtacacttattgcaatcgaccccttcgatgacaggcgcgaggccggcggggagtcaactgtggtcaatccaaagtccggaagttggaactttttcgattggttctctggcctgatgagctggtttgggggaccgttgaaaaccatactcctgatctgtctatacgtagcgctgtccattggcctcttctttctgcttatctatttgggtcggacagggctgtcaaagatgtggttagctgccactaagaaagcatcttga

SEQ ID NO: 11229 - RNA, 3480 nt, synthetic construct
  misc_feature 1..3480: note = derived and/or modified CDS sequence (opt3) from RVFV(MgH824)__DQ380210.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaacaatatcacatgtcacggtaaggaccctgaagataaaatttccttaatcaagggcccaccgcataaaaagcgcgtcgggatagttcgatgcgagcgtagaagggacgctaagcaaatcggacgggaaactatggccggcattgcaatgacggtgctgcccgccctagctgtattcgcactcgcccctgtggtctttgctgaggatccacatctgcgcaacagacccggtaaagggtataattacatcgacggaatgacccaggaggatgccacatgtaagcctgtgacttatgcgggcgcatgttcttcgttcgacgttcttctggaaaaaggcaagtttccattgttccagtcatacgcccaccacaggaccctcctggaggctgtgcatgatacaattatcgccaaagcagatccccctagctgcgacctgcagagtgctcacgggaacccatgcatgaaggaaaagctcgtcatgaaaacccactgtccgaatgactatcaatccgcccattacttaaacaatgatggaaagatggcgtctgtgaaatgtccccctaagtatgagctgactgaagactgcaacttttgccggcagatgacaggtgccagccttaaaaagggctcctacccattgcaggacctgttctgtcagtcaagtgaggatgacgggagcaaactaaagaccaagatgaaaggagtatgcgaggttggcgtgcaagcactcaagaaatgcgatggtcagctgtctacggctcacgaagtcgtgccctttgccgtgttcaaaaattccaagaaggtctaccttgacaagctggatttgaaaactgaggaaaacctcctgcctgactcatttgtttgtttcgagcgcaaggggcagtataaaggaaccatggatagcggccagacaaagcgagaattaaaaagttttgacatatctcaatgcccaaagattggcgggcatggatccaagaaatgtactggtgatgctgccttctgcagcgcatacgagtgtaccacacagtatgccaatgcttactgctcgcacgcgaacggctctggggtggtacagatccaagtgtccggagtctggaagaaacccctgtgtgtgggctatgagagagttgtggtcaagagggaactctcagcaaaaccgattcagcgggtggagccttgcaccacgtgtatcactaagtgcgaaccccacggtcttgtagttcgtagtacagggtttaagatcagctccgccgtggcttgtgcctctggcgtctgcgtgaccggaagccagtcaccaagtactgagattacactgaaataccctggcatatcccagagctctgggggagacatcggtgtccatatggcacacgatgaccaatcagtgagtagcaagattgttgcccattgtcccccacaggacccctgcttggtgcacggctgcatcgtatgtgctcatgggctaataaattatcagtgccacaccgccctgtccgcattcgtcgtggttttcgtgttttcttcgattgcgatcatctgtctcgctattctgtaccgcgtccttaaatgcctgaagatcgcccctagaaaagtgttgaacccactcatgtggattacggcattcataaggtggatctacaagaaaatggtagcccgggtggctgataatattaaccaggttaaccgagaaatcggatggatggagggcggtcaactggtcttagggaatccggcccccatccctcgccacgcaccaattcccagatatagcacctacctgatgctactcctgatagtgtcctatgcttcagcctgtagtgagcttatccaggcgtctagcaggattacaacttgctccaccgaaggcgtggacacaaagtgtcggttgtcaggaactgccctgatccgcgctggcagcgtcggggcagaggcctgcctcatgctgaagggagttaaagaagatcagaccaagtttcttaaaattaagacagtgtcttccgagctgagttgtagagagggtcagagctactggaccggctctttctcccctaaatgcttgtcaagtaggcgttgccatctcgtgggggaatgtcacgtaaaccggtgcctgagctggcgagacaatgagacttcggctgaattttccttcgtcggagagtctacgacaatgagagaaaacaagtgttttgagcaatgcggcggttgggggtgtggctgcttcaatgtgaacccaagctgtttatttgttcatacctatctgcagtcagtgaggaaggaggccctacgcgtcttcaattgcatcgattgggtgcacaaactcactctggaaataaccgactttgatggaagtgtttccacaatcgaccttggcgcatctagctcccggttcaccaactgggggtcagtgagcttgagtctggatgcggagggaatttctggctccaatagcttttcgttcatcgaatcacccggtaaggggtacgccattgtagacgagccgttccctgaaatcccaagacagggatttctcggcgagataaggtgtaactctgagagttccgtcctgagcgctcacgaatcttgcttacgcgcccccaatctgattagctataaacctatgatcgatcagcttgagtgtactacaaacttgattgaccccttcgtggtgtttgaacgaggttccctcccacaaacgcggaatgataagaccttcgcagcttcaaaaggcaaccgtggggtccaggcctttagtaagggaagcgttcaggcagacctgactctaatgttcgacaattttgaggtggatttcgtaggcgccgctgtgtcttgcgacgcggcctttctgaacctcacagggtgctactcctgtaacgcaggagctagagtctgcctgtcaatcaccagtacaggcactggtagcctttccgcccataataaggatgggtctttgcacatagtgctgccttcggaaaacggaaccaaagaccaatgtcagatcttacatttcacggttcccgaggtggaggaagagtttatgtacagctgcgatggcgacgaaaggccactcctggtcaagggtacccttattgccatcgatccgttcgacgatcgccgggaggctggcggggagtcaacagtggttaatcctaaatccggaagttggaactttttcgactggttctctggcctgatgagctggtttgggggacccttgaagactattctcctgatctgtctatatgtggcactgtccataggcctcttctttctgcttatttacttgggtagaaccgggctgtcaaaaatgtggttagccgcgacaaagaaggcttcttga

SEQ ID NO: 11230 - RNA, 3480 nt, synthetic construct
  misc_feature 1..3480: note = derived and/or modified CDS sequence (opt3) from RVFV(SA01-1322)__KX096942.1__NSm-Gn-Gc
  source 1..3480: mol_type = other RNA
atgatcgagggcgcctgggacagcctgagagaagaggaaatgcccgaggaactctcctgctctgtgtcagggattagggaggtcaagaccagtagccaggagctttaccgggctctgaaagcaataatcgccgcggatggattgaacaatattacatgtcacggtaagaaccctgaagacaaaatctccttaattaagggcccaccgcataaaaagcgcgttgggatcgtgcgatgcggacgtagaagggatactaagcaaataggccgggagacgatggctggtatcgccatgaccgtactgcccgcactagccgtgttcgctctcgcacctgtcgtgtttgccgaagacccacatctgcgcaatagacccgggaaaggacacaactatattgatggcatgacacaggaggacgctacttgtaagcctgttacctacgccggcgcgtgttcttcgttcgatgtgcttctggagaaagggaagtttccattgttccagtcatatgcacaccataggacactcctggaagccgtccacgacaccatcattgctaaagccgatccccctagctgcgacctgcagagtgcacacggaaatccatgcatgaaggagaagctcgtgatgaaaactcattgtccgaacgattaccaatccgctcactatttaaataacgacggtaagatggcctctgtaaaatgtccccctaagtacgaactgacagaggattgcaatttttgccggcagatgaccggcgcgagccttaaaaaggggtcctatccattgcaggacctgttctgtcagtcaagtgaagacgatggaagcaaactaaagacgaagatgaaaggcgtttgcgaggtgggtgtccaagccctcaagaaatgcgacgggcagctgtctactgcacatgaggtggtgccctttgctgtcttcaagaactccaaaaaggtttaccttgataagctggacttgaaaaccgaagagaatctcctgcctgattcatttgtgtgtttcgaacacaagggacagtacaaaggcacaatggacagcggccagactaagcgcgagttaaaaagttttgatatctctcaatgcccaaagatagggggacacggttccaagaaatgtaccggcgacgccgctttctgcagcgcctatgaatgtacagcacagtacgccaacgctttttgctcgcatgcgaatgggtctggaattgtacagatccaagtgtccggcgtctggaagaaacccctgtgtgtgggttatgagcgagttgtggtcaagagagagctctcagcaaaaccgattcagagggtggaaccttgcaccacgtgtatcactaagtgcgagccccacgggcttgtagttcggagtacaggcttcaagatcagctccgccgtggcttgtgcctctggagtctgcgtgaccggcagccagtcaccaagtactgaaattacactgaaataccctgggatatcccagagctctggaggtgatatcggcgtccatatggcacacgacgatcaatcagtgagtagcaagattgttgcccattgtcccccacaggacccctgcttggtgcacgggtgcatcgtatgtgctcacggactaataaactatcagtgccataccgccctgtccgcattcgtcgtggtttttgtgttctcttcgattgcgatcatctgtctcgctattctgtaccgtgtccttaaatgcctgaagatcgcccctcgcaaagtgttgaatccactcatgtggattacggcatttataagatgggtatataagaaaatggtggccagggttgctgacaacatcaaccaggtcaatcgggagattggctggatggaaggtgggcaactggtgttaggcgatccggcccccatccctcgacacgcaccaatcccccgctacagcacctacctgatgctactcctgattatatcctatgcttcagcctgtagtgagcttatccaggcgtctagcagaattacaacttgctccaccgagggagtgaacacaaagtgtaggttgtcaggcactgccctgatccgggctgggagcgtcggagcagaagcctgcctcatgctgaagggtgttaaagaggaccagaccaagttccttaaaattaagacagtgtcttccgaactgagttgtcgcgagggccagagctactggaccgggtctttttcccctaaatgcttgtcaagtagaaggtgccatctcgtgggagagtgtcacgtaaatcgttgcctgagctggcgggataacgaaacttcggctgagttctcctttgtcggcgaatctacgacaatgcgagagaataagtgtttcgaacaatgcggtgggtggggctgtggatgctttaacgtgaatccaagctgtttattcgttcacacctatctgcagtcagtgagaaaggaggccctaagggtctttaactgcatcgactgggtgcataaactcactctggagataaccgatttcgacggcagtgtttccacaatcgatcttggggcatctagctcccgctttaccaattggggatcagtgagcttgagtctggacgcggaaggcatttctggttccaacagcttctcgttcatcgagtcacccgggaagggatacgccattgtagatgaaccgttttctgagatccctcggcagggcttcctcggtgaaataagatgtaatagtgagtccagcgtcctgtctgctcacgagagctgcttaagggccccaaacctgatttcctataaacccatgatcgaccagcttgaatgtactacaaatttgattgatccttttgtggtgttcgagcgcggctcactcccccaaacgcgaaacgaaaagacctttgcagctagtaaagggaatcggggagtccaggccttcagcaagggctctgttcaggcagacctgactctaatgtttgataacttcgaggtggactttgtaggggccgctgtgtcctgcgacgcggccttcctgaacctcacaggatgctactcatgtaatgcaggcgctcgtgtctgcctgagtatcaccagcacaggtactgggaccctttccgcccataacaaggatggatctttgcacatagtgctgccatcggaaaatggcacgaaagaccaatgtcagatcttacattttaccgttcctgaggtggaggaagagttcatgtatagctgcgatggtgacgaaagacccctcctggtcaagggcacacttattgccatcgatccatttgacgataggcgcgaggctgggggagagtcaactgtggttaacccgaaatccggcagttggaatttcttcgactggttttctgggctgatgagctggttcggaggccctttgaagaccattctcctgatctgtctatacgtggcactgtccataggtctctttttcctgcttatttacttggggcggacaggactgtcaaaaatgtggttagccgcgactaagaaggcttcttga

SEQ ID NO: 11231 - RNA, 3480 nt, synthetic construct
  misc_feature 1..3480: note = derived and/or modified CDS sequence (opt3) from RVFV(Kenya 56 (IB8))__DQ380190.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaacaatatcacatgtcacggtaaggaccctgaagataaaatttccttaatcaagggcccaccgcataaaaagcaagtcgggatagttcgctgcgagcgacgtagagacgctaagcagatcggaagggaaactatggccggcattgcaatgacggtgctgcccgccctagctgtattcgcactcgcccctgtggtctttgctgaggatccacatctgcggaaccgccccggtaaagggcacaattatatcgacggaatgacccagggcgatgccacatgtaagcctgtgacttacgcgggcgcatgttcttcgttcgacgttcttctggagaaagggaagtttccattgttccagtcatatgcccaccatagaaccctcctggaagctgtgcacgatacaattatcgccaaagcagatccccctagctgcgacctgcaaagtgctcacggaaacccatgcatgaaggagaagctcgtcatgaaaacccattgtccgaaggactaccagtccgcccactatttaaataacgatggtaaaatggcgtctgtgaagtgtccccctaaatacgaactgactgaggactgcaatttttgcaggcagatgacaggcgccagccttaagaaagggtcctatccattgcaggacctgttctgtcaatcaagtgaagatgacggaagcaagctaaagaccaaaatgaagggcgtatgcgaggttggtgtgcaggcactcaaaaagtgcgatgggcagctgtctacggctcatgaggtcgtgccctttgccgtgttcaaaaactccaagaaggtctaccttgacaaactggatttgaagactgaagagaatctcctgcctgactcatttgtttgtttcgaacacaaaggacagtacaagggcaccatggatagcggccaaacaaaacgggagttaaagagttttgacatatctcagtgcccaaagattgggggacacggttccaaaaagtgtactggcgatgctgccttctgcagcgcatatgaatgtaccgcccagtacgctaacgcgtattgctcgcatgcaaatgggtctggaatcgtgcaaattcaggtatccggcgtgtggaaacgccccctgtgtgtcggttacgagcgagtggttgtgaagagagagctctcagccaaaccgatccagagggtcgaaccttgcacaacctgtatcacgaagtgcgagccccacgggcttgtggtacggagtactggctttaagattagctccgctgttgcctgtgcatctggagtgtgcgtcacaggcagccagtcaccaagtaccgaaataactctgaaatatcctgggatgtcccaaagctctggaggtgacatcggcgtgcatatggcccacgatgaccagtcagtcagtagcaagattgtggctcattgtcccccacaggacccctgcttggttcacgggtgcatcgtgtgtgcccacggactaataaactaccagtgccatacagcactgtccgcgttcgtagtcgtgttcgtgttttcttcggttgctattatctgtctcgccatcctgtataaagtccttaagtgcctgaaaattgcacctcgtaaggtgttgaatccactcatgtggatcaccgccttcattcgctgggtatacaaaaagatggtggctagagttgccgataacataaatcaagtcaacagggagatcggctggatggaaggtgggcagccggcactgggcaaccccgctcctattccacggcacgcccccatccctcgatacagcacgtatttaatgctgctactcatcgtgtcctacgcgtcagcctgtagtgagctgattcaggcttctagccgcataaccacatgctccactgagggagtgaataccaagtgtagactttcaggcacagcattgatcagggccgggagcgtcggagctgaagcctgcctgatgctcaaaggtgttaaggaggaccagactaaatttctgaagattaaaaccgtgtcttccgaacttagttgtcgggagggccaaagctattggacagggtctttctccccaaagtgcctgtcaagtcgcagatgccatttggtgggagagtgtcacgtaaacaggtgcctcagctggcgtgataatgaaacctcggcagagttttccttcgtcggcgaatctactacgatgcgggagaacaagtgttttgaacagtgcggtgggtggggctgtggatgcttcaatgtgaaccccagctgtctgtttgttcacacatacttacagtcagtgcgaaaagaggcgctgagagtcttcaattgcatcgactgggtgcataagctaaccctcgagattactgattttgacggcagtgtttccaccatcgatctgggggcctctagctccaggttcacaaactggggatcagtgagccttagtttggacgctgaaggcatatctggttccaatagcttttcgttcatcgagtcaccggggaaaggatatgccattgtagatgaacctttctctgagatcccacgccagggctttctgggtgaaattcggtgtaacagtgagtccagcgtcctctctgcacacgagagctgcctgagagctcccaatttaatctcctacaagcctatgatagaccaactggaatgtaccactaaccttattgatcccttcgtggcctttgagaggggctcattgccacagacacgcaatgacaaaacgttcgcagccagtaaggggaaccgaggagtgcaggcttttagcaagggctctgtccaagcggatctcaccctgatgttcgacaattttgaagttgacttcgtgggggccgcagtatcctgcgatgctgcctttctaaacctgactggatgctattcatgtaacgccggcgctcgggtgtgcctcagtatcacaagcaccggtacagggactctgtccgcacataataaagacggatctcttcacattgtcttgccttcggagaacggcaccaaggatcagtgtcagatcctgcatttcacggtgcccgaagttgaggaggaatttatgtacagctgcgacggtgatgagcgtccattactcgtgaaaggcaccctgatagccatcgacccgttcgatgacagaagggaagctgggggagagtcaacagtcgtgaatcctaagtccggcagttggaactttttcgattggttctctgggcttatgagctggtttggaggccccctgaaaactattttgctcatctgtctgtacgttgcgctatccattggtctgttctttctcctgatctatcttgggcgcaccggattgtcaaagatgtggctggccgcaacaaagaaagcctcttga

SEQ ID NO: 11232 - RNA, 3480 nt, synthetic construct
  misc_feature 1..3480: note = derived and/or modified CDS sequence (opt3) from RVFV(KEN/Mal-032/07)__HM586967.1__NSm-Gn-Gc
  source 1..3480: mol_type = other RNA
atgatcgagggcgcctgggacagcctgagagaagaggaaatgcccgaggaactctcctgctctgtgtcagggattagggaggtcaagaccagtagccaggagctttaccgggctctgaaagcaataatcgccgcggatggattgaacaatattacatgtcacggtaagaaccctgaagacaaaatctccttaattaagggcccaccgcataaaaagcgcgttgggatcgtgcgatgcgagcgtagaagggatgctaagcaaataggacgggaaactatggccggcatcgcaatgacggtactgcccgccctagctgtgttcgcactcgcccctgtcgtgtttgctgaggacccacatctgcgcaatagacccggtaaagggcacaactatattgatggaaggcttcaggaggacgccacctgtaagcctgttacatacgcgggcgcatgttcttcgttcgatgtgctgttggaaaaaggcaagtttccactcttccagtcatatgcccaccatcggactctgctggaggctgtccacgacaccatcattgccaaagcagatccccctagctgcgacctccagagtgctgatgggaataagtgcatgaaggaaaaattagtgatgaagacacactgtccaaacgactaccaatccgcccattatctgaataacgatggaaaaatggcgtctgtaaagtgcccgcccaaatacgagcttaccgaagactgtaatttttgccgccagatgactggtgccagcttgaagaaaggctcctatcctctgcaggacctattctgtcagtcaagtgaggatgacgggagcaagctcaagacaaaaatgaagggagtttgcgaggtgggcgtccaagcactgaaaaagtgcgatggtcagctttctaccgctcacgaagtggtgccatttgccgtcttcaaaaactccaagaaggtttacctggacaaattggatctcaagacggaggaaaatctgttacccgactcatttgtgtgtttcgagcataaagggcagtacaagggaactatggatagcggccagaccaaacgagaactgaagagttttgacatctctcaatgccctaagataggcgggcacggatccaaaaagtgtacaggtgatgctgccttctgcagcgcatatgagtgtactgcccagtacgctaacgcgtattgctcgcacgcaaatggctctgggattgtacagatccaagtgtccggagtctggaaaaagccactctgtgtgggctacgagagagttgtggtcaaaagggaactttcagccaagcccattcagcgggtggagccgtgcaccacatgtatcaccaagtgcgaacctcatggtctggtagttcgtagtacggggtttaaaatcagctccgctgtggcctgtgcatctggcgtctgcgtgactggaagccagtcacccagtacagagattaccttgaagtatccaggcatatcccagagctctgggggagacatcggtgtccacatggcccatgatgaccaatcagtgagtagcaaaattgttgctcactgccctccccaggacccatgtctagtgcatggctgcatcgtatgtgcccacgggctgataaactaccagtgccacactgcactctccgcgttcgtcgtgattttcgtgttttcttcgacagctatcatctgtctggccgttctttatcgcgtcctgaagtgcttgaaaattgcacccagaaaggtgctcaatcctctgatgtggatcaccgccttcattaggtgggtatacaaaaagatggtggctcgggttgccgataacataaaccaggtcaatcgagaaatcggatggatggagggcggtcaattagcactggggaacccagctccgattccccgccatgcccctatcccaagatacagcacgtatctaatgctcctgcttatcgtgtcctacgcgtcagcctgtagtgagttgattcaggcttctagcaggataaccacatgctccactgaaggcgtgaataccaagtgtcggctgtcaggaacagcactcatccgcgccggcagcgtcggggctgaggcctgcctgatgcttaaaggagttaaggaagaccagactaaatttctgaagattaaaaccgtgtcttccgagttgagttgtagagagggtcagagctattggacaggctctttctcccccaagtgcctctcaagtaggcgttgccacctggtgggggaatgtcatgtaaaccggtgcttaagctggcgagataatgagacctcggcagaattttccttcgtcggagagtctactacgatgagagaaaacaagtgttttgagcaatgcggcggttgggggtgtggctgcttcaatgtgaaccctagctgtctgtttgttcacacatacctacagtcagtgaggaaagaggcgctccgcgtcttcaattgcatcgactgggtgcacaagctgacccttgaaattactgattttgacggaagtgtttccaccatcgatttgggcgcctctagctcccggttcacaaactgggggtcagtgagcctgagtctcgacgctgagggaatatctggctccaatagcttttcgttcatcgaatcaccaggtaaagggtatgccattgtagatgagcccttctctgaaatcccgagacagggatttctgggcgagattaggtgtaacagtgagtccagcgtcttatctgcacatgaaagctgcctgcgcgctcctaatcttgtgtcctacaagccaatgatcgaccagttggagtgtaccactaacctcatagatcccttcgtggtctttgaacgaggttcactgcctcaaacacggaatgacaaaacgttcgccgcaagtaagggcaaccgtggggttcaggcctttagcaagggatctgtgcaggctgatctaaccctgatgttcgacaactttgaggtagacttcgtgggcgcggccgtctcctgcgatgcagcttttctcaatctgactgggtgctattcatgtaacgccggagccagagtgtgccttagtattacaagcaccggcacaggtactttgtccgctcacaataaagacgggtctctgcatatcgttttaccctcggaaaacggaaccaaggatcaatgtcagattctccacttcacggtgccagaggtcgaggaagagtttatgtacagctgcgacggcgatgaaaggcctctgcttgtgaaaggtaccctgatcgcaatagaccccttcgatgaccgccgggaggccggcggggagtcaacagttgtgaatccaaagtccggaagttggaactttttcgattggttctctggcttgatgagctggtttgggggaccgctcaaaactatcctgctaatttgtctgtacgtcgcgctctccatcggcctgttctttcttttgatttatctgggtagaaccgggttatcaaagatgtggctcgctgccacaaagaaagcatcttga

SEQ ID NO: 11233 - RNA, 3480 nt, synthetic construct
  misc_feature 1..3480: note = derived and/or modified CDS sequence (opt3) from RVFV(KEN/Gar-008/06)__HM586965.1__NSm-Gn-Gc
  source 1..3480: mol_type = other RNA
atgatcgagggcgcctgggacagcctgagagaagaggaaatgcccgaggaactctcctgctctgtgtcagggattagggaggtcaagaccagtagccaggagctttaccgggctctgaaagcaataatcgccgcggatggattgaacaatattacatgtcacggtaagaaccctgaagacaaaatctccttaattaagggcccaccgcataaaaagcgcgttgggatcgtgcgatgcgagcgtagaagggatgctaagcaaataggacgggaaactatggccggcatcgcaatgacggtactgcccgccctagctgtgttcgcactcgcccctgtcgtgtttgctgaggacccacatctgcgcaatagacccggtaaagggcacaactatattgatggaatgacccaggaggacgccacatgtaagcctgttacttacgcgggcgcatgttcttcgttcgatgtgcttctggaaaaaggcaagtttccattgttccagtcatatgcccaccataggaccctcctggaggctgtccacgacacaatcattgccaaagcagatccccctagctgcgacctgcagagtgctcacgggaatccatgcatgaaggaaaagctcgtgatgaaaacccattgtccgaacgattaccaatccgcccactatttaaataacgacggaaagatggcgtctgtaaaatgtccccctaagtacgagctgactgaagattgcaatttttgccggcagatgacaggtgccagccttaaaaagggctcctatccattgcaggacctgttctgtcagtcaagtgaggacgatgggagcaaactaaagaccaagatgaaaggagtttgcgaggtgggcgtccaagcactcaagaaatgcgacggtcagctgtctacggctcatgaagtggtgccctttgccgtcttcaagaactccaaaaaggtttaccttgataagctggacttgaaaactgaggaaaatctcctgcctgattcatttgtgtgtttcgagcacaaggggcagtacaaaggaaccatggacagcggccagacaaagcgcgaattaaaaagttttgatatctctcaatgcccaaagataggcgggcacggatccaagaaatgtactggtgacgctgccttctgcagcgcatatgagtgtaccgcccagtacgctaacgcgtattgctcgcatgcaaatggctctgggattgtacagatccaagtgtcccgagtctggaagaaacccctgtgtgtgggatacgagagagttgtggtcaagagggaactctcagccaaaccgattcagcgggtggagccttgcacaacctgtatcacgaagtgcgaaccccacggccttgtagttcgtagtactggttttaagatcagctccgctgtggcctgtgcatctggggtctgcgtgacaggcagccagtcaccaagtaccgagattactctgaaatatcctggaatatcccagagctctggcggggatatcggagtccatatggcccacgacgatcaatcagtgagtagcaagattgttgctcattgtcccccacaggacccctgcttggtgcacggttgcatcgtatgtgcccacggcctaataaactaccagtgccatacagcactgtccgcgttcgtcgtgattttcgtgttttcttcgaccgctatcatctgtctcgccgttctgtatcgcgtccttaaatgcctgaagattgcacctagaaaagtgttgaatccactcatgtggatcacggccttcattaggtgggtatacaagaaaatggtggctcgggttgccgacaacataaaccaggtcaatcgagaaatcgggtggatggagggaggccaactggcattaggtaacccggctcccattcctcgccacgccccaatccccagatacagcacctatctgatgctactcctgatcgtgtcctacgcgtcagcctgtagtgagcttattcaggcttctagcaggataacaacttgctccaccgaaggggtgaatacaaagtgtcggttgtcaggcactgcactgatccgcgccggaagcgtcggcgctgaggcctgcctcatgctgaagggggttaaagaagatcagaccaagtttcttaaaattaagacagtgtcttccgagctgagttgtagagagggacagagctattggaccggttctttctcccctaaatgcttgtcaagtaggcgttgccatctcgtgggcgaatgtcacgtaaaccggtgcctgagctggcgagacaatgagacttcggcagaattttccttcgtcggggagtctacgacaatgagagaaaacaagtgttttgagcaatgcggaggctggggttgtgggtgcttcaatgtgaacccaagctgtttatttgttcacacctacctgcagtcagtgaggaaggaggcgctacgcgtcttcaattgcatcgattgggtgcataaactcactctggaaattaccgactttgatggcagtgtttccacaatcgaccttggagcctctagctcccggttcaccaactggggctcagtgagcttgagtctggatgctgaggggatatctggatccaatagcttttcgttcatcgaatcacccggcaagggttatgccattgtagacgagccgttctctgaaatccctagacaggggtttctcggagagattaggtgtaacagtgagtccagcgtcctgtctgcacacgaaagctgcttacgcgctccaaatctggtgtcctacaaacccatgatcgatcagcttgagtgtactacaaacttgatagaccctttcgtggtctttgaacgaggctcactcccccaaacgcggaatgataagaccttcgccgcaagtaaaggtaaccgtggcgttcaggcctttagcaaggggtctgtgcaggctgacctgactctaatgttcgataacctgaaggtagactttgtgggagcggccgtctcctgcgacgcagctttcctcaatctgacaggctgctattcatgtaacgccggggccagagtgtgccttagtattaccagcacaggaactggcaccttgtccgctcataataaagatggttctctgcacatcgttttaccatcggagaacgggacgaaggaccaatgtcagattctccattttaccgtgcctgaagtcaaagaggagttcatgtacagctgcgatggagacgaaagggcactgcttatgaagggcacactgatcgccatagatccctttgacgatcgccgggaggcgggtggcgaatcaactgtggttaatccaaaatccgggagttggaacttctttgactggttctctggattgatgagctggttcggcgggccgctcaagaccatcctgctaatttgtctgtacgtggctctctccatcggactgtttttccttttgatttatctgggcagaacaggtttatcaaagatgtggctcgccgcaactaaaaaggcctcttga

SEQ ID NO: 11234 - RNA, 3480 nt, synthetic construct
  misc_feature 1..3480: note = derived and/or modified CDS sequence (opt3) from RVFV(Beijing-01)__KX611606.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaatcattgccgcggatggattgaacaatatcacatgtcacggtaaggaccctgaagataaaatttccttaatcaagggcccaccgcataaaaagcgcgtcgggatagttcgatgcgagcgtagaagggacgctaagcaaatcggacgggaaactatggccggcattgcaatgacggtgctgcccgccctagctgtattcgcactcgcccctgtggtctttgctgaggatccacatctgcgcaacagacccggtaaagggcacaattatatcgacggagtgacccaggaggatgccacatgtaagcctgttacttacgcgggcgcatgttcttcgttcgacgtgcttctggaaaaaggcaagtttccattgttccagtcatatgcccaccataggaccctcctggaggctgtccacgatacaattatcgccaaagcagatccccctagctgcgacctgcagagtgctcacgggaacccatgcatgaaggaaaagctcgtgatgaaaacccattgtccgaatgactaccaatccgcccactatttaaacaatgatggaaagatggcgtctgtaaaatgtccccctaagtacgagctgactgaagactgcaacttttgccggcagatgacaggtgccagccttaaaaagggctcctatccattgcaggacctgttctgtcagtcaagtgaggatgacgggagcaaactaaagaccaagatgaaaggagtttgcgaggtgggcgtccaagcactcaagaaatgcgatggtcgcctgtctacggctcatgaagtggtgccctttgccgtcttcaaaaattccaagaaggtttaccttgacaagctggatttgaaaactgaggaaaacctcctgcctgactcatttgtgtgtttcgagcacaaggggcagtacaaaggaaccatggatagcggccagacaaagcgagaattaaaaagttttgacatatctcagtgcccaaagattggcgggcacggatccaagaaatgtactggtgatgctgccttctgcagcgcatatgagtgtaccgcccaatacgctaatgcgtattgctcgcatgcaaacggctctgggatcgtacagattcaggtgtccggagtctggaagaaacccctgtgtgtgggctacgagagagttgtggtcaagagggaactctcagccaaaccgatccaacgggtggagccttgcacaacctgtatcacgaagtgcgaaccccacggtcttgtagttcgtagtactgggtttaagattagctccgctgtggcctgtgcatctggcgtctgcgtgacaggaagccagtcaccaagtaccgagataactctgaaatatcctggcatctcccagagctctgggggagacattggtgtccatatggcccacgatgaccagtcagtgagtagcaagatcgttttcgactgtcccccacaagatccctgcttggtgcatggctgcatagtatgtgctcacgggctaattaattaccagtgccacacagccctgtccgcattcgtcgtggtttttgtgttctcttcggtcgcgatcatctgtctcgctattctgtataaagtgcttcgctgcctgaagatcgcccctaaaaaggtattgaacccactcatgtggattaccgcatttataagatgggtgtacaaaaagatggttgccagggtcgctgacaatatcaaccaggtgaaccgggaaattggatggatggagggcggtcagctggccttagggaatccggcacccatccctcgacatgctccaatcccccgctacagcacgtatctgatgctactcctgattatatcctacgcctcagcgtgtagtgagcttatccaagcctctagcagaattaccacatgctccactgaaggcgtgaacaccaagtgtaggttgtcaggaacagctctgatccgggcaggcagcgtcggggccgaggcttgcctcatgttcgaaggagttaaagaggatcagactaagtttctgaaaattaagaccgtgtcttccgagcttagttgtcgcgaaggtcagagctattggacaggctctttctcccctaaatgcctgtcaagtagaaggtgccacttggtgggggagtgtcatgtaaatcgttgcctcagctggcgggacaacgaaacctcggccgagttttccttcgtcggagaatctactacgatgcgagagaataagtgttttgagcagtgcggcggttgggggtgtggctgcttcaacgtgaatccaagctgtctgtttgttcacacatacttacaatcagtgagaaaggaagcactgagggtcttcaactgcatcgattgggtgcacaaactaaccctcgagataactgactttgatggaagtgtttccaccatcgacctgggcgcgtctagctcccgcttcacaaattgggggtcagtgagccttagtttggatgccgaaggaatttctggctccaacagcttctcgtttatcgagtcacccggtaaggggtatgctattgtagacgaaccgttctctgagatccctcggcagggatttctgggcgagataagatgtaatagtgaatccagcgtcctctctgcccatgagagctgcctgagggcaccaaacttaatttcctacaaacccatgatcgatcagctggaatgtaccactaatcttattgaccctttcgtggtgtttgagcgcggttcattgccccagacacgaaacgataagacgttcgctgccagtaaaggcaatcgtggggtccaagcatttagcaagggatctgttcaggccgacctcaccctgatgttcgacaactttgaagtggatttcgtaggcgctgcggtgtcctgcgacgccgcatttctaaacctgactgggtgctattcatgtaatgctggagcccgggtctgcctcagtatcacaagcaccggcacaggtactctgtccgcccacaacaaggatgggtctcttcatatagtgttgccatcggagaatggaaccaaagaccagtgtcaaatcctgcacttcacggttcctgaggtggaagaggaatttatgtacagctgcgatggcgacgagagacccttactcgtcaagggtaccctgattgctatcgatccattcgacgataggcgcgaggcaggcggggaatcaacagtggttaacccgaaatccggaagttggaatttctttgactggttctctggccttatgagctggtttgggggacctctgaagactattttgctcatctgtctgtacgtggccctatccataggcctgttctttctcctgatttatcttggtcggaccgggttgtcaaaaatgtggctggcggctacaaagaaggcctcttga

SEQ ID NO: 11235 - RNA, 3480 nt, synthetic construct
  misc_feature 1..3480: note = derived and/or modified CDS sequence (opt3) from RVFV(KEN/Bar-035/07)__HM586969.1__NSm-Gn-Gc
  source 1..3480: mol_type = other RNA
atgatcgagggcgcctgggacagcctgagagaagaggaaatgcccgaggaactctcctgctctgtgtcagggattagggaggtcaagaccagtagccaggagctttaccgggctctgaaagcaataatcgccgcggatggattgaacaatattacatgtcacggtaagaaccctgaagacaaaatctccttaattaagggcccaccgcataaaaagcgcgttgggatcgtgcgatgcgagcgtagaagggatgctaagcaaataggacgggaaactatggccggcatcgcaatgacggtactgcccgccctagctgtgttcgcactcgcccctgtcgtgtttgctgaggacccacatctgcgcaatagacccggtaaagggcacaactatattgatggaaggcttcaggaggacgccacctgtaagcctgttacatacgcgggcgcatgttcttcgttcgatgtgctgttggaaaaaggcaagtttccactcttccagtcatatgcccaccatcggactctgctggaggctgtccacgacaccatcattgccaaagcagatccccctagctgcgacctccagagtgctgatgggaataagtgcatgaaggaaaaattagtgatgaagacacactgtccaaacgactaccaatccgcccattatctgaataacgatggaaaaatggcgtctgtaaagtgcccgcccaaatacgagcttaccgaagactgtaatttttgccgccagatgactggtgccagcttgaagaaaggctcctatcctctgcaggacctattctgtcagtcaagtgaggatgacgggagcaagctcaagacaaaaatgaagggagtttgcgaggtgggcgtccaagcactgaaaaagtgcgatggtcagctttctaccgctcacgaagtggtgccatttgccgtcttcaaaaactccaagaaggtttacctggacaaattggatctcaagacggaggaaaatctgttacccgactcatttgtgtgtttcgagcataaagggcagtacaagggaactatggatagcggccagaccaaacgagaactgaagagttttgacatctctcaatgccctaagataggcgggcacggatccaaaaagtgtacaggtgatgctgccttctgcagcgcatatgagtgtactgcccagtacgctaacgcgtattgctcgcacgcaaatggctctgggattgtacagatccaagtgtccggagtctggaaaaagccactctgtgtgggctacgagagagttgtggtcaaaagggaactttcagccaagcccattcagcgggtggagccgtgcaccacatgtatcaccaagtgcgaacctcatggtctggtagttcgtagtacggggtttaaaatcagctccgctgtggcctgtgcatctggcgtctgcgtgactggaagccagtcacccagtacagagattaccttgaagtatccaggcatatcccagagctctgggggagacatcggtgtccacatggcccatgatgaccaatcagtgagtagcaaaattgttgctcactgccctccccaggacccatgtctagtgcatggctgcatcgtatgtgcccacgggctgataaactaccagtgccacactgcactctccgcgttcgtcgtgattttcgtgttttcttcgacagctatcatctgtctggccgttctttatcgcgtcctgaagtgcttgaaaattgcacccagaaaggtgctcaatcctctgatgtggatcaccgccttcattaggtgggtatacaaaaagatggtggctcgggttgccgataacataaaccaggtcaatcgagaaatcggatggatggagggcggtcaattagcactggggaacccagctccgattccccgccatgcccctatcccaagatacagcacgtatctaatgctcctgcttatcgtgtcctacgcgtcagcctgtagtgagttgattcaggcttctagcaggataaccacatgctccactgaaggcgtgaataccaagtgtcggctgtcaggaacagcactcatccgcgccagaagcgtcggcgctgaggcctgcctgatgcttaaaggggttaaggaagaccagactaaatttctgaagattaaaaccgtgtcttccgagttgagttgtagggagggacagagctattggacaggttctttctcccccaagtgcctctcaagtcgtcggtgccacctggtgggcgaatgtcatgtaaaccgatgcttaagctggagagataatgagacctcggcagaattttccttcgtcggggagtctactacgatgagggaaaacaagtgttttgagcaatgcggaggctggggttgtgggtgcttcaatgtgaaccctagctgtctgtttgttcacacatacctacagtcagtgcgcaaagaggcgctccgggtcttcaattgcatcgactgggtgcacaagctgacccttgaaattactgattttgacggcagtgtttccaccatcgatttgggagcctctagctccagattcacaaactggggctcagtgagcctgagtctcgacgctgaggggatatctggatccaatagcttttcgttcatcgaatcaccaggcaaaggttatgccattgtagatgagcccttctctgaaatcccgaggcaggggtttctgggagagattcgctgtaacagtgagtccagcgtcttatctgcacatgaaagctgcctgcgagctcctaatcttgtgtcctacaagccaatgatcgaccagttggagtgtaccactaacctcatagatcccttcgtggtctttgaacggggctcactgcctcaaacacgtaatgacaaaacgttcgccgcaagtaagggtaacagaggcgttcaggcctttagcaaggggtctgtgcaggctgatctaaccctgatgttcgacaactttgaggtagacttcgtgggagcggccgtctcctgcgatgcagcttttctcaatctgactggctgctattcatgtaacgccggggccagggtgtgccttagtattacaagcaccggaacaggcactttgtccgctcacaataaagacggttctctgcatatcgttttaccctcggaaaacgggaccaaggatcaatgtcagattctccacttcacggtgccagaggtcgaggaagagtttatgtacagctgcgacggagatgaacgccctctgcttgtgaaaggcaccctgatcgcaatagaccccttcgatgaccggagagaggccggtggcgagtcaacagttgtgaatccaaagtccgggagttggaactttttcgattggttctctggattgatgagctggtttggcgggccgctcaaaactatcctgctaatttgtctgtacgtcgcgctctccatcggactgttctttcttttgatttatctgggcaggaccggtttatcaaagatgtggctcgctgccacaaagaaagcatcttga

SEQ ID NO: 11236 - RNA, 3480 nt, synthetic construct
  misc_feature 1..3480: note = derived and/or modified CDS sequence (opt3) from RVFV(KEN/Bar-032/07)__HM586968.1__NSm-Gn-Gc
  source 1..3480: mol_type = other RNA
atgatcgagggcgcctgggacagcctgagagaagaggaaatgcccgaggaactctcctgctctgtgtcagggattagggaggtcaagaccagtagccaggagctttaccgggctctgaaagcaataatcgccgcggatggattgaacaatattacatgtcacggtaagaaccctgaagacaaaatctccttaattaagggcccaccgcataaaaagcgcgttgggatcgtgcgatgcgagcgtagaagggatgctaagcaaataggacgggaaactatggccggcatcgcaatgacggtactgcccgccctagctgtgttcgcactcgcccctgtcgtgtttgctgaggacccacatctgcgcaatagacccggtaaagggcacaactatattgatggaaggcttcaggaggacgccacctgtaagcctgttacatacgcgggcgcatgttcttcgttcgatgtgctgttggaaaaaggcaagtttccactcttccagtcatatgcccaccatcggactctgctggaggctgtccacgacaccatcattgccaaagcagatccccctagctgcgacctccagagtgctgatgggaataagtgcatgaaggaaaaattagtgatgaagacacactgtccaaacgactaccaatccgcccattatctgaataacgatggaaaaatggcgtctgtaaagtgcccgcccaaatacgagcttaccgaagactgtaatttttgccgccagatgactggtgccagcttgaagaaaggctcctatcctctgcaggacctattctgtcagtcaagtgaggatgacgggagcaagctcaagacaaaaatgaagggagtttgcgaggtgggcgtccaagcactgaaaaagtgcgatggtcagctttctaccgctcacgaagtggtgccatttgccgtcttcaaaaactccaagaaggtttacctggacaaattggatctcaagacggaggaaaatctgttacccgactcatttgtgtgtttcgagcataaagggcagtacaagggaactatggatagcggccagaccaaacgagaactgaagagttttgacatctctcaatgccctaagataggcgggcacggatccaaaaagtgtacaggtgatgctgccttctgcagcgcatatgagtgtactgcccagtacgctaacgcgtattgctcgcacgcaaatggctctgggattgtacagatccaagtgtccggagtctggaaaaagccactctgtgtgggctacgagagagttgtggtcaaaagggaactttcagccaagcccattcagcgggtggagccgtgcaccacatgtatcaccaagtgcgaacctcatggtctggtagttcgtagtacggggtttaaaatcagctccgctgtggcctgtgcatctggcgtctgcgtgactggaagccagtcacccagtacagagattaccttgaagtatccaggcatatcccagagctctgtcggggacatcggagtgcacatggcccatgatgaccaatcagttagtagcaaaattgtggctcactgccctccccaggacccatgtctagtacatggttgcatcgtctgtgcccacggcctgataaactaccagtgccacactgcactctccgcgttcgtggttattttcgtgttttcttcgacagctatcatctgtctggccgtcctttatcgcgtgctgaagtgcttgaaaattgcacccagaaaggtactcaatcctctgatgtggatcaccgccttcattaggtgggtgtacaaaaagatggttgctcgggtcgccgataacataaaccaggtgaatcgagaaatcgggtggatggagggaggccaattagcactgggtaacccagctccgattccccgccatgcccctatcccaagatacagcacgtatctaatgctcctgcttatcgtgtcctacgcgtcagcctgtagtgagttgattcaggcttctagcaggataaccacatgctccactgaaggggtcaataccaagtgtcggctgtcacacacagcactcatccgcgccggcagcgttggagctgaggcctgcctgatgcttaaaggcgtgaaggaagaccagactaaatttctgaagattaaaaccgtgtcttccgagttgagttgtagagaggggcagagctattggacaggatctttctcccccaagtgcctctcaagtaggcgttgccatctggtaggtgaatgtcacgtcaaccggtgcttaagctggcgagataatgagacctcggcagaattttccttcgtgggcgagtctactacgatgagagaaaacaagtgttttgagcaatgcgggggatggggctgtggttgcttcaatgttaaccctagctgtctgtttgtgcacacatacctacagtcagtcaggaaagaggcgctccgcgtgttcaattgcatcgactgggttcataagctgacccttgaaattactgattttgacgggagtgtgtccaccatcgatttgggcgcctctagctcccggttcacaaactggggatcagtaagcctgagtctcgacgctgagggcatatctgggtccaatagcttttcgttcatcgaatcaccaggaaaaggctatgccattgtcgatgagcccttctctgaaatcccgagacagggttttctgggggagattaggtgtaacagtgagtccagcgtgttatctgcacacgaaagctgcctgcgcgctcctaatcttgtgtcctacaagccaatgatcgaccagttggagtgtaccactaacctcatagatcccttcgtcgtttttgaacgaggatcactgcctcaaacacggaatgacaaaacgttcgccgcaagtaagggcaaccgtggtgtgcaggcctttagcaagggctctgtacaggctgatctaaccctgagattcgacaactttgaggtggacttcgtcggggcggccgtgtcctgcgatgcagcttttctcaatctgactggatgctattcatgtaacgccggcgccagggtttgccttagtattacaagcaccgggacaggaactttgtccgctcataataaagacggctctctgcacatcgtgttaccctcggaaaacggtaccaaggatcaatgtcagattctccatttcacggtcccagaggtggaggaagagtttatgtacagctgcgacggggatgaacgccctctgcttgttaaaggaaccctgatcgcaatagaccccttcgatgaccggagagaggccggcggtgagtcaacagtggtcaatccaaagtccggcagttggaactttttcgattggttctctgggttgatgagctggtttggaggcccgctcaaaactatcctgctaatttgtctgtacgtagcgctctccatcgggctgttctttcttttgatttatctgggaaggaccggcttatcaaagatgtggctcgctgccacaaagaaagcatcttga

SEQ ID NO: 11237 - RNA, 3480 nt, synthetic construct
  misc_feature 1..3480: note = derived and/or modified CDS sequence (opt3) from RVFV(TAN/Dod-002/07)__HM586971.1__NSm-Gn-Gc
  source 1..3480: mol_type = other RNA
atgatcgagggcgcctgggacagcctgagagaagaggaaatgcccgaggaactctcctgctctgtgtcagggattagggaggtcaagaccagtagccaggagctttaccgggctctgaaagcaataatcgccgcggatggattgaataatattacatgtcacggtaagaaccctgaagacaaaatctccttaattaagggcccaccgcataaaaagcgcgttgggatcgtgcgatgcgagcgtagaagggatgctaagcaaataggacgggaaactatggccggcatcgcaatgacggtactgcccgccctagctgtgttcgcactcgcccctgtcgtgtttgctgaggacccacatctgcgcaatagacccggtaaagggcacaactatattgatggaatgacccaggaggacgccacatgtaagcctgttacttacgcgggcgcatgttcttcgttcgatgtgcttctggaaaaaggcaagtttccattgttccagtcatatgcccaccataggaccctcctggaggctgtccacgacacaatcattgccaaagcagatccccctagctgcgacctgcagagtgctcacgggaatccatgcatgaaggaaaagctcgtgatgaaaacccattgtccgaacgattaccaatccgcccactatttaaataacgacggaaagatggcgtctgtaaaatgtccccctaagtacgagctgactgaagattgcaatttttgccggcagatgacaggtgccagccttaaaaagggctcctatccattgcaggacctgttctgtcagtcaagtgaggacgatgggagcaaactaaagaccaagatgaaaggagtttgcgaggtgggcgtccaagcactcaagaaatgcgacggtcagctgtctacggctcatgaagtggtgccctttgccgtcttcaagaactccaaaaaggtttaccttgataagctggacttgaaaactgaggaaaatctcctgcctgattcatttgtgtgtttcgagcacaaggggcagtacaaaggaaccatggacagcggccagacaaagcgcgaattaaaaagttttgatatctctcaatgcccaaagataggcgggcacggacgaaagaaatgtactggtgacgctgccttctgctccgcatatgagtgtaccgcccagtacgctaacgcgtattgcagccatgcaaatggctcggggattgtacagatccaagtgtctggagtctggaagaaacccctgtgtgtgggctacgagagagttgtggtcaagagggaactctccgccaaaccgattcagcgggtggagccttgcacaacctgtatcacgaagtgcgaaccccacggtcttgtagttcgttcaactgggtttaagatcagtagcgctgtggcctgtgcatccggcgtctgcgtgacaggatctcagagcccatcaaccgagattactctgaaatatcctggcataagtcagtccagcgggggagatatcggtgtccatatggcccacgacgatcaatctgtgtcaagtaagattgttgctcattgtcccccacaggacccctgcttggtgcacggctgcatcgtatgtgcccaggcatggataattagccagtggcacacagcgctatccgctttcgtcgtgatcttcgtgttttcttcgaccgccatcatttgcctggcagttctctaccgcgtcctgaaatgtcttaagatcgcccctagaaaagtgctgaacccattgatgtggattacggctttcataaggtgggtatataagaaaatggtggcccgggttgcagacaatatcaaccaagtcaaccgagaaattgggtggatggagggaggccagctcgctctgggtaatccggcccccatccctcgccatgcgccaatccccagatacagcacctacttaatgctgctactcattgtgtcctatgcctcagcttgcagtgagctgatacaggcatctagcaggatcacaacttgttccaccgaaggggtgaacacaaagtgccggctttcaggcactgccttgattcgcgctggaagcgtcggcgccgaggcatgtctgatgctcaagggggttaaagaagatcagaccaagtttctgaaaatcaagacagtgtcttccgagcttagttgcagagagggacaaagctactggaccggttctttctcccctaaatgtctgtcaagtaggcgttgccacttggtgggcgaatgccatgtaaatcggtgtctcagctggcgagacaacgagacttcggcggaattttccttcgtcggggagtctacgacaatgagagaaaataagtgctttgagcagtgtggaggctggggttgcgggtgtttcaacgtgaatccaagctgcctgtttgttcacacctatttacagtcagtgaggaaggaggccctgcgcgtcttcaactgtattgattgggtgcacaaactaactctcgaaatcaccgactttgatggcagtgtttccacaatagacctgggagcttctagctcccggttcaccaattggggctcagtgagccttagtttggatgccgaggggatctctggatccaacagcttttcgttcattgaatcacccggcaagggttacgcaatcgtagacgagccgttctctgaaattcctagacaggggtttctgggagagatcaggtgcaatagtgagtccagcgtcctctctgctcatgaaagctgtctgcgcgccccaaacttagtgtcctataaacccatgatagatcaactggagtgcactacaaatcttattgaccctttcgtggtctttgaacgaggctcattgccccagacgcggaacgataagaccttcgcagccagtaaaggtaatcgtggcgttcaggcttttagcaaggggtctgtgcaagcggacctcactctgatgttcgataactttgaggtagacttcgtgggagccgcagtctcctgtgacgctgcctttctaaacctgacaggctgctactcatgcaatgccggggctagagtgtgtctcagtatcaccagcacaggaactggcaccctgtccgcacacaacaaggatggttctcttcatattgttttgccatcggaaaatgggacgaaagaccagtgccagatcctgcacttcaccgtgcctgaggtcgaggaagagtttatgtatagctgtgatggagacgaaaggcccttactcgtgaagggcacactgatagccatcgatccattcgacgatcgccgggaggcgggtggcgagtcaactgttgtgaacccgaaatccgggagttggaactttttcgactggttctctggacttatgagctggtttggcgggcctctgaagaccattttgctcatctgcctgtacgtcgctctatccattggactgttctttctcctgatctaccttggcagaacaggtttgtcaaaaatgtggctggccgcaactaagaaggcctcttga

SEQ ID NO: 11238 - RNA, 3480 nt, synthetic construct
  misc_feature 1..3480: note = derived and/or modified CDS sequence (opt3) from RVFV(Smithburn)__DQ380193.1__NSm-Gn-Gc
  source 1..3480: mol_type = other RNA
atgatcgagggcgcctgggacagcctgagagaagaggaaatgcccgaggaactctcctgctctatttcagggataagggaggtgaagaccagtagccaggagctttaccgggctctgaaagcaacaatcgccgcggatggattgaacaatattacttgtcacggtaaggaccctgaagataaaatctccttaattaagggcccaccgcataaaaagcgcgtcggggttgtgcgatgcgagcgtcaaagagacgctaagcagatcggaaggggcacgatggccggtatagcaatgaccgtattccccgccctggtggtctttgctctagcacctgtggttttcgccgaagatccacacctccggaaccgccccgggaaaggacataattatatcgacggcatgacacaggaggatgctacttgtaagcctgtgacctacgccggcgcgtgttcttcgtttgacgtcctgcttgagaaagggaagttcccactgtttcagtcatatgcacaccatagaacattgctcgaagccgtgcacgatattatcattgctaaagccgatccccctagctgcaacctgcaaagtgcacacggaaatccatgcatgaaggagaagctggtaatgaaaacctactgtccgaacgactatcagtccgctcattacctcaataacgacggtaagatggcctctgttaaatgtccccctaagcacgaattaactgaggattgcaatttctgcaggcagatgacaggcgcgagcctgaaagaagggtcctatccacttcaggacttgttttgtcaatcaagtgaggacgatggaagcaagctgaaaaccaagatgaagggcgtgtgcgaggtcggtgtccaggtgctaaagaagtgcgacgggcagctctctacggcccatgaagtggttcccttcgcagtgtttaaaaactccaagaaagtatacctggataaacttgacctgaagactgaggaaaatttgctccctgattcattcgtgtgttttgagcacaaaggacagtacaagggcaccatggacagcggccaaatcaaacgggaactgaagagtttcgatatatctcagtgcccaaaaattgggggacacggttccaagaagtgtacaggcgacgctgccttttgcagcgcttatgagtgtactgcccagtacgcaaacgcctattgctcgcatgctaatgggtctggaatcgtccaaattcaggtgtccggcgtttggaaaaagcccttatgtgtgggttacgagcgcgtcgtggtaaaacgagaactgtcagcgaagccgatccagagagttgagccttgcaccacatgtatcaccaaatgcgaaccccacgggctcgtggtcaggagtacgggcttcaagattagctccgcagtggcctgtgcttctggagtctgcgtgactggcagccagtcaccaagtacagagataacccttaagtatcctgggatctcccaaagctctggaggtgatattggcgttcatatggcccacgacgatcagtcagtgagtagcaaaatcgtagcacattgtcccccacaggacccctgcctggtccacgggtgcatagtgtgtgcccacggattgattaactaccagtgccatactgctttctccgcctttgttgtggtcttcgtgttttcttcggtagtgatcatctgtctagcaattctgtataaggttctcaaatgcctgaagatcgcgcctcggaaagtccttaatccactgatgtggattacagctttcatacgttgggtgtacaagaaaatggtggcccgcgtcgcagacaacatcaaccaagttaatagagaaattggctggatggagggtgggcagttggtgctcggcaacccggcccccatccctaggcacgctccaatcccccggtacagcacctatctgatgttactgctaattgtgtcctacgcctcagcatgtagtgagctcatacaggcttctagccgaatcacgacctgctccacagaaggagtaaatactaagtgtcgcctgtcaggcaccgcccttattagagcggggagcgtcggagccgaggcttgcttgatgctgaagggtgtgaaagaagatcagacaaagtttctcaaaatcaagactgtttcttccgagctgagttgtagggagggccaaagctattggaccgggtctttctcccctaaatgcctttcaagtcggcgctgccatctggtgggagaatgtcacgtcaacagatgcttgagctggagggacaatgagacatcggcagaattttccttcgtgggcgagtctaccactatgcgtgaaaacaagtgttttgagcagtgcggtgggtggggctgtggatgcttcaatgttaacccaagctgtctctttgtgcacacgtacctgcagtcagtacggaaggaggccttacgagtcttcaattgcattgattgggtgcataaactgacactagaaatcaccgactttgatggcagtgtgtccactgtcgacctcggggcttctagctccagattcaccaactggggatcagttagcctgagtcttgatgccgagggcatatctggttccaatagcttctcgtttatcgaatcacccgggaagggatatgcaattgtggacgagccgttctctgaaatccctaggcagggctttttgggtgagattcgctgtaacagtgagtccagcgtactgtctgcgcacgaaagctgcctccgggccccaaatctgatctcctacaaacccatgatagatcaattagagtgtacaaccaacctgattgaccctttcgtggtctttgaaagaggctcacttccccagactaggaatgataagacattcgctgccagtaaagggaaccgcggagtgcaggcatttagcaagggctctgttcaagctgacttgacgctcatgttcgataactttgaggtggacttcgtcggggccgcagtgtcctgcgacgccgcttttctgaatctaaccggatgctattcatgtaacgcgggcgcccgagtttgcctgagtatcactagcacaggtaccgggacactctccgcacataataaggatggatctctgcacattgtgcttccatcggaaaacggcactaaagaccagtgtcagatcttgcatttcaccgtccctgaggtagaggaagagtttatgtacagctgcgatggtgacgaacggcccctgttagtgaagggcacgctcatagctatcgatccattcgacgatcgtagagaggccgggggagagtcaaccgttgtgaatccgaaatccggcagttggaacttctttgactggttctctgggctgatgagctggtttggaggccctcttaagacaattctgttgatctgtctctacgtcgccctgtccattggtctattctttttcctgatctatctcgggaggactggactgtcaaaaatgtggcttgctgcaaccaagaaggcctcttga

SEQ ID NO: 11239 - RNA, 3480 nt, synthetic construct
  misc_feature 1..3480: note = derived and/or modified CDS sequence (opt3) from RVFV(KEN/Gar-004/06)__HM586964.1__NSm-Gn-Gc
  source 1..3480: mol_type = other RNA
atgatcgagggcgcctgggacagcctgagagaagaggaaatgcccgaggaactctcctgctctgtgtcagggattagggaggtcaagacaagtagccaggagctttaccgggctctgaaagcaataatcgccgcggatggattgaataatattacatgtcacggtaagaaccctgaagacaaaatctccttaattaagggcccaccgcataaaaagcgcgttgggatcgtgcgatgcgagcgtagaagggatgctaagcaaataggacgggaaactatggccggcatcgcaatgacggtactgcccgccctagctgtgttcgcactcgcccctgtcgtgtttgctgaggacccacatctgcgcaatagacccggtaaagggcacaactatattgatggaatgacccaggaggacgccacatgtaagcctgttacttacgcgggcgcatgttcttcgttcgatgtgcttctggaaaaaggcaagtttccattgttccagtcatatgcccaccataggaccctcctggaggctgtccacgacacaatcattgccaaagcagatccccctagctgcgacctgcagagtgctcacgggaatccatgcatgaaggaaaagctcgtgatgaaaacccattgtccgaacgattaccaatccgcccactatttaaataacgacggaaagatggcgtctgtaaaatgtccccctaagtacgagctgactgaagattgcaatttttgccggcagatgacaggtgccagccttaaaaagggctcctatccattgcaggacctgttctgtcagtcaagtgaggacgatgggagcaaactaaagaccaagatgaaaggagtttgcgaggtgggcgtccaagcactcaagaaatgcgacggtcagctgtctacggctcatgaagtggtgccctttgccgtcttcaagaactcccagaaagtttaccttgataagctggacttgaagactgaggaaaatctcctgcctgattcatttgtgtgtttcgagcacaaagggcagtacaagggaaccatggacagcggccaaacaaaacgcgaattaaagagttttgatatctctcagtgcccaaaaataggcgggcacggacgaaagaagagaactggtgacgctgccttctgttccgcatatgagtgcaccgcccagtacgctaacgcgtattgtagcagggcaaatggctcggggattgtacaaatccaggtgtctcgggtctggaaaaagcccctgtgcgtgggatacgagcgtgttgtggtcaaacgcgaactctccgccaagccgattcagagagtggagccttgtacaacctgcatcacgaaatgtgaaccccatggccttgtagttaggtcaactggttttaagatcagtagcgctgtggcctgcgcatccggggtctgtgtgacaggctctcagagcccatcaaccgagattactctgaagtatcctggaataagtcaatccagcggcggggatatcggagtccacatggcccatgacgatcagtctgtgtcaagtaaaattgttgctcactgtcccccacaggacccctgcttggtgcatggttgcatcgtatgcgcccacggcctaataaacaatcagagccactccgcactgtctgcgttcgtcgtgattttcgtgttttcgagcacagctatcatctgtctcgccgttctgtaccgggtccttaagtgcctgaaaattgcacctcgaaaggtgttgaacccactcatgtggatcaccgccttcattcgctgggtatataaaaagatggtggctagagttgccgacaacataaatcaagtcaacagggaaatcgggtggatggagggaggccagctggcattaggtaatccggctcccattcctcggcatgccccaatcccccgctactccacgtacctgatgctactcctgatcgtgtcatatgcgagtgcctgttctgagcttattcaggctagctccagaataaccacatgctcaactgaaggggtgaacaccaaatgtaggttgagcggcacagcactgatccgtgccggatctgtcggcgctgaggcctgcctcatgctgaagggggttaaggaagatcagactaaatttcttaagattaaaaccgtgtccagtgagctgagctgtcgggagggacaatcttactggacaggttccttctcacctaagtgcttgagtagccgaagatgtcacctcgtgggcgaatgccatgtaaataggtgcctgtcgtggcgcgacaacgagacctccgcagaattttctttcgtcggggagagcactacgatgcgggaaaataaatgttttgagcagtgcggaggctggggttgtgggtgcttcaacgtgaatccatcatgtttatttgttcacacatatctgcagagtgtgagaaaggaggcgctaagggtcttcaactgcatcgattgggtgcacaagctcaccctggaaattactgactttgatggctccgtttctaccatcgaccttggagccagctcctcacgcttcacaaattggggcagcgtgagtttgtctctggatgctgaggggatatccggaagcaactcgttttcattcatcgaatctcccggcaaaggttacgccattgtagacgagccgttcagtgaaatccctcgacaggggtttctcggagagattcggtgtaattccgagagctctgtcctgagcgcacatgaatcctgcttacgtgctccaaacctggtgtcatataagcccatgatcgatcaacttgagtgtaccactaatttgatagaccctttcgtggtctttgaaagaggcagtctcccccagacaaggaacgataaaacgttcgccgcaagcaagggtaaccgcggcgttcaggccttttctaaagggtccgtgcaagctgacctgaccctacggttcgataattttgaggtagacttcgtgggagcggccgtctcatgcgacgcagcttttctgaacctcactggctgttacagttgcaatgccggggccagagtgtgcctgagcattacatccaccggaacaggcactctttctgctcacaacaaggatggttcgttgcatatcgttctgccaagcgaaaatgggaccaaggaccagtgtcagattttacacttcacggtgcctgaggtcgaggaagagtttatgtattcatgcgatggagacgaaaggcccctcctggtgaaaggcacccttatcgcaatagatccattcgacgatcgacgcgaggccggtggcgagtccacagttgtgaacccgaagagtgggtcttggaactttttcgactggttcagcggactgatgtcctggtttggcgggcctttgaaaactatcctcctgatttgtctatacgtcgcgctgtcaatcggactcttctttctgcttatttacttgggccggaccggtctgtctaagatgtggttagctgccaccaaaaaggcaagctga

SEQ ID NO: 11240 - RNA, 3204 nt, synthetic construct
  misc_feature 1..3204: note = derived and/or modified CDS sequence (opt3) from RVFV(ZH-548)__DQ380206.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcttagtgcgcatggaaacccttgtatgaaagagaagctggtgatgaagactcactgcccaaatgattatcagagcgcacactacttgaacaatgacggcaaaatggcctccgttaagtgtccccctaaatatgaactcaccgaggattgcaacttttgtcgccagatgacaggtgcttctctgaagaaagggtcgtacccactgcaggacctcttctgccaatcaagcgaggatgacggaagtaagttaaagaccaaaatgaagggcgtgtgtgaagtcggcgtgcaggccctgaaaaagtgcgatgggcagctttccactgcacatgaggtagttccgtttgctgtgttcaaaaattctaagaaagtctatttggacaagctggacctaaagacagaagagaacctcctgcccgatagctttgtgtgtttcgagcacaaaggacagtacaagggtaccatggactccggccaaacgaaacgagaacttaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcagatccaagtcagcggcgtttggaaaaagccactgtgcgtgggctatgaacgtgtagtggtcaaaagagagttgagtgccaagcccatacagagggtggaaccttgtacaacttgcatcaccaaatgtgagccacacgggctcgttgtgcggtctacaggatttaagatttccagcgcagtcgcctgcgcttcgggtgtgtgtgtaaccggctctcagtccccctcaacggagatcactctgaagtacccggggattagtcaaagctccggaggcgatatcggtgttcatatggcgcacgacgatcagtctgtgagctcaaaaatagtcgcacattgccctccccaggacccatgtttagtgcacgattgcattgtctgcgcccatgggctgatcaattatcagtgtcacacagctctcagtgccttcgtggttgtgttcgtattttccagcattgcaatcatctgccttgccattctgtaccgcgtcttgaagtgtctaaaaatagctcctagaaaggtgctgaaccccctcatgtggatcaccgccttcattaggtggatctataaaaagatggttgcacgggtggcggacaatataaaccaagtcaatcgcgaaattggctggatggagggaggccagctggtgcttgggaacccagctcccatccctcgacacgccccaatcccgagatactctacttacctgatgttgctcctgattgtatcatatgcaagtgcctgcagcgaattaatccaggcttcctctaggattacaacctgttcgacggagggagtgaacaccaagtgccggctgagcggtacagccctaatacgtgcaggctccgttggggctgaagcctgtctcatgctgaaaggagtcaaggaggatcagactaaatttcttaagatcaaaaccgtgtcaagtgagttgtcttgccgcgaaggccaaagctactggacaggttccttctcacccaagtgtctgagctctagaaggtgccatctcgtgggggagtgtcacgtcaatcggtgcctgtcctggcgagacaacgaaaccagtgcggagtttagcttcgttggcgaatctactacaatgcgcgagaataaatgctttgagcagtgtggaggctgggggtgcggatgtttcaacgtgaatccttcctgcctttttgtgcatacctatctgcagtcagtaagaaaggaagccttgagggtcttcaactgtattgactgggtgcacaagctcactctggagatcacggattttgacggtagtgttagcacaatcgatttaggcgcttcgtcctctcggttcaccaattgggggagcgtgtcactgagtctagacgcagaaggaatttccggctctaacagcttttccttcatagagtcaccaggtaaagggtacgccatcgtcgatgagcccttcagcgaaattcctcgccagggctttctcggagagatcagatgcaatagtgaatcttccgtgctgagcgctcacgagtcgtgtcttagggccccaaacttgatttcatataagcccatgatcgaccaactggaatgcactaccaatctcatagatccgttcgttgtgtttgagcgtggctctctgcctcagacacggaacgacaaaaccttcgcagcgagtaaggggaatcgaggagtacaggccttttccaaaggcagcgtccaggctgatttaactctgatgttcgacaactttgaggtggatttcgtgggtgccgcagtctcttgtgacgctgcctttcttaatttgacagggtgctacagctgtaacgcaggagccagagtttgcctctccatcacgtcaaccggcactggtagtctgagcgctcataacaaggatggctctctacacattgtgctgccatccgaaaatgggacaaaggaccaatgccagatcctccatttcaccgtacccgaggtggaagaggaatttatgtattcatgtgacggagatgagaggcctctgcttgtcaaaggcacattgattgcgatcgaccccttcgatgaccgccgggaggccgggggagaaagtactgtggttaacccaaagagcggctcctggaactttttcgattggttctctggtctgatgtcgtggtttgggggacctttaaaaaccatactcctgatttgcctttacgtggcactgagcatcggcttgttctttctcctgatttacctaggtagaacgggcctgtcaaagatgtggctcgctgccaccaaaaaggcctcctga

SEQ ID NO: 11241 - RNA, 3204 nt, synthetic construct
  misc_feature 1..3204: note = derived and/or modified CDS sequence (opt3) from RVFV(2007000094)__EU574055.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattatcaatgtcacacagctctgagtgccttcgtggttgtgttcgtattttccagcattgcaatcatctgcctcgccattctttaccgcgtcctgaagtgtttgaaaatagctcctagaaaggtgctaaaccccctgatgtggatcaccgccttcattaggtgggtttataaaaagatggtggcacgggtcgcggataatatcaaccaggtgaatcgcgaaataggatggatggagggcgggcagctcgtactgggaaacccagctcccattcctcgacacgccccaatcccgagatactctacttaccttatgctgttgctcatcgtgtcatatgcaagtgcctgcagcgaactgattcaggcttcctctaggatcacaacctgttcgacggagggtgttaacaccaagtgccggttaagcggcacagccctgattcgtgcagggtccgtcggagctgaagcctgtctaatgctcaaaggcgtgaaggaggaccaaactaaatttctgaagataaaaaccgtgtcaagtgagctttcttgccgcgaaggtcagagctactggacagggtccttctcacccaagtgtttgagctctagaaggtgccatctggtcggcgagtgtcacgttaatcggtgcctctcctggcgagataacgaaacaagtgcggagtttagcttcgtgggagaatctaccacaatgcgcgagaataaatgctttgagcagtgtggcgggtggggatgcggttgtttcaacgtgaatccttcctgcctgtttgtacatacctatcttcagtcagtcagaaaggaagccctgagggtgttcaactgtatcgactgggttcacaagttgactctcgagattacggactttgatggcagtgtgagcacaatcgacctgggggcttcgtcctctcggttcaccaattggggaagcgtctcattaagtctggatgcagaaggcatctccggttctaacagcttttccttcattgagtcaccagggaaaggctacgccatagtggacgagcccttcagcgaaatccctcgccaaggatttctaggcgagattagatgcaatagtgaatcttccgttctcagcgctcacgagtcgtgtctgagggccccaaaccttatctcatataagcccatgattgatcagttggaatgcactaccaatctgatcgacccgttcgtggtatttgagcgtgggtctctccctcagacacggaacgataaaaccttcgcagcgagtaagggaaatcgaggcgtccaggccttttccaaaggtagcgtgcaagctgacctgactttaatgttcgataactttgaggtggacttcgtcggggccgcagtttcttgtgatgctgcctttctgaatcttacaggatgctacagctgtaacgcaggcgccagagtgtgcttgtccataacgtcaaccggtactggcacactcagtgctcataacaaggacgggagcctgcacatcgtactaccatctgaaaatggaaccaaggatcagtgccagattctgcatttcacagtgcccgaggtcgaagaggaatttatgtattcctgtgacggcgacgagaggcctctcctggtgaaagggactcttatcgcgattgatcccttcgacgatcgccgggaggccggaggcgaatcaaccgttgtgaacccaaagagtggtagctggaactttttcgactggttctccgggttgatgtcttggtttggaggccctctgaaaacgatcttactcatatgcctgtacgtcgcactttcgattggtctgttctttttgctcatctacctgggcagaaccgggctaagcaagatgtggctggctgccactaaaaaggcctcatga

SEQ ID NO: 11242 - RNA, 3204 nt, synthetic construct
  misc_feature 1..3204: note = derived and/or modified CDS sequence (opt3) from RVFV(ZH-548M12)__M25276.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcttagtgcgcatggaaacccttgtatgaaagagaagctggtgatgaagactcactgcccaaatgattatcagagcgcacaccatttgaacaatgacggcaaaatggcctccgttaagtgtccccctaaatacgaactcaccgaggattgcaacttttgtcgccagatgacaggtgcttctctgaagaaagggtcgtatccactgcaggacctcttctgccaatcaagcgaggatgacggaagtaagttaaagaccaaaatgaagggcgtgtgtgaagtcggcgtgcaggccctgaaaaagtgcgatgggcagctttccactgcacacgaggtagttccgtttgctgtgttcaaaaattctaagaaagtctacttggacaagctggacctaaagacagaagagaacctcctgcccgatagctttgtgtgtttcgagcataaaggacagtataagggtaccatggactccggccaaacgaaacgagaacttaagtcatttgatattagtcagtgccctaaaatcgggggacacggcagcaagaagtgcactggtgacgccgcgttctgttctgcctacgagtgcaccgcacagtacgctaatgcctattgttcccacgctaacgggtcaggaattgtgcagatccaagtcagcggcgtttggaaaaagccactgtgcgtgggctacgaacgtgtagtggtcaaaagagagttgagtgccaagcccatacagagggtggaaccttgtacaacttgcatcaccaaatgtgagccacatgggctcgttgtgcggtctacaggatttaagatttccagcgcagtcgcctgcgcttcgggtgtgtgtgtaaccggctctcagtccccctcaacggagatcactctgaagtatccggggattagtcaaagctccggaggcgatatcggtgttcacatggcgcatgacgatcagtctgtgagctcaaaaatagtcgcacactgccctccccaggacccatgtttagtgcatgattgcattgtctgcgcccacgggctgatcaattaccagtgtcacacagctctcagtgccttcgtggttgtgttcgtattttccagcattgcaatcatctgccttgccattctgtatcgcgtcttgaagtgtctaaaaatagctcctagaaaggtgctgaaccccctcatgtggatcaccgccttcattaggtggatctacaaaaagatggttgcacgggtggcggacaatataaaccaagtcaatcgcgaaattggctggatggagggaggccagctggtgcttgggaacccagctcccatccctcgacatgccccaatcccgagatattctacttacctgatgttgctcctgattgtatcatacgcaagtgcctgcagcgaattaatccaggcttcctctaggattacaacctgttcgacggagggagtgaacaccaagtgccggctgagcggtacagccctaatacgtgcaggctccgttggggctgaagcctgtctcatgctgaaaggagtcaaggaggatcagactaaatttcttaagttgaaaaccgtgtcaagtgagctgtcttgccgcgaaggccaaagctattggacaggttccttctcacccaagtgtctcagctctagaaggtgccacctggtgggggagtgtcatgtcaatcggtgcctttcctggcgagacaacgaaaccagtgcggagtttagcttcgttggcgaatctactacaatgcgcgagaataaatgctttgagcagtgtggaggctgggggtgcggatgtttcaacgtgaatccttcctgcctgtttgtgcacacctacttgcagtcagtaagaaaggaagccctcagggtcttcaactgtatcgactgggtgcacaagctgactttagagattacggattttgacggtagtgttagcacaatcgatctgggcgcttcgtcctctcggttcaccaattgggggagcgtgtcactaagtctcgacgcagaaggaatctccggctctaacagcttttccttcattgagtcaccaggtaaagggtatgccatagtcgatgagcccttcagcgaaatccctcgccagggctttctgggagagattagatgcaatagtgaatcttccgtgcttagcgctcatgagtcgtgtttgagggccccaaacctgatctcatacaagcccatgattgaccaactcgaatgcactaccaatctgatcgatccgttcgttgtgtttgagcgtggctctttacctcagacacggaacgacaaaaccttcgcagcgagtaaggggaatcgaggagtacaggccttttccaaaggcagcgtccaggctgatctgactcttatgttcgacaactttgaggtggatttcgtgggtgccgcagtctcttgtgacgctgcctttttgaatctcacagggtgctatagctgtaacgcaggagccagagtttgcctgtccataacgtcaaccggcactggtagtctaagcgctcacaacaaggatggctctctgcatatcgtgctcccatccgaaaatgggacaaaggaccaatgccagattctgcacttcaccgtacccgaggtggaagaggaatttatgtactcatgtgacggagatgagaggcctcttttggtcaaaggcacactgatcgcgattgaccccttcgatgaccgccgggaggccgggggagaaagtactgtggttaacccaaagagcggctcctggaactttttcgattggttctctggtttaatgtcgtggtttgggggacctctcaaaaccatcctgcttatatgcctgtatgtggcattgagcattggcctcttctttctgctaatctacctgggtggcacggggctctcaaagatgtggctggctgccaccaaaaaggcctcctga

SEQ ID NO: 11243 - RNA, 3204 nt, synthetic construct
  misc_feature 1..3204: note = derived and/or modified CDS sequence (opt3) from RVFV(Sudan 86-2010)__JQ820489.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattatcaatgtcacacagctctgagtgccttcgtggttgtgttcgtattttccagcattgcaatcatctgcctcgccattctttaccgcgtcctgaagtgtttgaaaatagctcctagaaaggtgctaaaccccctgatgtggatcaccgccttcattaggtgggtttataaaaagatggtggcacgggtcgcggataatatcaaccaggtgaatcgcgaaataggatggatggagggcgggcagctcgtactgggaaacccagctcccattcctcgacacgccccaatcccgagatactctacttaccttatgctgttgctcatcgtgtcatatgcaagtgcctgcagcgaactgattcaggcttcctctaggatcacaacctgttcgacggagggtgttaacaccaagtgccggttaagcggcacagccctgattcgtgcagggtccgtcggagctgaagcctgtctaatgctcaaaggcgtgaaggaggaccaaactaaatttctgaagataaaaaccgtgtcaagtgagctttcttgccgcgaaggtcagagctactggacagggtccttctcacccaagtgtttgagctctagaaggtgccatctggtcggcgagtgtcacgttaatcggtgcctctcctggcgagataacgaaacaagtgcggagtttagcttcgtgggagaatctaccacaatgcgcgagaataaatgctttgagcagtgtggcgggtggggatgcggttgtttcaacgtgaatccttcctgcctgtttgtacatacctatcttcagtcagtcagaaaggaagccctgagggtgttcaactgtatcgactgggttcacaagttgactctcgagattacggactttgatggcagtgtgagcacaatcgacctgggggcttcgtcctctcggttcaccaattggggaagcgtctcattaagtctggatgcagaaggcatctccggttctaacagcttttccttcattgagtcaccagggaaaggctacgccatagtggacgagcccttcagcgaaatccctcgccaaggatttctaggcgagattagatgcaatagtgaatcttccgttctcagcgctcacgagtcgtgtctgagggccccaaaccttatctcatataagcccatgattgatcagttggaatgcactaccaatctgatcgacccgttcgtgatatttgagcgtgggtctctccctcagacacggaacgataaaaccttcgcagcgagtaagggaaatcgaggcgtacaggccttttccaaaggtagcgtccaagctgacctgactttaatgttcgataactttgaggtggacttcgtgggggccgcagtctcttgtgatgctgcctttctgaatcttacaggatgctacagctgtaacgcaggcgccagagtttgcttgtccatcacgtcaaccggtactggcacactcagtgctcataacaaggacgggagcctgcacattgtgctaccatctgaaaatggaaccaaggatcagtgccagatcctgcatttcacagtacccgaggtggaagaggaatttatgtattcctgtgacggcgacgagaggcctctcctggtcaaagggactcttattgcgatcgatcccttcgacgatcgccgggaggccggaggcgaatcaaccgtggttaacccaaagagtggtagctggaactttttcgactggttctccgggttgatgtcttggtttggaggccctctgaaaacgatattactcatttgcctgtacgtggcactttcgatcggtctgttctttttgctcatttacctgggcagaaccgggctaagcaagatgtggctggctgccactaaaaaggcctcatga

SEQ ID NO: 11244 - RNA, 3204 nt, synthetic construct
  misc_feature 1..3204: note = derived and/or modified CDS sequence (opt3) from RVFV(ZS-6365)__DQ380205.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattatcaatgtcacacagctctgagtgccttcgtggttgtgttcgtattttccagcattgcaatcatctgcctcgccattctttaccgcgtcctgaagtgtttgaaaatagctcctagaaaggtgctaaaccccctgatgtggatcaccgccttcattaggtggatctataaaaagatggttgcacgggtggcggataatataaaccaggtcaatcgcgaaattggatggatggagggcgggcagctcgtgctgggaaacccagctcccatccctcgacacgccccaatcccgagatactctacttaccttatgctgttgctcattgtatcatatgcaagtgcctgcagcgaactgatccaggcttcctctaggattacaacctgttcgacggagggtgtgaacaccaagtgccggttaagcggcacagccctgatacgtgcagggtccgttggagctgaagcctgtctaatgctcaaaggcgtcaaggaggaccaaactaaatttctgaagatcaaaaccgtgtcaagtgagctttcttgccgcgaaggtcagagctactggacagggtccttctcacccaagtgtttgagctctagaaggtgccatctggtgggcgagtgtcacgtcaatcggtgcctctcctggcgagataacgaaaccagtgcggagtttagcttcgttggagaatctactacaatgcgcgagaataaatgctttgagcagtgtggcgggtggggatgcggttgtttcaacgtgaatccttcctgcctgtttgtgcatacctatcttcagtcagtaagaaaggaagccctgagggtcttcaactgtattgactgggtgcacaagttgactctcgagatcacggactttgatggcagtgttagcacaatcgacctgggggcttcgtcctctcggttcaccaattggggaagcgtgtcattaagtctggatgcagaaggcatttccggttctaacagcttttccttcatagagtcaccagggaaaggctacgccatcgtcgacgagcccttcagcgaaattcctcgccaaggatttctaggcgagatcagatgcaatagtgaatcttccgtgctcagcgctcacgagtcgtgtctgagggccccaaaccttatttcatataagcccatgatcgatcagttggaatgcactaccaatctgatagacccgttcgttgtgtttgagcgtgggtctctccctcagacacggaacgataaaaccttcgcagcgagtaagggaaatcgaggcgtacaggccttttccaaaggtagcgtccaagctgacctgactttaatgttcgataactttgaggtggacttcgtgggggccgcagtctcttgtgatgctgcctttctgaatcttacaggatgctacagctgtaacgcaggcgccagagtttgcttgtccatcacgtcaaccggtactggcagtctcagcgctcataacaaggacgggtctctgcacattgtgctaccatccgaaaatggaacaaaggatcagtgccagatcctgcatttcaccgtacccgaggtggaagaggaatttatgtattcatgtgacggcgacgagaggcctctcctggtcaaagggacacttattgcgatcgatcccttcgacgatcgccgggaggccggaggcgaaagtactgtggttaacccaaagagcggttcctggaactttttcgactggttctctgggttgatgtcgtggtttggaggccctctgaaaaccatattactcatttgcctgtacgtggcacttagcatcggtctgttctttttgctcatttacctgggcagaacggggctatcaaagatgtggctggctgccaccaaaaaggcctcctga

SEQ ID NO: 11245 - RNA, 3204 nt, synthetic construct
  misc_feature 1..3204: note = derived and/or modified CDS sequence (opt3) from RVFV(1853/78)__DQ380220.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggagtggtccaaattcaggttagcggcgtgtggaaaaagccactttgcgtaggctatgaacgtgtggtcgtgaaaagagagctgagtgccaagcccatccagagggttgaaccttgtacaacttgcataaccaaatgtgagccacacgggttggtggtccggtctacaggatttaagatctccagcgcagtggcctgcgcttcgggtgtatgtgttaccggctctcaatccccctcaacggagattactctcaagtacccggggatcagtcagagctccggaggcgatattggtgtgcatatggcgcacgacgatcagtctgtcagctcaaaaatcgtggcacattgccctccccaggacccatgtctggtccacgggtgcatagtgtgcgcccatggcttaattaattatcaatgtcacacagctctgagtgccttcgttgtggtattcgtcttttccagcatcgcaattatctgcctcgccatcctttaccgcgtgctgaagtgtttgaaaattgctcctagaaaggttctaaaccccctgatgtggataaccgccttcatcaggtgggtgtataaaaagatggtcgcacgggtggcggataatattaaccaggtaaatcgcgaaatcggatggatggagggcgggcagctcgtgctgggaaacccagctcccatacctcgacacgccccaattccgagatactctacttaccttatgctgttgctcatcgtttcatatgcaagtgcctgcagcgaactgatccaggcttcctctaggattacaacctgttcgacggagggtgtcaacaccaagtgccggttaagcggcacagccctgatccgtgcagggtccgtgggagctgaagcctgtctaatgctcaaaggcgtgaaggaggaccaaactaaatttctgaagattaaaaccgtctcaagtgagctttcttgccgcgaaggtcagagctactggacagggtccttctcacccaagtgtttgagctctagaaggtgccatctggttggcgagtgtcacgtgaatcggtgcctctcctggcgagataacgaaacaagtgcggagtttagcttcgtgggagaatctaccacaatgcgcgagaataaatgctttgagcagtgtggcgggtggggatgcggttgtttcaacgtaaatccttcctgcctgtttgtccatacctatcttcagtcagtgagaaaggaagccctgagggttttcaactgtatagactgggtgcacaagttgactctcgagatcacggactttgatggcagtgtcagcacaattgacctgggggcttcgtcctctcggttcaccaattggggaagcgtgtcattaagtctggatgcagaaggcatctccggttctaacagcttttccttcatcgagtcaccagggaaaggctacgccattgttgacgagcccttcagcgaaatacctcgccaaggatttctaggcgagatcagatgcaatagtgaatcttccgtgctcagcgctcacgagtcgtgtctgagggccccaaaccttatttcatataagcccatgatcgatcagttggaatgcactaccaatctgattgacccgttcgtagtctttgagcgtgggtctctccctcagacacggaacgataaaaccttcgcagcgagtaagggaaatcgaggcgtgcaggccttttccaaaggtagcgtgcaagctgacctgactttaatgttcgataactttgaggtcgacttcgttggggccgcagtgtcttgtgatgctgcctttctgaatcttacaggatgctacagctgtaacgcaggcgccagagtatgcttgtccatcacgtcaaccggtactggcacactcagtgctcataacaaggacgggagcctgcacatagtgctaccatctgaaaatggaaccaaggatcagtgccagatcctgcatttcacagtccccgaggtggaagaggaatttatgtattcctgtgacggcgacgagaggcctctcctggttaaagggactcttattgcgatcgatcccttcgacgatcgccgggaggccggaggcgaatcaaccgtggtcaacccaaagagtggtagctggaactttttcgactggttctccgggttgatgtcttggtttggaggccctctgaaaacgattttactcatctgcctgtacgtggcactttcgataggtctgttctttttgctcatttacctgggcagaaccgggctaagcaagatgtggctggctgccactaaaaaggcctcatga

SEQ ID NO: 11246 - RNA, 3204 nt, synthetic construct
  misc_feature 1..3204: note = derived and/or modified CDS sequence (opt3) from RVFV(T1)__DQ380201.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattatcaatgtcacacagctctgagtgccttcgtggttgtgttcgtattttccagcattgcaatcatctgcctcgccgtcctttaccgcgtgctgaagtgtttgaaaattgctcctagaaaggttctaaaccccctgatgtggataaccgccttcatcaggtggatttataaaaagatggtggcacgggtcgcggataatatcaaccaggtgaatcgcgaaataggatggatggagggcgggcagctcgtactgggaaacccagctcccattcctcgacacgccccaatcccgagatactctacttaccttatgctgttgctcatcgtgtcatatgcaagtgcctgcagcgaactgattcaggcttcctctaggatcacaacctgttcgacggagggtgttaacaccaagtgccggttaagcggcacagccctgattcgtgcagggtccgtcggagctgaagcctgtctaatgctcaaaggcgtgaaggaggaccaaactaaatttctgaagataaaaaccgtgtcaagtgagctttcttgccgcgaaggtcagagctactggacagggtccttctcacccaagtgtttgagctctagaaggtgccatctggtcggcgagtgtcacgttaatcggtgcctctcctggcgagataacgaaaccagtgcggagtttagcttcgtgggagaatctactacaatgcgcgagaataaatgctttgagcagtgtggcgggtggggatgcggttgtttcaacgtgaatccttcctgcctgtttgtacatacctatcttcagtcagtcagaaaggaagccctgagggtgttcaactgtatcgactgggttcacaagttgactctcgagattacggactttgatggcagtgtgagcacaatcgacctgggggcttcgtcctctcggttcaccaattggggaagcgtctcattaagtctggatgcagaaggcatctccggttctaacagcttttccttcattgagtcaccagggaaaggctacgccatagtggacgagcccttcagcgaaatccctcgccaaggatttctaggcgagattagatgcaatagtgaatcttccgttctcagcgctcacgagtcgtgtctgagggccccaaaccttatctcatataagcccatgattgatcagttggaatgcactaccaatctgatcgacccgttcgtggtatttgagcgtgggtctctccctcagacacggaacgataaaaccttcgcagcgagtaagggaaatcgaggcgtccaggccttttccaaaggtagcgtgcaagctgacctgactttaatgttcgataactttgaggtggacttcgtcggggccgcagtttcttgtgatgctgcctttctgaatcttacaggatgctacagctgtaacgcaggcgccagagtgtgcttgtccataacgtcaaccggtactggcagtctcagcgctcataacaaggacgggtctctgcacatcgtactaccatccgaaaatggaacaaaggatcagtgccagattctgcatttcaccgtgcccgaggtcgaagaggaatttatgtattcatgtgacggcgacgagaggcctctcctggtgaaagggacacttatcgcgattgatcccttcgacgatcgccgggaggccggaggcgaaagtactgttgtgaacccaaagagcggttcctggaactttttcgactggttctctgggttgatgtcgtggtttggaggccctctgaaaaccatcttactcatatgcctgtacgtcgcacttagcattggtctgttctttttgctcatctacctgggcagaacggggctatcaaagatgtggctggctgccaccaaaaaggcctcctga

SEQ ID NO: 11247 - RNA, 3204 nt, synthetic construct
  misc_feature 1..3204: note = derived and/or modified CDS sequence (opt3) from RVFV(Kenya 83 (21445))__DQ380198.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattatcaatgtcacacagctctgagtgccttcgtggttgtgttcgtattttccagcattgcaatcatctgcctcgccattctttaccgcgtcctgaagtgtttgaaaatagctcctagaaaggtgctaaaccccctgatgtggatcaccgccttcattaggtgggtttataaaaagatggtggcacgggtcgcggataatatcaaccaggtgaatcgcgaaataggatggatggagggcgggcagctcgctctgggaaacccagcccccattcctcgacacgcaccaatcccgagatactctacttaccttatgctgttgctcatcgtatcatatgccagtgcttgcagcgaactgattcaggcctcctctaggatcacaacctgttcgacggagggtgtgaacaccaagtgccggttaagcggcacagcactgattcgtgctgggtccgttggagccgaagcgtgtctaatgctcaaaggcgtcaaggaggaccaaactaaatttctgaagataaaaaccgtgtcaagtgagctttcttgccgcgaaggtcagagctactggacagggtccttctcacccaagtgtttgagctctagaaggtgccatctggtgggcgagtgtcacgtcaatcggtgcctctcctggcgagataacgaaacaagtgccgagtttagcttcgttggagaatctaccacaatgcgcgagaataaatgctttgagcagtgtggcgggtggggatgcggttgtttcaacgtgaatccttcctgcctgtttgtgcatacctatcttcagtcagtaagaaaggaagctctgagggtcttcaactgtatcgactgggtgcacaagttgactctcgagattacggactttgatggcagtgttagcacaatcgacctgggggcatcgtcctctcggttcaccaattggggaagcgtgtcattaagtctggatgccgaaggcatctccggttctaacagcttttccttcattgagtcaccagggaaaggctacgctatagtcgacgagcccttcagcgaaatccctcgccaaggatttctaggcgagattagatgcaatagtgaatcttccgtgctcagcgcccacgagtcgtgtctgagggcaccaaaccttatctcatataagcccatgattgatcagttggaatgcactaccaatctgatcgacccgttcgttgtgtttgagcgtgggtctctccctcagacacggaacgataaaaccttcgcggccagtaagggaaatcgaggcgtacaggctttttccaaaggtagcgtccaagccgacctgactttaatgttcgataactttgaggtggacttcgtgggggcagctgtctcttgtgatgccgcatttctgaatcttacaggatgctacagctgtaacgccggcgctagagtttgcttgtccataacgtcaaccggtactggcacactcagtgcgcataacaaggacgggagcctgcacatcgtgctaccatctgaaaatggaaccaaggatcagtgccagattctgcatttcacagtacccgaggtggaagaggaatttatgtattcctgtgacggcgacgagaggcctctcctggtcaaagggactcttatcgccattgatcccttcgacgatcgccgggaggcaggaggcgaatcaaccgtggttaacccaaagagtggtagctggaactttttcgactggttctccgggttgatgtcttggtttggaggccctctgaaaacgatcttactcatatgcctgtacgtggctctttcgattggtctgttctttttgctcatctacctgggcagaaccgggctaagcaagatgtggctggccgccactaaaaaggcttcatga

SEQ ID NO: 11248 - RNA, 3204 nt, synthetic construct
  misc_feature 1..3204: note = derived and/or modified CDS sequence (opt3) from RVFV(Sudan 85-2010)__JQ820488.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattatcaatgtcacacagctctgagtgccttcgtggttgtgttcgtattttccagcattgcaatcatctgcctcgccattctttaccgcgtcctgaagtgtttgaaaatagctcctagaaaggtgctaaaccccctgatgtggatcaccgccttcattaggtgggtttataaaaagatggtggcacgggtcgcggataatatcaaccaggtgaatcgcgaaataggatggatggagggcgggcagctcgtactgggaaacccagctcccattcctcgacacgccccaatcccgagatactctacttaccttatgctgttgctcatcgtgtcatatgcaagtgcctgcagcgaactgattcaggcttcctctaggatcacaacctgttcgacggagggtgttaacaccaagtgccggttaagcggcacagccctgattcgtgcagggtccgtcggagctgaagcctgtctaatgctcaaaggcgtgaaggaggaccaaactaaatttctgaagataaaaaccgtgtcaagtgagctttcttgccgcgaaggtcagagctactggacagggtccttctcacccaagtgtttgagctctagaaggtgccatctggtcggcgagtgtcacgttaatcggtgcctctcctggcgagataacgaaacaagtgcggagtttagcttcgtgggagaatctaccacaatgcgcgagaataaatgctttgagcagtgtggcgggtggggatgcggttgtttcaacgtgaatccttcctgcctgtttgtacatacctatcttcagtcagtcagaaaggaagccctgagggtgttcaactgtatcgactgggttcacaagttgactctcgagattacggactttgatggcagtgtgagcacaatcgacctgggggcttcgtcctctcggttcaccaattggggaagcgtctcattaagtctggatgcagaaggcatctccggttctaacagcttttccttcattgagtcaccagggaaaggctacgccatagtggacgagcccttcagcgaaatccctcgccaaggatttctaggcgagattagatgcaatagtgaatcttccgttctcagcgctcacgagtcgtgtctgagggccccaaaccttatctcatataagcccatgattgatcagttggaatgcactaccaatctgatcgacccgttcgtggtatttgagcgtgggtctctccctcagacacggaacgagaaaaccttcgcagcgagtaagggaaatcgaggcgtccaggccttttccaaaggtagcgtgcaagctgatctgactttaatgttcgacaactttgaagtggatttcgtcggggccgcagtttcttgtgacgctgcctttctgaatcttacaggatgctacagctgtaacgcaggcgccagagtgtgcttgtccataacgtcaaccggtactggcacactcagtgctcataacaaggatgggagcctgcacatcgtactaccatctgagaatggaaccaaggaccagtgccagattctgcatttcacagtgcccgaagtcgaggaagagtttatgtattcctgtgatggcgacgagaggcctctcctggtgaaagggactcttatcgcgattgaccccttcgatgaccgccgggaagccggaggcgagtcaaccgttgtgaacccaaagagtggtagctggaactttttcgattggttctccgggttgatgtcttggtttggaggccctctgaaaacgatcttactcatatgcctgtacgtcgcactttcgattggtctgttctttttgctcatctacctgggcagaaccgggctaagcaagatgtggctggctgccactaaaaaggcctcatga

SEQ ID NO: 11249 - RNA, 3204 nt, synthetic construct
  misc_feature 1..3204: note = derived and/or modified CDS sequence (opt3) from RVFV(2007004194)__EU574031.1__Gn-Gc
  source 1..3204: mol_type = other RNA
atggccggcatcgctatgacagtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgtccaacgacggcaaaatggcctctgttaagtgtccccctaaatatgaattgaccgaggattgcaatttttgtcgccagatgacaggtgcttcgctcaagaaagggtcatacccactgcaagacctgttctgccagagcagtgaggatgacggatccaagctcaagaccaaaatgaagggcgtgtgtgaagtcggcgtgcaggccttaaagaagtgcgatgggcagctgtctactgcacatgaggtagttccgtttgctgtgttcaaaaacagcaagaaagtctatcttgacaagttggacctgaagacagaagagaatctactccccgattcctttgtgtgtttcgagcacaaaggacaatacaagggtaccatggactcaggccagacgaaacgagaactgaagagttttgatattagccagtgccctaaaatcgggggacatggctctaagaagtgcactggtgacgccgcgttctgttccgcctacgagtgcaccgcacagtatgctaacgcctactgttcacacgctaatgggagcggaattgtgcaaatccaggtcagtggcgtttggaaaaagccactttgcgtgggctatgaacgtgtagtggtcaaaagagagctgtctgccaagcccatacagagggtggaaccttgtacaacttgcatcaccaaatgtgagccacacgggttggttgtgcggtccacaggatttaagattagctcggcagtcgcctgcgcttctggtgtgtgtgtaaccggctcccaatcacccagtacggagatcactctcaagtacccggggattagccagtcctctggaggcgatatcggtgttcatatggcgcacgacgatcagagcgtgtcaagtaaaatagtcgcacattgccctccccaggacccatgtctggtgcacgggtgcattgtctgcgcccatggcttaatcaactatcaatgtcacacagctctgtccgccttcgtggttgtgttcgtatttagctctattgcaatcatctgcctcgccattctttaccgcgtcctgaagtgtttgaaaatagctcctagaaaggtgctaaatcccctgatgtggatcaccgccttcattaggtgggtttataaaaagatggtggcacgggtcgcggataacatcaatcaggtgaaccgcgaaataggatggatggagggcgggcagctcgtactgggaaatccagctcccattcctcgacacgccccaatcccgagatactcaacttaccttatgctgttgctcatcgtgagttatgcaagcgcctgctccgaactgattcaggcttcttcgaggatcacaacctgtagcacggagggtgttaacaccaagtgccggttatccggcacagccctgattcgtgcagggtcagtcggagctgaagcctgtctaatgctcaaaggcgtgaaggaggaccaaactaaatttctgaagataaaaaccgtgagttctgagcttagctgccgcgaaggtcagtcctactggacagggtcattcagccccaagtgtttgtcttccagaaggtgccatctggtcggcgagtgtcacgttaaccggtgcctcagttggcgagataatgaaactagcgcggagttttctttcgtgggagaatccaccacaatgcgcgagaacaaatgctttgagcagtgtggcgggtggggatgcggttgtttcaatgtgaacccttcatgcctgtttgtacatacctatcttcagagtgtcagaaaggaagccctgagggtgttcaattgtatcgactgggttcacaagttgactctcgagattacggactttgatggcagcgtgtcgacaatcgacctgggggcttcctctagccggttcaccaactggggatcagtcagtttatccctggatgcagaaggcatctctggtagcaattccttttcattcattgagagcccagggaaaggctacgccatagtggacgagcccttcagtgaaatccctcgccaaggatttctaggcgagattagatgcaactctgaatccagcgttctctcggctcacgagtcatgtctgagggccccaaatcttatctcttataagcccatgattgatcagttggaatgcactaccaacctgatcgacccgttcgtggtatttgagcgtgggagtctccctcagacacggaatgataaaaccttcgcagcgtccaagggaaaccgaggcgtccaggcctttagcaaaggttctgtgcaagctgacctgactttaatgttcgataattttgaggtggacttcgtcggggccgcagttagctgtgatgctgcctttctgaaccttacaggatgctactcctgtaatgcaggcgccagagtgtgcttgtcaataacgagtaccggtactggcacactcagcgctcataacaaggacgggtctctgcacatcgtactaccatccgaaaacggaaccaaggatcagtgccagattctgcatttcacagtgcccgaggtcgaagaggaatttatgtattcatgtgacggcgacgagaggcctctcctggtgaaagggactcttatcgcgattgatcccttcgacgatcgccgggaggccggaggcgaaagtaccgttgtgaatccaaagagcggttcctggaactttttcgactggttctctgggttgatgtcgtggtttggaggccctctgaaaacgatcttactcatatgcctgtacgtcgcacttagcattggtctgttctttttgctcatctacctgggcagaaccgggctatcaaagatgtggctggctgccaccaaaaaggcctcctga

SEQ ID NO: 11250 - RNA, 3204 nt, synthetic construct
  misc_feature 1..3204: note = derived and/or modified CDS sequence (opt3) from RVFV(2250/74)__DQ380209.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattatcaatgtcacacagctctgagtgccttcgtggttgtgttcgtattttccagcattgcaatcatctgcctcgccattctttaccgcgtcctgaagtgtttgaaaatagctcctagaaaggtgctaaaccccctgatgtggatcaccgccttcattaggtggatctataaaaagatggttgcacgggtggcggataatataaaccaggtcaatcgcgaaattggatggatggagggcgggcagctcgtgctgggaaacccagctcccatccctcgacacgccccaatcccgagatactctacttaccttatgctgttgctcattgtatcatatgcaagtgcctgcagcgaactgatccaggcttcctctaggattacaacctgttcgacggagggtgtgaacaccaagtgccggttaagcggcacagccctgatacgtgcagggtccgttggagctgaagcctgtctaatgctcaaaggcgtcaaggaggaccaaactaaatttctgaagatcaaaaccgtgtcaagtgagctttcttgccgcgaaggtcagagctactggacagggtccttctcacccaagtgtttgagctctagaaggtgccatctggtgggcgagtgtcacgtcaatcggtgcctctcctggcgagataacgaaaccagtgcggagtttagcttcgttggagaatctactacaatgcgcgagaataaatgctttgagcagtgtggcgggtggggatgcggttgtttcaacgtgaatccttcctgcctgtttgtgcatacctatcttcagtcagtaagaaaggaagccctgagggtcttcaactgtattgactgggtgcacaagttgactctcgagatcacggactttgatggcagtgttagcacaatcgacctgggggcttcgtcctctcggttcaccaattggggaagcgtgtcattaagtctggatgcagaaggcatttccggttctaacagcttttccttcatagagtcaccagggaaaggctacgccatcgtcgacgagcccttcagcgaaattcctcgccaaggatttctaggcgagatcagatgcaatagtgaatcttccgtgctcagcgctcacgagtcgtgtctgagggccccaaaccttatttcatataagcccatgatcgatcagttggaatgcactaccaatctgatagacccgttcgttgtgtttgagcgtgggtctctccctcagacacggaacgataaaaccttcgcagcgagtaagggaaatcgaggcgtacaggccttttccaaaggtagcgtccaagctgacctgactttaatgttcgataactttgaggtggacttcgtgggggccgcagtctcttgtgatgctgcctttctgaatcttacaggatgctacagctgtaacgcaggcgccaaggtttgcttgtccatcacgtcaaccggtactggcagtctcagcgctcataacaaggacgggtctctgcacattgtgctaccatccgaaaatggaacaaaagatcagtgccagatcctgcatttcaccgtacccgaggtggaagaggaatttatgtattcatgtgacggcgacgagagacctctcctggtcaaggggacacttattgcgatcgatcccttcgacgataggcgcgaggccggaggcgaaagtactgtggttaacccaaaaagcggttcctggaactttttcgactggttctctgggttgatgtcgtggtttggaggccctctgaagaccatattactcatttgcctgtacgtggcacttagcatcggtctgttctttttgctcatttacctgggccggacggggctatcaaaaatgtggctggctgccaccaagaaggcctcctga

SEQ ID NO: 11251 - RNA, 3204 nt, synthetic construct
  misc_feature 1..3204: note = derived and/or modified CDS sequence (opt3) from RVFV(Sudan 28-2010)__JQ820491.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattatcaatgtcacacagctctgagtgccttcgtggttgtgttcgtattttccagcattgcaatcatctgcctcgccattctttaccgcgtcctgaagtgtttgaaaatagctcctagaaaggtgctaaaccccctgatgtggatcaccgccttcattaggtgggtttataaaaagatggtggcacgggtcgcggataatatcaaccaggtgaatcgcgaaataggatggatggagggcgggcagctcgtactgggaaacccagctcccattcctcgacacgccccaatcccgagatactctacttaccttatgctgttgctcatcgtgtcatatgcaagtgcctgcagcgaactgattcaggcttcctctaggatcacaacctgttcgacggagggtgttaacaccaagtgccggttaagcggcacagccctgattcgtgcagggtccgtcggagctgaagcctgtctaatgctcaaaggcgtgaaggaggaccaaactaaatttctgaagataaaaaccgtgtcaagtgagctttcttgccgcgaaggtcagagctactggacagggtccttctcacccaagtgtttgagctctagaaggtgccatctggtcggcgagtgtcacgttaatcggtgcctctcctggcgagataacgaaacaagtgcggagtttagcttcgtgggagaatctaccacaatgcgcgagaataaatgctttgagcagtgtggcgggtggggatgcggttgtttcaacgtgaatccttcctgcctgtttgtacatacctatcttcagtcagtcagaaaggaagccctgagggtgttcaactgtatcgactgggttcacaagttgactctcgagattacggactttgatggcagtgtgagcacaatcgacctgggggcttcgtcctctcggttcaccaattggggaagcgtctcattaagtctggatgcagaaggcatctccggttctaacagcttttccttcattgagtcaccagggaaaggctacgccatagtggacgagcccttcagcgaaatccctcgccaaggatttctaggcgagattagatgcaatagtgaatcttccgttctcagcgctcacgagtcgtgtctgagggccccaaaccttatctcatataagcccatgattgatcagttggaatgcactaccaatctgatcgacccgttcgtggtatttgagcgtgggtctctccctcagacacggaacgataaaaccttcgcagcgagtaagggaaatcgaggcgtccaggccttttccaaaggtagcgtgcaagctgacctgactttaatgttcgataactttgaggtggacttcgtcggggccgcagtttcttgtgatgctgcctttctgaatcttacaggatgctacagctgtaacgcaggcgccagagtgtgcttgtccataacgtcaaccggtactggcacactcagtgctcataacaaggacgggagcctgcacatcgtactaccatctgaaaatggaaccaaggatcagtgccagattctgcatttcacagtgcccgaggtcgaagaggaatttatgtattcctgtgacggcgacgagaggcctctcctggtgaaagggactcttatcgcgattgatcccttcgacgatcgccgggaggccggaggcgaatcaaccgttgtgaacccaaagagtggtagctggaactttttcgactggttctccgggttgatgtcttggtttggaggccctctgaaaacgatcttactcatatgcctgtacgtcgtgctttcgattggtctgttctttttgctcatctacctgggcagaaccgggctaagcaagatgtggctggcagctactaaaaaggcctcatga

SEQ ID NO: 11252 - RNA, 3204 nt, synthetic construct
  misc_feature 1..3204: note = derived and/or modified CDS sequence (opt3) from RVFV(2007000324)__JF326195.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattatcaatgtcacacagctctgagtgccttcgtggttattttcgtgttttccagcaccgcaatcatctgcctcgccgtactttaccgcgtcctgaagtgtttgaaaattgctcctagaaaggtgctaaaccccctgatgtggataactgccttcatcaggtgggtttataaaaagatggtggcacgggtcgcggataatattaaccaggtgaatcgcgaaatcggatggatggagggcgggcagctcgctctgggaaacccagcccccatacctcgacacgcaccaattccgagatactctacataccttatgctgttgctcatcgtatcatatgccagtgcttgcagcgaactgatccaggcctcctctaggattaccacgtgttcgaccgagggtgtgaacacaaagtgccggttaagcggcactgcactgatccgtgctgggtccgttggagccgaagcgtgtctaatgctcaaaggcgtcaaggaggaccaaaccaaatttctgaagattaaaacagtgtcaagtgagctttcttgccgcgaaggtcagagctactggactgggtccttctcacccaagtgtttgagctctagaaggtgccatctggtgggcgagtgtcacgtcaatcggtgcctctcctggcgagataacgaaaccagtgccgagtttagcttcgttggagaatctacaaccatgcgcgagaataaatgctttgagcagtgtggcgggtggggatgcggttgtttcaacgtgaatccttcctgcctgtttgtgcatacttatcttcagtcagtaagaaaggaagctctgagggtcttcaactgtatagactgggtgcacaagttgacgctcgagatcacagactttgatggcagtgttagcaccattgacctgggggcatcgtcctctcggttcactaattggggaagcgtgtcattaagtctggatgccgaaggcatctccggttctaacagcttttccttcatcgagtcaccagggaaaggctacgctattgtcgacgagcccttcagcgaaatacctcgccaaggatttctaggcgagatcagatgcaatagtgaatcttccgtgctcagcgcccacgagtcgtgtctgagggcaccaaaccttgtttcatataagcccatgattgatcagttggaatgcaccacaaatctgatcgacccgttcgtggtatttgagcgtgggtctctccctcagacccggaacgataaaactttcgcggccagtaagggaaatcgaggcgtccaggctttttccaaaggtagcgtgcaagccgacctgacattaatgttcgataactttgaggtggacttcgtcggggcagctgtttcttgtgatgccgcatttctgaatcttacgggatgctacagctgtaacgccggcgctagagtgtgcttgtccattacctcaactggtacaggcaccctcagtgcgcataacaaggacgggagcctgcacatcgtactaccatctgaaaatggaacaaaggatcagtgccagatactgcatttcactgtgcccgaggtcgaagaggaatttatgtattcctgtgacggcgacgagaggcctctcctggtgaaagggacccttatcgccattgatcccttcgacgatcgccgggaggcaggaggcgaatcaacggttgtgaacccaaagagtggtagctggaactttttcgactggttctccgggttgatgtcttggtttggaggccctctgaaaaccatcttactcatttgcctgtacgtcgctctttcgatcggtctgttctttttgctcatatacctgggcagaacagggctaagcaagatgtggctggccgccactaaaaaggcttcatga

SEQ ID NO: 11253 - RNA, 3204 nt, synthetic construct
  misc_feature 1..3204: note = derived and/or modified CDS sequence (opt3) from RVFV(ZM-657)__DQ380204.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaaagcctactgttcccacgctaatgggtcaggaattgtgcaaatccaggtcagcggcgtttggaagaaaccactttgcgtgggctatgaacgtgtagtggtcaagagagagctgagtgccaaacccatacagagggtggaaccttgtacaacttgcatcaccaagtgtgagccacacgggttggttgtgcggtctacaggatttaagatttccagcgcagtcgcctgcgcttcgggtgtgtgtgtaaccggctctcaatccccctcaacggagatcactctcaaatacccggggattagtcagagctccggaggcgatatcggtgttcatatggcgcacgacgatcagtctgtgagctcaaagatagtcgcacattgccctccccaggacccatgtctggtgcacgggtgcattgtctgcgcccatggcttaatcaactatcaatgtcacacagctctgagtgccttcgtggttgtgttcgtattttccagcattgcaatcatctgcctcgccattctttaccgcgtcctgaaatgtttgaagatagctcctagaaaagtgctaaatcccctgatgtggatcaccgccttcattaggtggatctataagaagatggttgcacgggtggcggataacataaatcaggtcaaccgcgaaattggatggatggagggcgggcagctcgtgctgggaaatccagctcccatccctcgacacgccccaatcccgagatactctacttaccttatgctgttgctcattgtatcatatgcaagtgcctgcagcgaactgatccaggcttcctctaggattacaacctgttcgacggagggtgtgaacaccaaatgccggttaagcggcacagccctgatacgtgcagggtccgttggagctgaagcctgtctaatgctcaagggcgtcaaagaggaccaaactaagtttctgaaaatcaagaccgtgtcaagtgagctttcttgccgcgaaggtcagagctactggacagggtccttctcacccaaatgtttgagctctagaaggtgccatctggtgggcgagtgtcacgtcaaccggtgcctctcctggcgagataatgaaaccagtgcggagtttagcttcgttggagaatctactacaatgcgcgagaacaagtgctttgagcagtgtggcgggtggggatgcggttgtttcaatgtgaacccttcctgcctgtttgtgcatacctatcttcagtcagtaagaaaggaagccctgagggtcttcaattgtattgactgggtgcacaaattgactctcgagatcacggactttgatggcagtgttagcacaatcgacctgggggcttcgtcctctcggttcaccaactggggaagcgtgtcattaagtctggatgcagaaggcatttccggttctaatagcttttccttcatagagtcaccagggaagggctacgccatcgtcgacgagcccttcagcgaaattcctcgccaaggatttctaggcgagatcagatgcaacagtgaatcttccgtgctcagcgctcacgagtcgtgtctgagggccccaaatcttatttcatataaacccatgatcgatcagttggaatgcactaccaacctgatagacccgttcgttgtgtttgagcgtgggtctctccctcagacacggaatgataagaccttcgcagcgagtaaaggaaaccgaggcgtacaggccttttccaagggtagcgtccaagctgacctgactttaatgttcgataattttgaggtggacttcgtgggggccgcagtctcttgtgatgctgcctttctgaaccttacaggatgctacagctgtaatgcaggcgccagagtttgcttgtccatcacgtcaaccggtactggcagtctcagcgctcataacaaggacgggtctctgcacattgtgctaccatccgaaaacggaacaaaagatcagtgccagatcctgcatttcaccgtacccgaggtggaagaggaatttatgtattcatgtgacggcgacgagaggcctctcctggtcaaggggacacttattgcgatcgatcccttcgacgatcgccgggaggccggaggcgaaagtactgtggttaatccaaaaagcggttcctggaactttttcgactggttctctgggttgatgtcgtggtttggaggccctctgaagaccatattactcatttgcctgtacgtggcacttagcatcggtctgttctttttgctcatttacctgggcagaacggggctatcaaaaatgtggctggctgccaccaagaaggcctcctga

SEQ ID NO: 11254 - RNA, 3204 nt, synthetic construct
  misc_feature 1..3204: note = derived and/or modified CDS sequence (opt3) from RVFV(T-46 (228113))__DQ380199.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccaaagactccggccagacgaagcgagaactgaaatcatttgatattagtcagtgccctaagatcgggggacatggcagcaagaaatgcactggtgacgccgcgttctgttctgcctacgagtgcaccgcacagtatgctaatgcctactgttcccacgctaacgggtcaggaattgtgcaaatccaggtcagcggcgtttggaagaaaccactttgcgtgggctatgaacgtgtagtggtcaagagagagctgagtgccaaacccatacagagggtggaaccttgtacaacttgcatcaccaagtgtgagccacacgggttggttgtgcggtctacaggatttaagatttccagcgcagtcgcctgcgcttcgggtgtgtgtgtaaccggctctcaatccccctcaacggagatcactctcaaatacccggggattagtcagagctccggaggcgatatcggtgttcatatggcgcacgacgatcagtctgtgagctcaaagatagtcgcacattgccctccccaggacccatgtctggtgcacgggtgcattgtctgcgcccatggcttaatcaattatcaatgtcacacagctctgagtgccttcgtggttgtgttcgtattttccagcattgcaatcatctgcctcgccgtcctttaccgcgtgctgaaatgtttgaagattgctcctagaaaagttctaaaccccctgatgtggataaccgccttcatcaggtggatttataagaagatggtggcacgggtcgcggataatatcaaccaggtgaatcgcgaaataggatggatggagggcgggcagctcgtactgggaaacccagctcccattcctcgacacgccccaatcccgagatactctacttaccttatgctgttgctcatcgtgtcatatgcaagtgcctgcagcgaactgattcaggcttcctctaggatcacaacctgttcgacggagggtgttaacaccaaatgccggttaagcggcacagccctgattcgtgcagggtccgtcggagctgaagcctgtctaatgctcaagggcgtgaaagaggaccaaactaagtttctgaaaataaagaccgtgtcaagtgagctttcttgccgcgaaggtcagagctactggacagggtccttctcacccaaatgtttgagctctagaaggtgccatctggtcggcgagtgtcacgttaatcggtgcctctcctggcgagataacgaaaccagtgcggagtttagcttcgtgggagaatctactacaatgcgcgagaataagtgctttgagcagtgtggcgggtggggatgcggttgtttcaacgtgaatccttcctgcctgtttgtacatacctatcttcagtcagtcagaaaggaagccctgagggtgttcaactgtatcgactgggttcacaaattgactctcgagattacggactttgatggcagtgtgagcacaatcgacctgggggcttcgtcctctcggttcaccaattggggaagcgtctcattaagtctggatgcagaaggcatctccggttctaacagcttttccttcattgagtcaccagggaagggctacgccatagtggacgagcccttcagcgaaatccctcgccaaggatttctaggcgagattagatgcaatagtgaatcttccgttctcagcgctcacgagtcgtgtctgagggccccaaaccttatctcatataaacccatgattgatcagttggaatgcactaccaatctgatcgacccgttcgtggtatttgagcgtgggtctctccctcagacacggaacgataagaccttcgcagcgagtaaaggaaatcgaggcgtccaggccttttccaagggtagcgtgcaagctgacctgactttaatgttcgataactttgaggtggacttcgtcggggccgcagtttcttgtgatgctgcctttctgaatcttacaggatgctacagctgtaacgcaggcgccagagtgtgcttgtccataacgtcaaccggtactggcagtctcagcgctcataacaaggacgggtctctgcacatcgtactaccatccgaaaatggaacaaaagatcagtgccagattctgcatttcaccgtgcccgaggtcgaagaggaatttatgtattcatgtgacggcgacgagaggcctctcctggtgaaggggacacttatcgcgattgatcccttcgacgatcgccgggaggccggaggcgaaagtactgttgtgaacccaaaaagcggttcctggaactttttcgactggttctctgggttgatgtcgtggtttggaggccctctgaagaccatcttactcatatgcctgtacgtcgcacttagcattggtctgttctttttgctcatctacctgggcagaacggggctatcaaaaatgtggctggctgccaccaagaaggcctcctga

SEQ ID NO: 11255 - RNA, 3204 nt, synthetic construct
  misc_feature 1..3204: note = derived and/or modified CDS sequence (opt3) from RVFV(MP12)__Z30318.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcttagtgcgcatggaaacccttgtatgaaagagaagctggtgatgaagactcactgcccaaatgattatcagagcgcacaccatttgaacaatgacggcaaaatggcctccgttaagtgtccccctaaatacgaactcaccgaggattgcaacttttgtcgccagatgacaggtgcttctctgaagaaagggtcgtatccactgcaggacctcttctgccaatcaagcgaggatgacggaagtaagttaaagaccaaaatgaagggcgtgtgtgaagtcggcgtgcaggccctgaaaaagtgcgatgggcagctttccactgcacacgaggtagttccgtttgctgtgttcaaaaattctaagaaagtctacttggacaagctggacctaaagacagaagagaacctcctgcccgatagctttgtgtgtttcgagcataaaggacagtataagggtaccatggactccggccaaacgaaacgagaacttaagtcatttgatattagtcagtgccctaaaatcgggggacacggcagcaagaagtgcactggtgacgccgcgttctgttctgcctacgagtgcaccgcacagtacgctaatgcctattgttcccacgctaacgggtcaggaattgtgcagatccaagtcagcggcgtttggaaaaagccactgtgcgtgggctacgaacgtgtagtggtcaaaagagagttgagtgccaagcccatacagagggtggaaccttgtacaacttgcatcaccaaatgtgagccacatgggctcgttgtgcggtctacaggatttaagatttccagcgcagtcgcctgcgcttcgggtgtgtgtgtaaccggctctcagtccccctcaacggagatcactctgaagtatccggggattagtcaaagctccggaggcgatatcggtgttcacatggcgcatgacgatcagtctgtgagctcaaaaatagtcgcacactgccctccccaggacccatgtttagtgcatgattgcattgtctgcgcccacgggctgatcaattaccagtgtcacacagctctcagtgccttcgtggttgtgttcgtattttccagcattgcaatcatctgccttgccattctgtatcgcgtcttgaagtgtctaaaaatagctcctagaaaggtgctgaaccccctcatgtggatcaccgccttcattaggtggatctacaaaaagatggttgcacgggtggcgcataatataaaccaagtcaatcgcgaaattggctggatggagggaggccagctggtgcttgggaacccagctcccatccctcgacacgccccaatcccgagatattctacttacctgatgttgctcctgattgtatcatacgcaagtgcctgcagcgaattaatccaggcttcctctaggattacaacctgttcgacggagggagtgaacaccaagtgccggctgagcggtacagccctaatacgtgcaggctccgttggggctgaagcctgtctcatgctgaaaggagtcaaggaggaccagactaaatttcttaagttgaaaaccgtgtcaagtgagctgtcttgccgcgaaggccaaagctattggacaggttccttctcacccaagtgtctcagctctagaaggtgccatctggtgggggagtgtcacgtcaatcggtgcctttcctggcgagataacgaaaccagtgcggagtttagcttcgttggcgaatctactacaatgcgcgagaataaatgctttgagcagtgtggaggctgggggtgcggatgtttcaacgtgaatccttcctgcctgtttgtgcacacctacttgcagtcagtaagaaaggaagccctcagggtcttcaactgtatcgactgggtgcataagctgactttagagattacggactttgatggtagtgttagcacaatcgacctgggcgcttcgtcctctcggttcaccaattgggggagcgtgtcactaagtctcgatgcagaaggaatctccggctctaacagcttttccttcattgagtcaccaggtaaagggtatgccatagtcgacgagcccttcagcgaaatccctcgccagggctttctgggagagattagatgcaatagtgaatcttccgtgcttagcgctcacgagtcgtgtttgagggccccaaacctgatctcatacaagcccatgattgatcaactcgaatgcactaccaatctgatcgacccgttcgttgtgtttgagcgtggctctttacctcagacacggaacgataaaaccttcgcagcgagtaaggggaatcgaggagtacaggccttttccaaaggcagcgtccaggctgacctgactcttatgttcgataactttgaggtggacttcgtgggtgccgcagtctcttgtgatgctgcctttttgaatctcacagggtgctatagctgtaacgcaggagccagagtttgcctgtccataacgtcaaccggcactggtagtctaagcgctcataacaaggacggctctctgcacatcgtgctcccatccgaaaatgggacaaaggatcaatgccagattctgcatttcaccgtacccgaggtggaagaggaatttatgtactcatgtgacggagacgagaggcctcttttggtcaaaggcacactgatcgcgattgatcccttcgacgatcgccgggaggccgggggagaaagtactgtggttaacccaaagagcggctcctggaactttttcgactggttctctggtttaatgtcgtggtttgggggacctctcaaaaccatcctgcttatatgcctgtatgtggcattgagcattggcctcttctttctgctaatctacctgggtggcacggggctctcaaagatgtggctggctgccaccaaaaaggcctcctga

SEQ ID NO: 11256 - RNA, 3204 nt, synthetic construct
  misc_feature 1..3204: note = derived and/or modified CDS sequence (opt3) from RVFV(200803166)__JF311381.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttaaagaaagggaagtttcctctgttccaatcttacgcacaccatcggaccctactcgaggccgtccacgacacaataatcgctaaagccgatccaccctcatgcgacctgcagagtgcgcatggaaacccttgtatgaaggaaaaacttgtgatgaagactcactgcccaaatgattatcagagcgcacactacctgaacaatgacggcaagatggcctccgttaaatgtccccctaagtatgagttgaccgaagattgcaacttttgtcgccagatgacaggtgcttctctcaaaaaggggtcgtacccactgcaagacctgttctgccagtcaagcgaggatgacggaagtaagctcaaaaccaagatgaaaggcgtgtgtgaggtcggcgtgcaggccttaaagaaatgcgatgggcagctgtccactgcacatgaagtagttccgtttgctgtgttcaaaaattctaagaaggtctatcttgacaagttggacctgaaaacagaggaaaacctactccccgatagctttgtgtgtttcgagcacaagggacaatacaaaggtaccatggactccggccagacgaagcgagagctgaaatcatttgatattagtcagtgccctaagatcgggggacatggcagcaagaaatgcactggtgacgccgcgttctgttctgcctacgaatgcaccgcacagtatgctaatgcctactgttcccacgctaacgggtcaggaattgtgcaaatccaggtcagcggcgtttggaagaaaccactttgcgtgggctatgagcgtgtagtggtcaagagagaactgagtgccaaacccatacagagggtggagccttgtacaacttgcatcaccaagtgtgaaccacacgggttggttgtgcggtctacaggatttaagatttccagcgcagtcgcctgcgcttcgggtgtgtgtgtaaccggctctcaatccccctcaacggagatcactctcaaatacccggggattagtcagagctccggaggcgatatcggtgttcatatggcgcacgacgatcagtctgtgagctcaaagatagtcgcacattgccctccccaggacccatgtctggtgcacgggtgcattgtctgcgcccatggcttaatcaattatcaatgtcacacagctctgagtgccttcgtggttgtgttcgtattttccagcattgcaatcatctgcctcgccattctttaccgcgtcctgaaatgtttgaagatagctcctagaaaagtgctaaaccccctgatgtggatcaccgccttcattaggtgggtttataagaagatggtggcacgggtcgcggataatatcaaccaggtgaatcgcgagataggatggatggaaggcgggcagctcgtactgggaaacccagctcccattcctcgacacgccccaatcccgagatactctacttaccttatgctgttgctcatcgtgtcatatgcaacagcctgcagtgagctgattcaggctagctccaggatcaccacgtgttctaccgaaggtgttaacacaaaatgccggttatcgggcactgccctgattcgtgcagggagcgtcggagctgaggcctgtctaatgctcaagggcgtgaaagaagaccaaaccaagtttctgaaaataaagacagtgtcctcagagcttagttgccgcgagggtcagtcttactggactgggagcttctcccccaaatgtttgtcaagcagaaggtgccatctggtcggcgaatgtcacgttaatcggtgcctctcttggcgagataacgagacctccgcggaatttagtttcgtgggagagagcacaaccatgcgcgaaaataagtgctttgagcagtgtggcgggtggggatgcggttgtttcaacgtgaatccttcttgcctgtttgtacatacttatcttcagtccgtcagaaaggaggccctgagggtgttcaactgtatcgactgggttcacaaattgacgctcgaaattacagactttgatggctcagtgagtaccatcgacctgggggctagctcgtcccggttcactaattggggatctgtcagcttatcactggatgcagagggcatcagtggttccaactcttttagcttcattgaatccccagggaagggctacgccatagtggacgagcccttctcagagatccctcgccaaggatttctaggcgaaattagatgcaatagcgagagttctgttctctccgctcacgaaagctgtctgagggccccaaaccttatctcgtataaacccatgattgatcagttggagtgcaccacaaatctgatcgacccgttcgtggtatttgaacgtgggtcactccctcagacccggaacgataagactttcgcagcgtctaaaggaaatcgaggcgtccaggcctttagtaagggttccgtgcaagctgacctgacattaatgttcgataactttgaggtggacttcgtcggggccgcagttagctgtgatgctgcctttctgaatcttacgggatgctactcttgtaacgcaggcgccagagtgtgcttgagcataacctccactggtacaggcaccctctcagctcataacaaggacgggagtctgcacgtagtgctaccaagcgagaatggaacaaaagatcagtgccagatcctgcatttcactgtccccgaagtggaggaagagtttatgtattcttgtgacggcgacgaaaggcctctcctggttaaggggacccttattgcgatcgatcccttcgacgatcgccgggaggccggaggcgagtccacggtggtcaacccaaaatcaggtagttggaactttttcgactggttcagcgggttgatgtcctggtttggaggccctctgaagaccattttactcatctgcctgtacgtggcactttctataggtctgttctttttgctcatttacctgggcagaacagggctatcgaaaatgtggctggctgccactaagaaggccagctga

SEQ ID NO: 11257 - RNA, 3204 nt, synthetic construct
  misc_feature 1..3204: note = derived and/or modified CDS sequence (opt3) from RVFV(200803162)__JF311377.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcgcaaaatgtgagccacacgggttggttgtgcggtctaccggatttaagatttccagcgccgtcgcttgcgcgtcgggtgtgtgtgtaacaggctctcaatccccctcaaccgagatcacgctcaagtacccggggattagtcagagctccggaggcgatatcggtgttcatatggcacacgacgatcagtctgtgagctcaaaaatagtcgcccattgccctccccaggacccatgtctggtgcacgattgcattgtctgcgctcatgggttaatcaattatcaatgtcacactgccctgagtgcattcgtggttattttcgtgttttccagcacagccatcatctgcctcgctgtactttaccgcgtcctgaagtgtttgaaaattgcccctagaaaggtgctaaaccccctgatgtggataaccgcattcatcaggtgggtttataaaaagatggtggcgcgggtcgctgacaatattaaccaggtgaatcgcgaaatcggctggatggagggaggccagctcgccctgcgaaacccagcacccatacctagacacgccccaattccgaggtactctacttaccttatgctgttgctcatcgtatcatatgctagtgcctgcagcgaactgatccaggcatcctctcggattacaacctgttcgacggagggggtgaacaccaagtgccgtttaagcggaacagctctgatccgcgccggttccgttggcgcggaagcctgtctaatgctcaaaggggtcaaggaggatcaaactaaatttctgaagattaaaaccgtgtcaagtgagctttcttgcagagaaggacagagctactggacaggctccttctcacccaagtgtttgagctctaggcggtgccatctggtgggtgagtgtcacgtcaatcgatgcctctcctggcgcgacaacgaaacaagtgctgagtttagcttcgttggggaatctaccacaatgagagagaataaatgctttgagcagtgtggcggatggggctgcgggtgtttcaacgtgaatccttcctgcctgtttgtgcatacctatcttcagtcagtaaggaaggaagcactgcgggtcttcaactgtatagactgggtgcacaagttgactctcgagatcacggattttgacggaagtgttagcacaattgatctgggtgcctcgtcctctcgcttcaccaattggggcagcgtgtcattaagtctggacgctgaagggatctccggatctaacagcttttccttcatcgagtcaccaggcaaaggttacgccattgtcgatgagcccttcagcgaaatacctagacaagggtttctaggcgagatcaggtgcaatagtgaatcttccgtgctcagcgcacacgagtcgtgtctgcgtgcgccaaaccttgtttcatataagcccatgattgaccagttggaatgcactaccaatctgatcgatccgttcgtggtatttgagcggggatctctccctcagacacgaaacgacaaaaccttcgccgctagtaagggcaatagaggggtccaggccttttccaaaggaagcgtgcaagcagatctgactttaatgttcgacaactttgaggtggatttcgtcggcgctgccgtttcttgtgacgcagcctttctgaatcttacaggttgctacagctgtaacgctggggcgagggtgtgcttgtccattacgtcaaccggaactggcacactcagtgcccataacaaggatggtagcctgcacatcgtactaccatctgaaaatggcaccaaggaccagtgccagatactgcatttcacagtgcccgaggtcgaagaggaatttatgtattcctgtgacggggatgagcgccctctcctggtgaaaggaactcttatcgcaattgaccccttcgatgaccggagagaggctggcggggaatcaaccgttgtgaacccaaagagtggaagctggaactttttcgattggttctccggcttgatgtcttggtttggtgggcctctgaaaacgatcttactcatttgcctgtacgtcgccctttcgatcggactgttctttttgctcatatacctgggcaggaccggtctaagcaagatgtggctggccgctactaaaaaggcatcatga

SEQ ID NO: 11258 - RNA, 3204 nt, synthetic construct
  misc_feature 1..3204: note = derived and/or modified CDS sequence (opt3) from RVFV(Hv-B375)__DQ380218.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaaaacgaattgaccgaggattgcaatttttgtcgccagatgacaggtgcttctctcaagaaagggtcgtatccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaactctaagaaagtctaccttgacaagttggacctgaagacagaagagaatctactccccgatagctttgtgtgtttcgagcacaaaggacaatataagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtacgctaacgcctattgttcccacgctaatgggtcaggaattgtgcaaatccaggtcagcggcgtttggaaaaagccactttgcgtgggctacgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtatccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaactaccaatgtcacacagctctgagtgccttcgtggttgtgttcgtattttccagcattgcaatcatctgcctcgccattctttatcgcgtcctgaagtgtttgaaaatagctcctagaaaggtgctaaatcccctgatgtggatcaccgccttcattaggtgggtttacaaaaagatggtggcacgggtcgcggataacatcaatcaggtgaaccgcgaaataggatggatggagggcgggcagctcgtactgggaaacccagctcccattcctcgacacgccccaatcccgagatattctacttaccttatgctgttgctcatcgtgtcatacgcaagtgcctgcagcgaactgattcaggcttcctctaggatcacaacctgttcgacggagggtgttaataccaagtgccggttaagcggcacagccctgattcgtgcagggtccgtcggagctgaagcctgtctaatgctcaaaggcgtgaaggaggaccaaactaaatttctgaagataaaaaccgtgtcaagtgagctttcttgccgcgaaggtcagagctattggacagggtccttctcacccaagtgtttgagctctagaaggtgccatctggtcggcgagtgtcacgttaaccggtgcctctcctggcgagataatgaaacaagtgcggagtttagcttcgtgggagaatctaccacaatgcgcgagaacaaatgctttgagcagtgtggcgggtggggatgcggttgtttcaatgtgaacccttcctgcctgtttgtacatacctaccttcagtcagtcagaaaggaagccctgagggtgttcaattgtatcgactgggttcacaagttgactctcgagattacggactttgatggcagtgtgagcacaatcgacctgggggcttcgtcctctcggttcaccaactggggaagcgtctcattaagtctggatgcagaaggcatctccggttctaatagcttttccttcattgagtcaccagggaaaggctatgccatagtggacgagcccttcagcgaaatccctcgccaaggatttctaggcgagattagatgcaacagtgaatcttccgttctcagcgctcacgagtcgtgtctgagggccccaaatcttatctcatacaagcccatgattgatcagttggaatgcactaccaacctgatcgacccgttcgtggtatttgagcgtgggtctctccctcagacacggaatgataaaaccttcgcagcgagtaagggaaaccgaggcgtccaggccttttccaaaggtagcgtgcaagctgacctgactttaatgttcgataattttgaggtggacttcgtcggggccgcagtttcttgtgatgctgcctttctgaaccttacaggatgctatagctgtaacgcaggcgccagagtgtgcttgtccataacgtcaaccggtactggcacactcagtgctcataataaggacgggagcctgcacatcgtactaccatctgaaaacggaaccaaggatcagtgccagattctgcatttcacagtgcccgaggtcgaagaggaatttatgtactcctgtgacggcgacgagaggcctctcctggtgaaagggactcttatcgcgattgatcccttcgacgatcgccgggaggccggaggcgaatcaaccgttgtgaatccaaagagtggtagctggaactttttcgactggttctccgggttgatgtcttggtttggaggccctctgaaaacgatcttactcatatgcctgtatgtcgcactttcgattggtctgttctttttgctcatctacctgggcagaaccgggctaagcaagatgtggctggctgccactaaaaaggcctcatga

SEQ ID NO: 11259 - RNA, 3204 nt, synthetic construct
  misc_feature 1..3204: note = derived and/or modified CDS sequence (opt3) from RVFV(1260/78)__DQ380214.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattatcaatgtcacacagctctgagtgccttcgtggttgtgttcgtattttccagcattgcaatcatctgcctcgccattcttcaccgcgtcctgaagtgtttgaaaatagctcctagaaaggtgctaaaccccctgatgtggatcaccgccttcattaggtgggtttacaaaaagatggtggcacgggtcgcggataatatcaaccaggtgaatcgcgaaataggatggatggagggcgggcagctcgtactgggaaacccagctcccattcctcgacatgccccaatcccgagatattctacttaccttatgctgttgctcatcgtgtcatacgcaagtgcctgcagcgaactgattcaggcttcctctaggatcacaacctgttcgacggagggtgttaacaccaagtgccggttaagcggcacagccctgattcgtgcagggtccgtcggagctgaagcctgtctaatgctcaaaggcgtgaaggacgatcaaactaaatttctgaagataaaaaccgtgtcaagtgagctttcttgccgcgagggtcagagctattggacagggtccttctcacccaagtgtttgagctctagaaggtgccacctggtcggcgaatgtcatgttaatcggtgcctctcctggcgagacaacgagacaagtgcggaatttagcttcgtgggagagtctaccacaatgcgcgaaaataaatgctttgagcagtgtggcgggtggggatgcggttgtttcaacgtgaatccttcctgcctgtttgtacacacctaccttcagtcagtcagaaaggaggccctgagggtgttcaactgtatcgactgggttcacaagttgactctcgaaattacggattttgacggcagtgtgagcacaatcgatctgggggcttcgtcctctcggttcaccaattggggaagcgtctcattaagtctggacgcagagggcatctccggttctaacagcttttccttcattgaatcaccagggaaaggctatgccatagtggatgagcccttcagcgagatccctcgccaaggatttctaggcgaaattagatgcaatagtgagtcttccgttctcagcgctcatgaatcgtgtctgagggccccaaaccttatctcatacaagcccatgattgaccagttggagtgcactaccaatctgatcgatccgttcgtggtatttgaacgtgggtctctccctcagacacggaacgacaaaaccttcgcagcgagtaagggaaatcgaggcgtccaggccttttccaaaggtagcgtgcaagctgatctgactttaatgttcgacaactttgaggtggatttcgtcggggccgcagtttcttgtgacgctgcctttctgaatcttacaggatgctatagctgtaacgcaggcgccagagtgtgcttgtccataacgtcaaccggtactggcacactcagtgctcacaacaaggatgggagcctgcatatcgtactaccatctgagaatggaaccaaggaccagtgccagattctgcacttcacagtgcccgaagtcgaggaagagtttatgtactcctgtgacggcgatgaaaggcctctcctggtgaaagggactcttatcgcgattgaccccttcgatgaccgccgggaggccggaggcgagtcaaccgttgtgaacccaaagagtggtagctggaactttttcgattggttctccgggttgatgtcttggtttggaggccctctgaaaacgatcttactcatatgcctgtatgtcgcactttcgattggtctgttctttttgctcatctacctgggcagaaccgggctaagcaagatgtggctggctgccactaaaaaggcctcatga

SEQ ID NO: 11260 - RNA, 3204 nt, synthetic construct
  misc_feature 1..3204: note = derived and/or modified CDS sequence (opt3) from RVFV(ZH-501-777)__DQ380202.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggaccctggccagacgaaacgagaactgaagtcctttgatatttcacagtgcccaaaaatcgggggacatggcagtaagaagtgcactggtgacgccgcgttctgtagcgcctacgagtgcaccgcacagtatgctaatgcctactgttctcacgctaacgggtccggaattgtgcaaatccaggtctcaggcgtttggaaaaagcccctttgcgtgggctatgaacgtgtagtggtcaaaagagagctgagcgccaagcctatacagagggtggaaccatgtacaacttgcatcaccaaatgtgagccccacgggttggttgtgcggagtacaggatttaagatttcttccgcagtcgcctgcgctagcggtgtgtgtgtaaccggctcgcaatctccgtccacggagatcactctcaagtaccctgggatttcacagagtagcggaggcgatatcggtgttcatatggcgcacgacgatcagtccgtgtctagcaaaatagtcgcacattgtcccccacaggacccttgcctggtgcacgggtgcattgtctgcgcccatggcttaatcaattatcaatgtcacacagctctgtcagccttcgtggttgtgttcgtatttagttccattgcaatcatctgcctcgccgtcctttaccgcgtgctgaagtgtttgaaaattgctcccagaaaggttctaaacccactgatgtggataaccgccttcatcaggtggatttataaaaagatggtggcacgggtcgcggataatatcaaccaggtgaatcgcgaaataggatggatggagggcgggcagctcgtactgggaaaccccgctcctattccacgacacgccccgatccccagatacagcacttaccttatgctgttgctcatcgtgtcttatgcatcagcctgcagtgaactgattcaggctagctccaggatcacaacctgttctacggagggtgttaacaccaagtgccggttatcgggcacagccctgattcgtgcagggagcgtcggagctgaagcctgtctaatgctcaaaggcgtgaaggaggaccaaactaaatttctgaagataaaaaccgtgtcctcagagcttagttgccgcgaaggtcagtcttactggacagggagcttctcccctaagtgtttgtcaagcagaaggtgccatctggtcggcgagtgtcacgttaatcggtgcctctcttggcgagataacgaaacttccgcggagtttagtttcgtgggagaaagcaccacaatgcgcgagaataaatgctttgagcagtgtggcgggtggggatgcggttgtttcaacgtgaatccatcttgcctgtttgtacatacctatcttcagtccgtcagaaaggaagccctgagggtgttcaactgtatcgactgggttcacaagttgactctcgagattacggactttgatggctcagtgagtacaatcgacctgggggctagctcgtcccggttcaccaattggggatctgtcagcttatcactggatgcagaaggcatcagtggttccaactcttttagcttcattgagtcccccgggaaaggctacgccatagtggacgagcctttctcagaaatcccacgccaaggatttctaggcgagattagatgcaatagcgaaagttctgttctctccgctcacgagagctgtctgagggcccccaaccttatctcgtataagccgatgattgatcagttggaatgcactaccaatctgatcgaccctttcgtggtatttgagcgtgggtcactcccacagacacggaacgataaaaccttcgcagcgtctaagggaaatcgaggcgtccaggcctttagtaaaggttccgtgcaagctgacctgactttaatgttcgataactttgaggtggacttcgtcggggccgcagttagctgtgatgctgcctttctgaatcttacaggatgctactcttgtaacgcaggcgccagagtgtgcttgagcataacgtccaccggtactggctcactcagtgctcataacaaggacgggagcctgcacatcgtactaccctctgaaaatggaacaaaggatcagtgccagattctgcatttcaccgtgcctgaggtcgaagaggaatttatgtattcctgtgacggcgacgagaggcccctcctggtgaaagggacacttatcgcgattgatccattcgacgatcgccgggaggccggaggcgaatcaactgttgtgaaccctaagagtggtagctggaactttttcgactggttctccgggttgatgtcttggtttggaggccccctgaaaaccatcttactcatatgcctgtacgtcgcactttcgattggtctgttctttttgctcatctacctgggcagaacggggctaagcaagatgtggctggctgccaccaaaaaggcctcatga

SEQ ID NO: 11261 - RNA, 3204 nt, synthetic construct
  misc_feature 1..3204: note = derived and/or modified CDS sequence (opt3) from RVFV(OS-3)__DQ380184.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggagtggtccaaattcaggttagcggcgtgtggaaaaagccactttgcgtaggctatgaacgtgtggtcgtgaaaagagagctgagtgccaagcccatccagagggttgaaccttgtacaacttgcataaccaaatgtgagccacacgggttggtggtccggtctacaggatttaagatctccagcgcagtggcctgcgcttcgggtgtatgtgttaccggctctcaatccccctcaacggagattactctcaagtacccggggatcagtcagagctccggaggcgatattggtgtgcatatggcgcacgacgatcagtctgtcagctcaaaaatcgtggcacattgccctccccaggacccatgtctggtccacgggtgcatagtgtgcgcccatggcttaattaattatcaatgtcacacagctctgagtgccttcgttgtggtattcgtcttttccagcgtggcaatcatttgcctcgccatcctttacaaggttctgaaatgtttgaagatcgctcctcgcaaagtgctaaaccccctgatgtggattaccgccttcataagatgggtctataagaagatggtggcaagggtagcggataatatcaaccaggtgaatcgggaaattggatggatggagggcgggcagctcgctctgggaaacccagcccccatccctcgccacgcaccaataccgcgatactctacttaccttatgctgttgctcattgtttcatatgccagtgcttgcagcgaactgatccaggcctcctctagaatcacaacctgttcgacggagggtgtcaacaccaaatgcaggttaagcggcacagcactgattcgggctgggtccgtgggagccgaagcgtgtctaatgctcaagggcgtgaaagaggaccaaactaagtttctgaaaatcaagaccgtctcaagtgagctttcttgccgtgaaggtcagagctactggacagggtccttctcacccaaatgtttgagctctcgcagatgccatctggttggcgagtgtcacgtgaataggtgcctctcctggcgggataacgaaaccagtgccgagtttagcttcgtgggagaatctactacaatgcgagagaataagtgctttgagcagtgtggcgggtggggatgcggttgtttcaacgtaaatccttcctgcctgtttgtccatacctatcttcagtcagtgcgcaaggaagctctgagagttttcaactgtattgactgggtgcacaaattgactctcgagataacggactttgatggcagtgtcagcacaatcgacctgggggcatcgtcctctaggttcaccaattggggaagcgtgtcattaagtctggatgccgaaggcatttccggttctaacagcttttccttcatcgagtcaccagggaagggctacgctatcgttgacgagcccttcagcgaaattcctcggcaaggatttctaggcgagatacgctgcaatagtgaatcttccgtgctcagcgcccacgagtcgtgtctgagagcaccaaaccttatctcatataaacccatgattgatcagttggaatgcactaccaatctgatcgacccgttcgtagtctttgagagggggtctctccctcagacacgtaacgataagaccttcgcggccagtaaaggaaatcggggcgtgcaggctttttccaagggtagcgtgcaagccgacctgactttaatgttcgataactttgaggtcgacttcgttggggcagctgtgtcttgtgatgccgcatttctgaatcttacaggatgctacagctgtaacgccggcgctcgagtatgcttgtccattacgtcaaccggtactggcacactcagtgcgcataacaaggacgggagcctgcacatcgtgctaccatctgaaaatggaaccaaagatcagtgccagatactgcatttcacagtccccgaggtggaagaggaatttatgtattcctgtgacggcgacgagagacctctcctggttaaggggactcttatcgccattgatcccttcgacgataggcgcgaggcaggaggcgaatcaaccgtggtcaacccaaaaagtggtagctggaactttttcgactggttctccgggttgatgtcttggtttggaggccctctgaagacgatcttactcatttgcctgtacgtggctctttcgatcggtctgttctttttgctcatatacctgggccggaccgggctaagcaaaatgtggctggccgccacaaagaaggcttcatga

SEQ ID NO: 11262 - RNA, 3204 nt, synthetic construct
  misc_feature 1..3204: note = derived and/or modified CDS sequence (opt3) from RVFV(SAUDI 200010901)__KU978778.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgccttttgttcccacgctaacgggtcaggaattgtgcaaatccaggtcagcggcgtttggaaaaagccactttgcgtgggctacgaacgtgtagtggtcaaaagagagctgagtgccaagcccatacagagggtggaaccttgtacaacttgcatcaccaaatgtgagccacacgggttggttgtgcggtctacaggattcaagatttccagcgcagtcgcctgcgcttcgggtgtgtgtgtaaccggctctcaatccccctcaacggagatcactctcaagtatccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattaccaatgtcacacagctctgagtgccttcgtggttgtgtttgtattctccagcattgcaatcatctgcctcgccattctttatcgcgtcctgaagtgtttgaaaatagctcctagaaaggtgctaaaccccctgatgtggatcaccgcctttattaggtgggtttacaaaaagatggtggcacgggtcgcggataatatcaaccaggtgaatcgcgaaataggatggatggagggcgggcagctcgtactgggaaacccagctcccattcctcgacacgccccaatcccgagatattctacttaccttatgctgttgctcatcatttcatacgcaagtgcctgcagcgaactgatccaggcttcctctaggattacaacctgttcgacggagggtgtgaacaccaagtgccggttaagcggcacagccctgatacgtgcagggtccgttggagctgaagcctgtctaatgctcaaaggcgtcaaggaggaccaaactaaattcctgaagatcaaaaccgtgtcaagtgagctttcttgccgcgaaggtcagagctattggacagggtccttttcacccaagtgtttgagctctagaaggtgccatctggtgggcgagtgtcacgtcaatcggtgcctctcctggcgagataacgaaacaagtgcggagttcagctttgttggagaatctaccacaatgcgcgagaataaatgcttcgagcagtgtggcgggtggggatgcggttgttttaacgtgaatccttcctgcctgttcgtgcatacctaccttcagtcagtaagaaaggaagccctgagggtctttaactgtattgactgggtgcacaagttgactctcgagatcacggacttcgatggcagtgttagcacaatcgacctgggggcttcgtcctctcggtttaccaattggggaagcgtgtcattaagtctggatgcagaaggcatttccggttctaacagcttctccttcatagagtcaccagggaaaggctatgccatcgtcgacgagccctttagcgaaattcctcgccaaggattcctaggcgagatcagatgcaatagtgaatcttccgtgctcagcgctcacgagtcgtgtctgagggccccaaaccttatttcatacaagcccatgatcgatcagttggaatgcactaccaatctgatagacccgtttgttgtgttcgagcgtgggtctctccctcagacacggaacgagaaaacctttgcagcgagtaagggaaatcgaggcgtacaggccttctccaaaggtagcgtccaagctgatctgactttaatgtttgacaacttcgaagtggattttgtgggggccgcagtctcttgtgacgctgccttcctgaatcttacaggatgctatagctgtaacgcaggcgccagagtttgcttgtccatcacgtcaaccggtactggcacactcagtgctcataacaaggatgggagcctgcacattgtgctaccatctgagaatggaaccaaggaccagtgccagatcctgcattttacagtacccgaagtggaggaagagttcatgtactcctgtgatggcgacgagaggcctctcctggtcaaagggactcttattgcgatcgacccctttgatgaccgccgggaagccggaggcgagtcaaccgtggttaacccaaagagtggtagctggaatttcttcgattggttttccgggttgatgtcttggttcggaggccctctgaaaacgatattactcatttgcctgtatgtggcactttcgatcggtctgtttttcttgctcatttacctgggcagaaccgggctaagcaagatgtggctggctgccactaaaaaggcctcatga

SEQ ID NO: 11263 - RNA, 3204 nt, synthetic construct
  misc_feature 1..3204: note = derived and/or modified CDS sequence (opt3) from RVFV(2007001811)__EU574040.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattatcaatgtcacacagctctgagtgccttcgtggttgtgttcgtattttccagcattgcaatcatctgcctcgccattctttaccgcgtcctgaagtgtttgaaaatagctcctagaaaggtgctaaaccccctgatgtggatcaccgccttcattaggtgggtttataaaaagatggtggcacgggtcgcggataatatcaaccaggtgaatcgcgaaataggatggatggagggcgggcagctcgtactgggaaacccagctcccattcctcgacacgccccaatcccgagatactctacttaccttatgctgttgctcatcgtgtcatatgcaagtgcctgcagcgaactgattcaggcttcctctaggatcacaacctgttcgacggagggtgttaacaccaagtgccggttaagcggcacagccctgattcgtgcagggtccgtcggagctgaagcctgtctaatgctcaaaggcgtgaaggaggaccaaactaaatttctgatgataaagaccgtgtcaagtgagctttcttgccgcgaaggtcagagctactggacagggtccttctcacccaaatgtttgagctctagaaggtgccatctggtcggcgagtgtcacgttaatcggtgcctctcctggcgagataacgaaaccagtgcggagtttagcttcgtgggagaatctactacaatgcgcgagaataagtgctttgagcagtgtggcgggtggggatgcggttgtttcaacgtgaatccttcctgcctgtttgtacatacctatcttcagtcagtcagaaaagaagccctgagggtgttcaactgtatcgactgggttcacaagttgactctcgagattacggactttgatggcagtgtgagcacaatcgacctgggggcttcgtcctctcggttcaccaattggggaagcgtctcattaagtctggatgcagaaggcatctccggttctaacagcttttccttcattgagtcaccagggaagggctacgccatagtggacgagcccttcagcgaaatccctcgccaaggatttctaggcgagattagatgcaatagtgaatcttccgttctcagcgctcacgagtcgtgtctgagggccccaaaccttatctcatataaacccatgattgatcagttggaatgcactaccaatctgatcgacccgttcgtggtatttgagcgtgggtctctccctcagacacggaacgagaagaccttcgcagcgagtaaaggaaatcgaggcgtccaggccttttccaagggtagcgtgcaagctgatctgactttaatgttcgacaactttgaagtggatttcgtcggggccgcagtttcttgtgacgctgcctttctgaatcttacaggatgctacagctgtaacgcaggcgccagagtgtgcttgtccataacgtcaaccggtactggcacactcagtgctcataacaaagatgggagcctgcacatcgtactaccatctgagaatggaaccaaggaccagtgccagattctgcatttcacagtgcccgaagtcgaggaagagtttatgtattcctgtgatggcgacgagaggcctctcctggtgaaggggactcttatcgcgattgaccccttcgatgaccgccgggaagccggaggcgagtcaaccgttgtgaacccaaaaagtggtagctggaactttttcgattggttctccgggttgatgtcttggtttggaggccctctgaagacgatcttactcatatgcctgtacgtcgcactttcgattggtctgttctttttgctcatctacctgggcagaaccgggctaagcaaaatgtggctggctgccacaaagaaagcctcatga

SEQ ID NO: 11264 - RNA, 3204 nt, synthetic construct
  misc_feature 1..3204: note = derived and/or modified CDS sequence (opt3) from RVFV(2007000253)__JF326192.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattatcaatgtcacacagctctgagtgccttcgtggttattttcgtgttttccagcaccgcaatcatctgcctcgccgtactttaccgcgtcctgaagtgtttgaaaattgctcctagaaaggtgctaaaccccctgatgtggataactgccttcatcaggtgggtttataaaaagatggtggcacgggtcgcggataatattaaccaggtgaatcgcgaaatcggatggatggagggcgggcagctcgctctgggaaacccagcccccatacctcgacacgcaccaattccgagatactctacataccttatgctgttgctcatcgtatcatatgccagtgcttgcagcgaactgatccaggcctcctctaggattaccacgtgttcgaccgagggtgtgaacacaaagtgccggttaagcggcactgcactgatccgtgctgggtccgccggagcggaagcctgtctaatgctcaaaggcgttaaggaggaccaaaccaaatttctgaagattaaaacagtctcaagtgagctttcttgccgcgaaggtcagagctactggactgggtccttctcacccaagtgtttgagctctagaaggtgccatctggtgggcgagtgtcacgtgaatcggtgcctctcctggcgagataacgaaaccagtgctgagtttagcttcgtcggagaatctacaaccatgcgcgagaataaatgctttgagcagtgtggcgggtggggatgcggttgtttcaacgttaatccttcctgcctgtttgtgcatacttatcttcagtcagtgagaaaggaagcactgagggtattcaactgtatagactgggtccacaagttgacgctcgagatcacagactttgatggcagtgtgagcaccattgacctgggggcctcgtcctctcggttcactaattggggaagcgtttcattaagtctggatgctgaaggcatctccggttctaacagcttttccttcatcgagtcaccagggaaaggctacgccattgtggacgagcccttcagcgaaatacctcgccaaggatttctaggcgagatcagatgcaatagtgaatcttccgtcctcagcgcacacgagtcgtgtctgagggcgccaaaccttgtgtcatataagcccatgattgatcagttggaatgcaccacaaatctgatcgacccgttcgttgtgtttgagcgtgggtctctccctcagacccggaacgataaaactttcgccgctagtaagggaaatcgaggcgtacaggccttttccaaaggtagcgtccaagcagacctgacattaatgttcgataactttgaggtggacttcgtgggggctgccgtctcttgtgatgcagcctttctgaatcttacgggatgctacagctgtaacgctggcgcgagagtttgcttgtccattacctcaactggtacaggcaccctcagtgcccataacaaggacgggagcctgcacatcgtgctaccatctgaaaatggaacaaaggatcagtgccagatactgcatttcactgtacccgaggtggaagaggaatttatgtattcctgtgacggcgacgagaggcctctcctggtcaaagggacccttatcgcaattgatcccttcgacgatcgccgggaggctggaggcgaatcaacggtggttaacccaaagagtggtagctggaactttttcgactggttctccgggttgatgtcttggtttggaggccctctgaaaaccatcttactcatttgcctgtacgtggccctttcgatcggtctgttctttttgctcatatacctgggcagaacagggctaagcaagatgtggctggccgctactaaaaaggcatcatga

SEQ ID NO: 11265 - RNA, 3204 nt, synthetic construct
  misc_feature 1..3204: note = derived and/or modified CDS sequence (opt3) from RVFV(2007001292)__EU574046.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattatcaatgtcacacagctctgagtgccttcgtggttattttcgtgttttccagcaccgcaatcatctgcctcgccgtactttaccgcgtcctgaagtgtttgaaaattgctcctagaaaggtgctaaaccccctgatgtggataactgccttcatcaggtgggtttataaaaagatggtggcacgggtcgcggataatattaaccaggtgaatcgcgaaatcggatggatggagggcgggcagctcgctctgggaaacccagcccccatacctcgacacgcaccaattccgagatactctacataccttatgctgttgctcatcgtatcatatgccagtgcttgcagcgaactgatccaggcctcctctaggattaccacgtgttcgaccgagggtgtgaacacaaagtgccggttaagcggcactgcactgatccgtgctgggtccgttggagccgaagcgtgtctaatgctcaaaggcgtcaaggaggaccaaaccaaatttctgaagattaaaacagtgtcaagtgagctttcttgccgcgaaggtcagagctactggactgggtccttctcacccaagtgtttgagctctagaaggtgccatctggtgggcgagtgtcacgtcaatcggtgcctctcctggcgagataacgaaaccagtgccgagtttagcttcgttggagaatctacaaccatgcgcgagaataaatgctttgagcagtgtggcgggtggggatgcggttgtttcaacgtgaatccttcctgcctgtttgtgcatacttatcttcagtcagtaagaaaggaagctctgagggtcttcaactgtatagactgggtgcacaagttgacgctcgagatcacagactttgatggcagtgttagcaccattgacctgggggcatcgtcctctcggttcactaattggggaagcgtgtcattaagtctggatgccgaaggcatctccggttctaacagcttttccttcatcgagtcaccagggaaaggctacgctattgtcgacgagcccttcagcgaaatacctcgccaaggatttctaggcgagatcagatgcaatagtgaatcttccgtgctcagcgcccacgagtcgtgtctgagggcaccaaaccttgtttcatataagcccatgattgatcagttggaatgcaccacaaatctgatcgacccgttcgtggtatttgagcgtgggtctctccctcagacccggaacgataaaactttcgcggccagtaagggaaatcgaggcgtccaggctttttccaaaggtagcgtgcaagccgacctgacattaatgttcgataactttgaggtggacttcgtcggggcagctgtttcttgtgatgccgcatttctgaatcttacgggatgctacagctgtaacgccggcgctagagtgtgcttgtccattacctcaactggtacaggcaccctcagtgcgcataacaaggacgggagcctgcacatcgtactaccatctgaaaatggaacaaaggatcagtgccagatactgcatttcactgtgcccgaggtcgaagaggaatttatgtattcctgtgacggcgacgagaggcctctcctggtgaaagggacccttatcgccattgatcccttcgacgatcgccgggaggcaggaggcgaatcaacggttgtgaacccaaagagtggtagctggaatttgtttgactggttctccgggctgatgtcttggttcggaggccctttaaaaaccatcctcctgatttgcctttacgtcgctctgtcgatcggtttgtttttcctcctgatatacctaggcagaacagggctgagcaagatgtggctcgccgccactaaaaaggcttcatga

SEQ ID NO: 11266 - RNA, 3204 nt, synthetic construct
  misc_feature 1..3204: note = derived and/or modified CDS sequence (opt3) from RVFV(2007002476)__EU574036.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattatcaatgtcacacagctctgagtgccttcgtggttattttcgtgttttccagcaccgcaatcatctgcctcgccgtactttaccgcgtcctgaagtgtttgaaaattgctcctagaaaggtgctaaaccccctgatgtggataactgccttcatcaaatgggtttataagaagatggtggcaagggtcgcggataatattaaccaggtgaatcgggaaatcggatggatggagggcgggcagctcgctctgggaaacccagcccccatacctcgccacgcaccaattccgcgatactctacataccttatgctgttgctcatcgtatcatatgccagtgcttgcagcgaactgatccaggcctcctctagaattaccacgtgttcgaccgagggtgtgaacacaaaatgcaggttaagcggcactgcactgatccgggctgggtccgttggagccgaagcgtgtctaatgctcaagggcgtcaaagaggaccaaaccaagtttctgaaaattaagacagtgtcaagtgagctttcttgccgtgaaggtcagagctactggactgggtccttctcacccaaatgtttgagctctcgcagatgccatctggtgggcgagtgtcacgtcaataggtgcctctcctggcgggataacgaaaccagtgccgagtttagcttcgttggagaatctacaaccatgcgagagaataagtgctttgagcagtgtggcgggtggggatgcggttgtttcaacgtgaatccttcctgcctgtttgtgcatacttatcttcagtcagtacgcaaggaagctctgagagtcttcaactgtatagactgggtgcacaaattgacgctcgagatcacagactttgatggcagtgttagcaccattgacctgggggcatcgtcctctaggttcactaattggggaagcgtgtcattaagtctggatgccgaaggcatctccggttctaacagcttttccttcatcgagtcaccagggaagggctacgctattgtcgacgagcccttcagcgaaatacctcggcaaggatttctaggcgagatccgctgcaatagtgaatcttccgtgctcagcgcccacgagtcgtgtctgagagcaccaaaccttgtttcatataaacccatgattgatcagttggaatgcaccacaaatctgatcgacccgttcgtggtatttgagagggggtctctccctcagacccgtaacgataagactttcgcggccagtaaaggaaatcggggcgtccaggctttttccaagggtagcgtgcaagccgacctgacattaatgttcgataactttgaggtggacttcgtcggggcagctgtttcttgtgatgccgcatttctgaatcttacgggatgctacagctgtaacgccggcgctcgagtgtgcttgtccattacctcaactggtacaggcaccctcagtgcgcataacaaggacgggagcctgcacatcgtactaccatctgaaaatggaacaaaagatcagtgccagatactgcatttcactgtgcccgaggtcgaagaggaatttatgtattcctgtgacggcgacgagagacctctcctggtgaaggggacccttatcgccattgatcccttcgacgataggcgcgaggcaggaggcgaatcaacggttgtgaacccaaaaagtggtagctggaactttttcgactggttctccgggttgatgtcttggtttggaggccctctgaagaccatcttactcatttgcctgtacgtcgctctttcgatcggtctgttctttttgctcatatacctgggccggacagggctaagcaaaatgtggctggccgccactaagaaggcttcatga

SEQ ID NO: 11267 - RNA, 3204 nt, synthetic construct
  misc_feature 1..3204: note = derived and/or modified CDS sequence (opt3) from RVFV(73HB1230)__DQ380221.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaaaaggaactgaaatcatttgatattagtcagtgccctaagatcgggggacatggcagcaagaaatgcactggtgacgccgcgttctgttctgcctacgagtgcaccgcacagtatgctaatgcctactgttcccacgctaacgggtcaggaattgtgcaaatccaggtcagcggcgtttggaagaaaccactttgcgtgggctatgaacgagtagtggtcaagcgtgagctgagtgccaaacccatacagagagtggaaccttgtacaacttgcatcaccaagtgtgagccacacgggttggttgtgaggtctacaggatttaagatttccagcgcagtcgcctgcgcttcgggtgtgtgtgtaaccggctctcaatccccctcaacggagatcactctcaaatacccggggattagtcagagctccggaggcgatatcggtgttcatatggcgcacgacgatcagtctgtgagctcaaagatagtcgcacattgccctccccaggacccatgtctggtgcacgggtgcattgtctgcgcccatggcttaatcaattatcaatgtcacacagctctgagtgccttcgtggttgtgttcgtattttccagcattgcaatcatctgcctcgccattctttaccgggtcctgaaatgtttgaagatagctcctcgcaaagtgctaaaccccctgatgtggatcaccgccttcattagatgggtttataagaagatggtggcaagggtcgcggataatatcaaccaggtgaatcgggaaataggatggatggagggcgggcagctcgtactgggaaacccagctcccattcctcgccacgccccaatcccgcgatactctacttaccttatgctgttgctcatcgtgtcatatgcaagtgcctgcagcgaactgattcaggcttcctctagaatcacaacctgttcgacggagggtgttaacaccaaatgcaggttaagcggcacagccctgattcgggcagggtccgtcggagctgaagcctgtctaatgctcaagggcgtgaaagaggaccaaactaagtttctgaaaataaagaccgtgtcaagtgagctttcttgccgtgaaggtcagagctactggacagggtccttctcacccaaatgtttgagctctcgcagatgccatctggtcggcgagtgtcacgttaataggtgcctctcctggcgggataacgaaaccagtgcggagtttagcttcgtgggagaatctactatcatgcgagagaataagtgctttgagcagtgtggcgggtggggatgcggttgtttcaacgtgaatccttcctgcctgtttgtacatacatatcttcagtcagtccgcaaggaagccctgagagtgttcaactgtattgactgggttcacaaattgaccctcgagatcactgactttgatggcagtgtgagcacgatcgacctgggggcttcgtcctctaggttcacaaattggggaagcgtctcattaagtctggatgcagaaggcatttccggttctaacagcttttccttcatagagtcaccagggaagggctacgccatcgtggacgagcccttcagcgaaattcctcggcaaggatttctaggcgagatccgctgcaatagtgaatcttccgttctcagcgctcacgagtcgtgtctgagagccccaaaccttatttcatataaacccatgatcgatcagttggaatgcaccactaatctgatagacccgttcgtggtatttgagagggggtctctccctcagacccgtaacgataagacattcgcagcgagtaaaggaaatcggggcgtccaggccttttccaagggtagcgtgcaagctgacctgaccttaatgttcgataactttgaggtggacttcgtcggggccgcagtttcttgtgatgctgcctttctgaatcttactggatgctacagctgtaacgcaggcgcccgagtgtgcttgtccatcacatcaacgggtaccggcactctcagtgctcataacaaggacgggagcctgcacattgtactaccatctgaaaatggaacaaaagatcagtgccagatcctgcatttcaccgtgcccgaggtcgaagaggaatttatgtattcctgtgacggcgacgagagacctctcctggtgaaggggacacttattgcgatcgatcccttcgacgataggcgcgaggccggaggcgaatcaactgttgtgaacccaaaaagtggtagctggaactttttcgactggttctccgggttgatgtcttggtttggaggccctctgaagaccatattactcatttgcctgtacgtcgcactttcgatcggtctgttctttttgctcatttacctgggccggacggggctaagcaaaatgtggctggctgccaccaagaaggcctcatga

SEQ ID NO: 11268 - RNA, 3204 nt, synthetic construct
  misc_feature 1..3204: note = derived and/or modified CDS sequence (opt3) from RVFV(ZINGA J83 R1)__KU978776.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaagatggcctccgttaagtgtccccctaaatatgaattgaccgaggattgcaacttttgtcgcctcatgacaggtgcttctctgaagaaagggtcgtacccactgcaggacctcttctgccaatcaagcgaggatgacggaagtaagttaaagaccaaaatgaagggcgtgtgtgaagtcggcgtgcaggccctgaaaaagtgcgatgggcagctttccactgcacatgaggtagttccgtttgctgtgttcaaaaattctaagaaagtctatttggacaagctggacctaaagacagaagagaacctcctgcccgatagctttgtgtgtttcgagcacaaaggacagtacaagggtaccatggactccggccaaacgaaacgagaacttaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcagatccaagtcagcggcgtttggaaaaagccactgtgcgtgggctatgaacgtgtagtggtcaaaagagagttgagtgccaagcccatacagagggtggaaccttgtacaacttgcatcaccaaatgtgagccacacgggctcgttgtgcggtctacaggatttaagatttccagcgcagtcgcctgcgcttcgggtgtgtgtgtaaccggctctcagtccccctcaacggagatcactctgaagtacccggggattagtcaaagctccggaggcgatatcggtgttcatatggcgcacgacgatcagtctgtgagctcaaaaatagtcgcacattgccctccccaggacccatgtttagtgcacgggtgcattgtctgcgcccatggcctgatcaattatcagtgtcacacagctctcagtgccttcgtggttgtgttcgtattttccagcattgcaatcatctgccttgccattctgtaccgcgtcttgaagtgtctaaaaatagctcctagaaaggtgctgaaccccctcatgtggatcaccgccttcattaggtgggtttatcggaaaatggtggcacgcgtcgcggataatatcaaccaagtgaatcgagaaataggatggatggagggcgggcagctggtacttggaaacccagctcccattcctagacacgtgccaatcccgaggtactctacttacctgatgttgctcctgatcgtttcatatgccagtgcatgcagcgaattaattcaggcctcctctcggatcacaacctgttcgacggagggtgtcaacaccaagtgccgtctgagcggcacagctctaattcgcgccgggtccgtgggagcagaggcttgtctcatgctgaagggcgtgaaagaagaccagactaagtttcttaaaataaagaccgtctcaagtgagttgtcttgcagagaaggtcaaagctactggacagggtccttctcacccaaatgtctgagctctaggcggtgccatctcgttggcgagtgtcacgtgaatcgatgcctgtcctggcgcgataacgaaacaagtgccgagtttagcttcgtgggagaatctaccacaatgagagagaataagtgctttgagcagtgtggcgggtggggatgcggttgtttcaacgtaaatccttcctgcctttttgtccatacctatctgcagtcagtgaggaaagaagcgttgcgggttttcaactgtatcgactgggtgcacaagctcactctggagattacggactttgatggcagtgtcagcacaatcgacttaggggcctcgtcctctcgcttcaccaattggggaagcgtgtcactgagtctagatgctgaaggcatctccggttctaacagcttttccttcattgagtcaccagggaagggctacgcaatagttgacgagcccttcagcgaaatccctagacagggatttctcggcgagattaggtgcaatagtgaatcttccgtgctgagcgcccacgagtcgtgtcttcgtgctccaaacttgatctcatataaacccatgattgatcaactggaatgcactaccaatctcatcgacccgttcgtagtctttgagcgggggtctctgcctcagacacgaaacgataagaccttcgccgcaagtaaaggaaatagaggcgtgcaggcgttttccaagggtagcgtgcaggccgacttaactctgatgttcgataactttgaggtcgacttcgttggggctgccgtgtcttgtgatgcagcttttcttaatttgacaggatgctacagctgtaacgccggcgcaagggtatgcctctccataacgtcaaccggtactggcacactgagtgcccataacaaagacgggagcctacacatcgtgctgccatctgaaaatggaaccaaggatcaatgccagattctccatttcacagtccccgaggtggaagaggaatttatgtattcctgtgacggcgacgagcgccctctgcttgttcgggggactttgatcgctattgatcccttcgacgatagaagggaggcgggaggcgaatcaaccgtggtcaacccaaagagtggtagctggaactttttcgactggttctccgggctgatgtcttggtttggaggccctttaaaaacgatcctcctgatatgcctttacgtggccctgtcgattggtttgttctttctcctgatctacctaggccgcaccgggctgagcaagatgtggctcgcagctactaaaaaggcctcatga

SEQ ID NO: 11269 - RNA, 3204 nt, synthetic construct
  misc_feature 1..3204: note = derived and/or modified CDS sequence (opt3) from RVFV(2008/00101)__HE687306.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattatcaatgtcacacagctctgagtgccttcgtggttattttcgtgttttccagcaccgcaatcatctgcctcgccgtactttaccgcgtcctgaagtgtttgaaaattgctcctagaaaggtgctaaaccccctgatgtggataactgccttcatcaggtgggtttataaaaagatggtggcacgggtcgcggataatattaaccaggtgaatcgcgaaatcggatggatggagggcgggcagctcgctctgggaaacccagcccccatacctcgacacgcaccaattccgagatactctacataccttatgctgttgctcatcgtatcatatgccagtgcttgcagcgaactgatccaggcctcctctaggattaccacgtgttcgaccgagggtgtgaacacaaagtgccggttaagcggcactgcactgatccgtgctgggtccgttggagccgaagcgtgtctaatgctcaaaggcgtcaaggaggaccaaaccaaatttctgaagattaaaacagtgtcaagtgagctttcttgccgcgaaggtcagagctactggactgggtccttctcacccaagtgtttgagctctagaaggtgccatctggtgggcgagtgtcacgtcaatcggtgcctctcctggcgagataacgaaaccagtgccgagtttagcttcgttggagaatctacaaccatgcgcgagaataaatgctttgagcagtgtggcgggtggggatgcggttgtttcaacgtgaatccttcctgcctgtttgtgcatacttatcttcagtcagtaagaaaggaagctctgagggtcttcaactgtatagactgggtgcacaagttgacgctcgagatcacagactttgatggcagtgttagcaccattgacctgggggcatcgtcctctcggttcactaattggggaagcgtgtcattaagtctggatgccgaaggcatctccggttctaacagcttttccttcatcgagtcaccagggaaaggctacgctattgtcgacgagcccttcagcgaaatacctcgccaaggatttctaggcgagatcagatgcaatagtgaatcttccgtgctcagcgcccacgagtcgtgtctgagggcaccaaaccttgtttcatataagcccatgattgatcagttggaatgcaccacaaatctgatcgacccgttcgtggtatttgagcgtgggtctctccctcagacccggaacgataaaactttcgcggccagtaagggaaatcgaggcgtccaggctttttccaaaggtagcgtgcaagccgacctgacattaatgttcgataactttgaggtggacttcgtcggggcagctgtttcttgtgatgccgcatttctgaatcttacgggatgctacagctgtaacgccggcgctagagtgtgcttgtccattacctcaactggtacaggcaccctcagtgcgcataacaaggacgggagcctgcacatcgtactaccatctgaaaatggaacaaaggatcagtgccagatactgcatttcactgtgcccgaggtcgaagaggaatttatgtattcctgtgacggcgacgagaggcctctcctggtgaaagggacccttatcgccattgatcccttcgacgatcgccgggaggcaggaggcgaatcaacggttgtgaacccaaagagtggtagctggaactttttcgactggttctccgggttgatgtcttggtttggaggccctctgaaaaccacattactcatctgcctgtacgtcgctctttcgattggtctgttctttttgctcatctacctgggcagaactgggctaagcaagatgtggctggccgccaccaaaaaggcttcatga

SEQ ID NO: 11270 - RNA, 3204 nt, synthetic construct
  misc_feature 1..3204: note = derived and/or modified CDS sequence (opt3) from RVFV(2007002445)__EU574037.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattatcaatgtcacacagctctgagtgccttcgtggttattttcgtgttttccagcaccgcaatcatctgcctcgccgtactttaccgcgtcctgaagtgtttgaaaattgctcctagaaaggtgctaaaccccctgatgtggataactgccttcatcaggtgggtttataaaaagatggtggcacgggtcgcggataatattaaccaggtgaatcgcgaaatcggatggatggagggcgggcagctcgctctgggaaacccagcccccatacctcgacacgcaccaattccgagatactctacataccttatgctgttgctcatcgtatcatatgccagtgcttgcagcgaactgatccaggcctcctctaggattaccacgtgttcgaccgagggtgtgaacacaaagtgccggttaagcggcactgcactgatccgtgctgggtccgttggagccgaagcgtgtctaatgctcaaaggcgtcaaggaggaccaaaccaaatttctgaagattaaaacagtgtcaagtgagctttcttgccgcgaaggtcagagctactggactgggtccttctcacccaagtgtttgagctctagaaggtgccatctggtgggcgagtgtcacgtcaatcggtgcctctcctggcgagataacgaaaccagtgccgagtttagcttcgttggagaatctacaaccatgcgcgagaataaatgctttgagcagtgtggcgggtggggatgcggttgtttcaacgtgaatccttcctgcctgtttgtgcatacttatcttcagtcagtaagaaaggaagctctgagggtcttcaactgtatagactgggtgcacaagttgacgctcgagatcacagactttgatggcagtgttagcaccattgacctgggggcatcgtcctctcggttcactaattggggaagcgtgtcattaagtctggatgccgaaggcatctccggttctaacagcttttccttcatcgagtcaccagggaaaggctacgctattgtcgacgagcccttcagcgaaatacctcgccaaggatttctaggcgagatcagatgcaatagtgaatcttccgtgctcagcgcccacgagtcgtgtctgagggcaccaaaccttgtttcatataagcccatgattgatcagttggaatgcaccacaaatctgatcgacccgttcgtggtatttgagcgtgggtctctccctcagacccggaacgagaaaactttcgcggccagtaagggaaatcgaggcgtccaggctttttccaaaggtagcattcaagccgatctgacattaatgttcgacaactttgaagtggatttcgtgggggcagctgtctcttgtgacgccgcatttctgaatcttacgggatgctacagctgtaacgccggcgctagagtttgcttgtccatcacctcaactggtacaggcaccctcagtgcgcataacaaggatgggagcctgcacatagtgctaccatctgagaatggaacaaaggaccagtgccagatcctgcatttcactgtacccgaagtggaggaagagtttatgtattcctgtgatggcgacgagaggcctctcctggtcaaagggacccttattgccatcgaccccttcgatgaccgccgggaagcaggaggcgagtcaacggtggttaacccaaagagtggtagctggaactttttcgattggttctccgggttgatgtcttggtttggaggccctctgaaaaccattttactcatctgcctgtacgtggctctttcgataggtctgttctttttgctcatttacctgggcagaacagggctaagcaagatgtggctggccgccactaaaaaggcttcatga

SEQ ID NO: 11271 - RNA, 3204 nt, synthetic construct
  misc_feature 1..3204: note = derived and/or modified CDS sequence (opt3) from RVFV(ZC-3349)__DQ380207.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcaggcagtgtctagcaaaatagtcgcccattgccctccccaggacccatgtctggtgcacgggtgcattgtctgcgctcatggcttaatcaattatcaatgtcacacagccctgtcagcattcgtggttgtgttcgtatttagttccattgccatcatctgcctcgctattctttaccgcgtcctgaagtgtttgaaaatagcccctagaaaggtgctaaaccccctgatgtggatcaccgcattcattaggtggatctataaaaagatggttgcgcgggtggctgataatataaaccacgtcaatcgcgaaattggatggatggagggcgggcagctcgtgctgggaaacccagcccccatccctcgacatgcaccaatcccgagatacagcacttaccttatgctgttgctcattgtatcttatgcctcagcttgcagtgaactgatccaggccagctccaggattacaacctgttctacggagggtgtgaacaccaagtgccggttatcgggcacagcactgatacgtgctgggagcgttggagccgaagcgtgtctaatgctcaaaggcgtcaaggaggaccagactaaatttctgaagatcaaaaccgtgtcctcagagcttagttgccgcgaaggtcaatcttactggacagggagcttctcccccaagtgtttgtcaagcagaaggtgccacctggtgggcgagtgtcatgtcaatcggtgcctctcttggcgagataacgaaacttccgccgagtttagtttcgttggagaaagcaccacaatgcgcgagaataaatgctttgagcagtgtggcgggtggggatgcggttgtttcaacgtgaatccttcttgcctgtttgtgcacacctatcttcagtccgtaagaaaggaagctctgagggtcttcaactgtattgactgggtgcacaagttgactctcgagatcacggactttgatggctcagttagtacaatcgacctgggggcaagctcgtcccggttcaccaattggggatctgtgagcttatcactggatgccgaaggcattagtggttccaactcttttagcttcatagagtccccagggaaaggctacgctatcgtcgacgagcccttctcagaaattcctcgccagggatttctaggcgagatcagatgcaatagcgaaagttctgtgctctccgcccatgagagctgtctgaaggcaccaaaccttatttcgtataaacccatgatcgatcaattggaatgcactaccaatctgatagacccgttcgttgtgtttgagagggggtcactccctcagacacgtaacgataagaccttcgcggcctctaaaggaaatcggggcgtacaggcttttagtaagggttccgtccaggccgacctgactttaatgttcgataactttgaggtggacttcgtgggggcagctgtcagctgtgatgccgcatttctgaatcttacaggatgctactcttgtaacgccggcgctcgagtttgcttgagcatcacgtccaccggtactggctcactcagtgcgcacaacaaggacgggagcctgcatattgtgctaccatctgaaaatggaacaaaagatcaatgccagatcctgcacttcaccgtacccgaggtggaagaggaatttatgtattcctgtgacggcgacgagagacctctcctggtcaaggggacacttattgccatcgatcccttcgacgataggcgcgaggcaggaggcgaatcaactgtggttaacccaaaaagtggtagctggaactttttcgactggttctccgggttgatgtcttggtttggaggccctctgaagaccatattactcatttgcctgtacgtggctctttcgatcggtctgttctttttgctcatttacctgggccggacggggctaagcaaaatgtggctggccgccaccaagaaggcttcatga

SEQ ID NO: 11272 - RNA, 3204 nt, synthetic construct
  misc_feature 1..3204: note = derived and/or modified CDS sequence (opt3) from RVFV(Kenya 9800523)__DQ380196.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgccttttgttcccacgctaacgggtcaggaattgtgcaaatccaggtcagcggcgtttggaaaaagccactttgcgtgggctacgaacgtgtagtggtcaaaagagagctgagtgccaagcccatacagagggtggaaccttgtacaacttgcatcaccaaatgtgagccacacgggttggttgtgcggtctacaggattcaagatttccagcgcagtcgcctgcgcttcgggtgtgtgtgtaaccggctctcaatccccctcaacggagatcactctcaagtatccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattaccaatgtcacacagctctgagtgccttcgtggttgtgtttgtattctccagcattgcaatcatctgcctcgccattctttatcgcgtcctgaagtgtttgaaaatagctcctagaaaggtgctaaaccccctgatgtggatcaccgcctttattaggtgggtttacaaaaagatggtggcacgggtcgcggataatatcaaccaggtgaatcgcgaaataggatggatggagggcgggcagctcgtactgggaaacccagctcccattcctcgacacgccccaatcccgagatattctacttaccttatgctgttgctcatcgtgtcatacgcaagtgcctgcagcgaactgattcaggcttcctctaggatcacaacctgttcgacggagggtgttaacaccaagtgccggttaagcggcacagccctgattcgtgcagggtccgtcggagctgaagcctgtctaatgctcaaaggcgtgaaggaggaccaaactaaattcctgaagataaaaaccgtgtcaagtgagctttcttgccgcgaaggtcagagctattggacagggtccttttcacccaagtgtttgagctctagaaggtgccatctggtcggcgagtgtcacgttaatcggtgcctctcctggcgagataacgaaacaagtgcggagttcagctttgtgggagaatctaccacaatgcgcgagaataaatgcttcgagcagtgtggcgggtggggatgcggttgttttaacgtgaatccttcctgcctgttcgtacatacctaccttcagtcagtcagaaaggaagccctgagggtgtttaactgtatcgactgggttcacaagttgactctcgagattacggacttcgatggcagtgtgagcacaatcgacctgggggcttcgtcctctcggtttaccaattggggaagcgtctcattaagtctggatgcagaaggcatctccggttctaacagcttctccttcattgagtcaccagggaaaggctatgccatagtggacgagccctttagcgaaatccctcgccaaggattcctaggcgagattagatgcaatagtgaatcttccgttctcaacgctcacgagagctgtctgagggccccaaatcttatctcgtacaagcccatgattgatcagttggaatgcactaccaacctgatcgacccgtttgtggtattcgagcgtgggtcactccctcagacacggaatgataaaacctttgcagcgtctaagggaaaccgaggcgtccaggccttcagtaaaggttccgtgcaagctgacctgactttaatgtttgataatttcgaggtggactttgtcggggccgcagttagctgtgatgctgccttcctgaaccttacaggatgctattcttgtaacgcaggcgccagagtgtgcttgagcataacgtccaccggtactggcacactctcagctcataataaggaagggagtctgcacatcgtactaccaagcgagaacggaaccaaggaccagtgccagattctgcattttacagtgcccgaagtcgaggaagagttcatgtactcttgtgatggcgacgagaggcctctcctggtgaaagggactcttatcgcgattgacccctttgatgaccgccgggaagccggaggcgagtccaccgttgtgaatccaaagtcaggtagttggaacttcttcgattggtttagcgggttgatgtcctggttcggaggccctctgaaaacgatcttactcatatgcctgtatgtcgcactttctattggtctgtttttcttgctcatctacctgggcagaaccgggctatcgaagatgtggctggctgccactaaaaaggccagctga

SEQ ID NO: 11273 - RNA, 3204 nt, synthetic construct
  misc_feature 1..3204: note = derived and/or modified CDS sequence (opt3) from RVFV(Entebbe)__DQ380191.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagattaaacgagaactgaagtcatttgatatcagtcagtgccctaaaattgggggacatggcagcaagaagtgcacgggtgacgccgcgttctgttctgcctacgagtgcactgcacagtatgctaatgcctactgttcccacgctaacgggtcaggaatcgtgcaaatacaggtcagcggcgtttggaaaaagccactttgcgtgggctatgaacgtgtagtggtcaaaagagagctgagtgccaagcccatccagagggtggaaccttgtaccacatgcattactaaatgtgagccacacgggttggttgtgcggtctaccggatttaagatctccagcgcagtcgcctgcgcttcgggtgtgtgtgtaacaggctctcaatccccctcaaccgagattacgctcaagtacccggggatcagtcagagctccggaggcgatataggtgttcatatggcgcacgacgatcagtctgtgagctcaaaaattgtcgcacattgccctccccaggacccatgtctggtgcacgggtgcatcgtctgcgcccatggcttaattaattatcaatgtcacactgctctgagtgccttcgtggttgtgttcgtattttccagcgtcgcaatcatctgcctcgccattctttacaaggtgctgaaatgtttgaagatagctcctcgcaaagttctaaaccccctgatgtggatcacagccttcattagatgggtgtataagaagatggtcgcaagggtggcggataatatcaaccaggtaaatcgggaaataggatggatggagggcgggcagctcgtgctgggaaacccagctcccattcctcgccacgccccaatcccgcgatactctacctaccttatgctgttgctcatcgtttcatatgcaagtgcctgcagcgaactgattcaggcttcctctagaatcactacatgttcgaccgagggtgtcaacacgaaatgcaggttaagcggcaccgccctgattcgggcagggtccgtgggagctgaagcctgtctaatgctcaagggcgtgaaagaggaccaaacaaagtttctgaaaataaagactgtctcaagtgagctttcttgccgtgaaggtcagagctactggaccgggtccttctcacccaaatgtttgagctctcgcagatgccatctggttggcgagtgtcacgtgaataggtgcctctcctggcgggataacgaaacaagtgcggagtttagcttcgtgggagaatctactaccatgcgagagaataagtgctttgagcagtgtggcgggtggggatgcggttgtttcaacgtaaatccttcctgcctgtttgtccatacatatcttcagtcagtgcgcaaggaagccctgagagttttcaactgtatcgactgggtgcacaaattgaccctcgagattactgactttgatggcagtgtcagcacggtggacctgggggcttcgtcctctaggttcacaaattggggaagcgtttcattaagtctggatgcagaaggcatctccggttctaacagcttttccttcatcgagtcaccagggaagggctacgccattgtggacgagcccttcagcgaaatacctcggcaaggatttctaggcgagatccgctgcaatagtgaatcttccgtactcagcgctcacgagtcgtgtctgagagccccaaaccttatttcatataaacccatgatcgatcagttggaatgcaccactaatctgattgacccgttcgtcgtgtttgagagggggtctctccctcagacccgtaacgataagacattcgcagcgagtaaaggaaatcggggcgtgcaggccttttccaagggtagcgtccaagctgacctgaccttaatgttcgataactttgaggttgacttcgtgggggccgcagtatcttgtgatgctgcctttctgaatcttactggatgctacagctgtaacgcaggcgcccgagtgtgcttgtccatcacatcaacgggtaccggcactctcagtgctcataacaaggacgggagcctgcacatagtcctaccatctgaaaatggaacaaaagatcagtgccagatcctgcatttcaccgtgcccgaggttgaagaggaatttatgtattcctgtgacggcgacgagagacctctcctggtgaaggggacacttattgcgatcgatcccttcgacgataggcgcgaggccggaggcgaatcaactgtcgtgaacccaaaaagtggtagctggaactttttcgactggttctccgggttgatgtcttggtttggaggccctctgaagaccattttactcatctgcctgtacgttgcactttcgataggtctgttctttttgctcatttacctgggccggacggggctaagcaaaatgtggctggctgccaccaagaaggcctcatga

SEQ ID NO: 11274 - RNA, 3204 nt, synthetic construct
  misc_feature 1..3204: note = derived and/or modified CDS sequence (opt3) from RVFV(25010-24)__KM210509.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttgattgttcggtctacaggatttaagatctccagcgcagtggcctgcgcttcgggtgtctgtgtgaccggctctcaatccccctcaacggagattactctcaagtacccggggatcagtcagagctccggaggcgatataggtgtacatatggcgcacgacgatcagtctgttagctcaaaaattgtggcacattgccctccccaggacccatgtctggtccacgggtgcatcgtgtgcgcccatggcttaattaattatcaatgtcacacagctctgagtgccttcgtcgtggttttcgtgttttccagcgtagcaatcatctgcctcgccattctttacaaggtcctgaaatgtttgaagatagctcctaaaaaggtgctaaaccccctgatgtggatcaccgccttcattcgctgggtttataagaaaatggtggcaagagtcgcggataatatcaaccaggtgaatagggaaataggatggatggagggcgggcagctcgctctgggaaacccagcccccattcctcggcacgcaccaatcccgcgctactctacttaccttatgctgttgctcatcgtatcatatgccagtgcttgcagcgaactgattcaggcctcctctcgaatcacaacctgttcgacggagggtgtgaacaccaagtgcagattaagcggcacagcactgattagggctgggtccgttggagccgaagcgtgtctaatgctcaaaggcgtcaaggacgatcaaactaaatttctgaagataaaaaccgtgtcaagtgagctttcttgccgggagggtcagagctactggacagggtccttctcacccaagtgtttgagctctcgtcgctgccatctggtgggcgaatgtcacgtcaatagatgcctctcctggagggacaacgagacttcagccgaatttagcttcgttggagagtctaccacaatgcgggaaaataagtgctttgagcagtgtggcgggtggggatgcggttgtttcaacgtgaatccttcctgcctgtttgtgcatacctatcttcagtcagtacgaaaagaggctctgcgcgtcttcaactgtatcgactgggtgcacaagttgactctcgaaattacggattttgacggcagtgttagcacaatcgatctgggggcatcgtcctctagattcaccaattggggaagcgtgtcattaagtctggacgccgagggcatctccggttctaacagcttttccttcattgaatcaccagggaaaggctacgctatagtcgatgagcccttcagcgagatccctaggcaaggatttctaggcgaaattcggtgcaatagtgagtcttccgtgctcagcgcccacgaatcgtgtctgcgcgcaccaaaccttatctcatataagcccatgattgaccagttggagtgcactaccaatctgatcgatccgttcgttgtgtttgaaagagggtctctccctcagacaaggaacgacaaaaccttcgcggccagtaagggaaatcgtggcgtacaggctttttccaagggtagcgtccaagccgatctgactttaatgttcgacaactttgaggtggatttcgtgggggcagctgtctcttgtgacgccgcatttctgaatcttacaggatgctacagctgtaacgccggcgctcgggtttgcttgtccataacgtcaaccggtactggcacactcagtgcgcataacaaagatgggagcctgcacatcgtgctaccatctgagaatggaaccaaggaccagtgccagattctgcatttcacagtacccgaagtggaggaagagtttatgtattcctgtgacggcgatgaacgacctctcctggtcaaagggactcttatcgccattgaccccttcgatgacagaagggaggcaggaggcgagtcaaccgtggttaacccaaagagtggtagctggaactttttcgattggttctccgggttgatgtcttggtttggaggccctctgaaaacgatcttactcatatgcctgtacgtggctctttcgattggtctgttctttttgctcatctacctgggccgcaccgggctaagcaagatgtggctggccgccacaaagaaagctagttga

SEQ ID NO: 11275 - RNA, 3204 nt, synthetic construct
  misc_feature 1..3204: note = derived and/or modified CDS sequence (opt3) from RVFV(763/70)__DQ380188.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatggtttgaccgaagattgcaacttttgtcgccagatgacaggggcttctctcaagaaaggatcgtacccactgcaagacctgttctgccagtcaagcgaggatgacggcagtaagctcaagaccaaaatgaagggcgtgtgtgaggtcggggtgcaggccttaaagaagtgcgatggacagctgtccactgcacatgaagtagttccgtttgctgtgttcaaaaattctaagaaagtctatcttgacaagttggacctgaagacagaggaaaacctactccccgatagctttgtgtgtttcgagcacaaaggtcaatacaagggcaccatggactccgggcagacgaaacgagagctgaagtcatttgatattagtcagtgccctaaaatcggaggccatggtagcaagaagtgcactggggacgccgcgttctgttctgcctacgaatgcaccgcacagtatgctaatgcctactgttcccacgctaacggatcaggcattgtgcaaatccaggtcagcggcgtttggaaaaagccactttgcgtggggtatgagcgtgtagtggtcaaaagagaactgagtgccaagcccatacagagggtggagccttgtacaacttgcatcaccaaatgtgaaccacacggattggttgtgcggtctacaggttttaagatttccagcgcagtcgcctgcgcttcgggcgtgtgtgtaaccgggtctcaatccccctcaacggagatcactctcaagtacccgggaattagtcagagctccggcggtgatatcggggttcatatggcgcacgacgatcagtctgtgagctcaaaaatagtcgcacattgccctccccaggacccatgtctggtgcacggctgcattgtctgcgcccatggattaatcaattatcaatgtcacacagctctgagtgccttcgtggttgtgttcgtattttccagcgtcgcaattatctgcctcgccatcctttacaaggtgctgaaatgtttgaagattgctcctcgcaaagttctaaaccccctgatgtggataaccgccttcatcagatgggtgtataagaagatggtcgcaagggtggcggataatattaaccaggtaaatcgggagatcggctggatggaagggggacagctcgctctgggtaacccagcccccatacctcgccacgcaccaattccgcgatactctacttaccttatgctgttgctcatcgtgtcatatgccagtgcttgcagcgagctgatccaggcctcctctagaattacaacctgttcgacggaaggcgttaacaccaaatgcaggttaagcgggacagcactgatccgggctggatccgtcggcgccgaggcgtgtctaatgctcaagggtgtgaaagaagaccaaactaagtttctgaaaattaagaccgtgtcaagtgagctttcttgccgtgaggggcagagctactggacaggctccttctcacccaaatgtttgagctctcgcagatgccatctggtcggagaatgtcacgttaataggtgcctctcctggcgggataacgagaccagtgccgaatttagcttcgtgggcgagtctactacaatgcgagaaaataagtgctttgagcagtgtgggggatggggttgcggctgtttcaacgtgaatccttcctgcctgtttgtacatacctatcttcagtcagtccgcaaggaggctctgagagtgttcaactgtatagactgggttcacaaattgactctcgaaatcacggactttgatgggagtgtgagcacaattgacctgggagcatcgtcctctaggttcaccaattggggcagcgtctcattaagtctggatgccgagggtatctccgggtctaacagcttttccttcatcgaatcaccaggcaagggatacgctattgtggacgagcccttcagcgagatacctcggcaaggctttctaggggaaatccgctgcaatagtgagtcttccgttctcagcgcccacgaatcgtgtctgagagcaccaaaccttatttcatataaacccatgatcgatcagttggagtgcactaccaatctgattgacccgttcgtggtatttgaaaggggatctctccctcagacacgtaacgataagaccttcgcggccagtaaaggcaatcggggtgtccaggctttttccaaggggagcgtgcaagccgacctgactttaatgttcgataactttgaggtggacttcgtcggagcagctgtttcttgtgatgccgcatttctgaatcttacaggctgctacagctgtaacgccggtgctcgagtgtgcttgtccatcacgtcaaccggcactgggacactcagtgcgcataacaaggacggaagcctgcacatagtactaccatctgagaatggcaccaaagatcagtgccagatcctgcatttcacagtgcccgaagtcgaggaagagtttatgtattcctgtgacggggacgaaagacctctcctggtgaagggaactcttattgccatcgatcccttcgacgataggcgcgaggcaggcggtgagtcaaccgttgtgaacccaaaaagtgggagctggaactttttcgactggttctccggattgatgtcttggtttggcggtcctctgaagacgattttactcatctgcctgtacgtcgctctttcgataggcctgttctttttgctcatttacctggggcggaccggactaagcaaaatgtggctggccgccacaaagaaggcttcatga

SEQ ID NO: 11276 - RNA, 3204 nt, synthetic construct
  misc_feature 1..3204: note = derived and/or modified CDS sequence (opt3) from RVFV(OS-1)__DQ380186.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggagtggtccaaattcaggttagcggcgtgtggaaaaagccactttgcgtaggctatgaacgtgtggtcgtgaaaagagagctgagtgccaagcccatccagagggttgaaccttgtacaacttgcataaccaaatgtgagccacacgggttggtggtccggtctacaggatttaagatctccagcgcagtggcctgcgcttcgggtgtatgtgttaccggctctcaatccccctcaacggagattactctcaagtacccggggatcagtcagagctccggaggcgatattggtgtgcatatggcgcacgacgatcagtctgtcagctcaaaaatcgtggcacattgccctccccaggacccatgtctggtccacgggtgcatagtgtgcgcccatggcttaattaattatcaatgtcacacagctctgagtgccttcgttgtggtattcgtcttttccagcgtggcaatcatttgcctcgccatcctttacaaggttctgaaatgtttgaagatcgctcctcgcaaagtgctaaaccccctgatgtggattaccgccttcataagatgggtctataagaagatggtggcaagggtagcggataatatcaaccaggtgaatcgggaaattggatggatggagggcgggcagctcgctctgggaaacccagcccccatccctcgccacgcaccaataccgcgatactctacttaccttatgctgttgctcattgtttcatatgccagtgcttgcagcgaactgatccaggcctcctctagaatcacaacctgttcgacggagggtgtcaacaccaaatgcaggttaagcggcacagcactgattcgggctgggtccgtgggagccgaagcgtgtctaatgctcaagggcgtgaaagaggaccaaactaagtttctgaaaatcaagaccgtctcaagtgagctttcttgccgtgaaggtcagagctactggacagggtccttctcacccaaatgtttgagctctcgcagatgccatctggttggcgagtgtcacgtgaataggtgcctctcctggcgggataacgaaacttcagccgagtttagcttcgtgggagaatctaccacaatgcgagagaataagtgctttgagcagtgtggcgggtggggatgcggttgtttcaacgtaaatccttcctgcctgtttgtccatacctatcttcagtcagtgcgcaaggaagctctgaaagttttcaactgtattgactgggtgcacaagttgactctcgagataacggactttgatggcagtgtcagcacaatcgacctgggggcatcgtcctctagattcaccaattggggaagcgtgtcattaagtctggatgccgaaggcatttccggttctaacagcttttccttcatcgagtcaccagggaaaggctacgctatcgttgacgagcccttcagcgaaattcctaggcaaggatttctaggcgagatacggtgcaatagtgaatcttccgtgctcagcgcccacgagtcgtgtctgcgcgcaccaaaccttatctcatataagcccatgattgatcagttggaatgcactaccaatctgatcgacccgttcgtagtctttgagagagggtctctccctcagacaaggaacgataaaaccttcgcggccagtaagggaaatcgtggcgtgcaggctttttccaagggtagcgtgcaagccgacctgactttaatgttcgataactttgaggtcgacttcgttggggcagctgtgtcttgtgatgccgcatttctgaatcttacaggatgctacagctgtaacgccggcgctcgggtatgcttgtccattacgtcaaccggtactggcacactcagtgcgcataacaaagacgggagcctgcacatcgtgctaccatctgaaaatggaaccaaggatcagtgccagatactgcatttcacagtccccgaggtggaagaggaatttatgtattcctgtgacggcgacgagcgacctctcctggttaaagggactcttatcgccattgatcccttcgacgatagaagggaggcaggaggcgaatcaaccgtggtcaacccaaagagtggtagctggaactttttcgactggttctccgggttgatgtcttggtttggaggccctctgaaaacgatcttactcatttgcctgtacgtggctctttcgatcggtctgttctttttgctcatatacctgggccgcaccgggctaagcaagatgtggctggccgccacaaagaaagctagttga

SEQ ID NO: 11277 - RNA, 3204 nt, synthetic construct
  misc_feature 1..3204: note = derived and/or modified CDS sequence (opt3) from RVFV(BIME-01)__KX609032.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattatcaatgtcacacagctctgagtgccttcgtggttgtgttcgtattttccagcgtcgcaattatctgcctcgccatcctttacaaggtgctgcgctgtttgaaaattgctcctaagaaagttctaaaccccctgatgtggataaccgccttcatcagatgggtgtataagaagatggtcgcaagggtggcggataatattaaccaggtaaatcgggaaatcggatggatggagggcgggcagctcgctctgggaaacccagcccccatacctcgccacgcaccaattccgcgatactctacttaccttatgctgttgctcatcatctcatatgccagtgcttgcagcgaactgattcaggcctcctctagaatcacaacctgttcgacggagggtgtgaacaccaaatgcaggttaagcggcacagcactgattcgggctgggtccgttggagccgaagcgtgtctaatgctcaagggcgtcaaagaggaccaaactaagtttctgaaaataaagaccgtgtcaagtgagctttcttgccgtgaaggtcagagctactggacagggtccttctcacccaaatgtttgagctctcgcagatgccatctggtgggcgagtgtcacgtcaataggtgcctctcctggcgggataacgaaaccagtgccgagtttagcttcgttggagaatctactacaatgcgagagaataagtgctttgagcagtgtggcgggtggggatgcggttgtttcaacgtgaatccttcctgcctgtttgtgcatacctatcttcagtcagtacgcaaggaagctctgagagtcttcaactgtatcgactgggtgcacaaattgactctcgagattacggactttgatggcagtgttagcacaatcgacctgggggcatcgtcctctaggttcaccaattggggaagcgtgtcattaagtctggatgccgaaggcatctccggttctaacagcttttccttcattgagtcaccagggaagggctacgctatagtcgacgagcccttcagcgaaatccctcggcaaggatttctaggcgagattcgctgcaatagtgaatcttccgtgctcagcgcccacgagtcgtgtctgagagcaccaaaccttatctcatataaacccatgattgatcagttggaatgcactaccaatctgatcgacccgttcgttgtgtttgagagggggtctctccctcagacacgtaacgataagaccttcgcggccagtaaaggaaatcggggcgtacaggctttttccaagggtagcgtccaagccgacctgactttaatgttcgataactttgaggtggacttcgtgggggcagctgtctcttgtgatgccgcatttctgaatcttacaggatgctacagctgtaacgccggcgctcgagtttgcttgtccataacgtcaaccggtactggcacactcagtgcgcataacaaggacgggagcctgcacatcgtgctaccatctgaaaatggaaccaaagatcagtgccagattctgcatttcacagtacccgaggtggaagaggaatttatgtattcctgtgacggcgacgagagacctctcctggtcaaggggactcttatcgccattgatcccttcgacgataggcgcgaggcaggaggcgaatcaaccgtggttaacccaaaaagtggtagctggaactttttcgactggttctccgggttgatgtcttggtttggaggccctctgaagacgatcttactcatatgcctgtacgtggctctttcgattggtctgttctttttgctcatctacctgggccggaccgggctaagcaaaatgtggctggccgccacaaagaaggcttcatga

SEQ ID NO: 11278 - RNA, 3204 nt, synthetic construct
  misc_feature 1..3204: note = derived and/or modified CDS sequence (opt3) from RVFV(73HB1449)__DQ380211.1__Gn-Gc
  source 1..3204: mol_type = other RNA
atggccggcatcgctatgacagtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaaaatccctccacggagatcactctcaagtacccggggatttcacagagtagcggaggcgatatcggtgttcatatggcgcacgacgatcagtccgtgtctagcaaaatagtcgcacattgccctccccaggacccatgtctggtgcacgggtgcattgtctgcgcccatggcttaatcaactatcaatgtcacacagctctgtcagccttcgtggttgtgttcgtatttagttccattgcaatcatctgcctcgccattctttaccgcgtcctgaagtgtttgaaaatagctcctagaaaggtgctaaatcccctgatgtggatcaccgccttcattaggtgggtttataaaaagatggtggcacgggtcgcggataacatcaatcaggtgaaccgcgaaataggatggatggagggcgggcagctcgtactgggaaacccagctcccattcctcgacacgccccaatcccgagatacagcacttaccttatgctgttgctcatcgtgtcttatgcatcagcctgcagtgaactgattcaggctagctccaggatcacaacctgttctacggagggtgttaataccaagtgccggttatcgggcacagccctgattcgtgcagggagcgtcggagctgaagcctgtctaatgctcaaaggcgtgaaggacgatcaaactaaatttctgaagataaaaaccgtgtcctcagagcttagttgccgcgagggtcagtcttactggacagggagcttctcccccaagtgtttgtcaagcagaaggtgccatctggtcggcgaatgtcacgttaaccggtgcctctcttggcgagacaatgagacttccgcggaatttagtttcgtgggagagagcaccacaatgcgcgaaaacaaatgctttgagcagtgtggcgggtggggatgcggttgtttcaatgtgaacccttcttgcctgtttgtacatacctatcttcagtccgtcagaaaggaggccctgagggtgttcaattgtatcgactgggttcacaagttgactctcgaaattacggattttgacggctcagtgagtacaatcgatctgggggctagctcgtcccggttcaccaactggggatctgtcagcttatcactggacgcagagggcatcagtggttccaattcttttagcttcattgaatccccagggaaaggctacgccatagtggatgagcccttctcagagatccctcgccaaggatttctaggcgaaattagatgcaacagcgagagttctgttctctccgctcacgaaagctgtctgagggccccaaatcttatctcgtataagcccatgattgaccagttggagtgcactaccaacctgatcgatccgttcgtggtatttgaacgtgggtcactccctcagacacggaatgagaaaaccttcgcagcgtctaagggaaaccgaggcgtccaggcctttagtaaaggttccgtgcaagctgacctgactttaatgttcgataattttgaggtggacttcgtcggggccgcagttagctgtgatgctgcctttctgaaccttacaggatgctactcttgtaacgcaggcgccagagtgtgcttgagcataacgtccaccggtactggcacactctcagctcataataaggacgggagtctgcacatcgtactaccaagcgaaaacggaaccaaggatcagtgccagattctgcatttcacagtgcccgaggtcgaagaggaatttatgtattcttgtgacggcgacgagaggcctctcctggtgaaagggactcttatcgcgattgatcccttcgacgatcgccgggaggccggaggcgaatccaccgttgtgaatccaaagtcaggtagttggaactttttcgactggttcagcgggttgatgtcctggtttggaggccctctgaaaacgatcttactcatatgcctgtacgtcgcactttctattggtctgttctttttgctcatctacctgggcagaaccgggctatcgaagatgtggctggctgccaccaaaaaggccagctga

SEQ ID NO: 11279 - RNA, 3204 nt, synthetic construct
  misc_feature 1..3204: note = derived and/or modified CDS sequence (opt3) from RVFV(SA01-1322)__KX096942.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgccttttgttcccacgctaacgggtcaggaattgtgcaaatccaggtcagcggcgtttggaaaaagccactttgcgtgggctacgaacgtgtagtggtcaaaagagagctgagtgccaagcccatacagagggtggaaccttgtacaacttgcatcaccaaatgtgagccacacgggttggttgtgcggtctacaggattcaagatttccagcgcagtcgcctgcgcttcgggtgtgtgtgtaaccggctctcaatccccctcaacggagatcactctcaagtatccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattaccaatgtcacacagctctgagtgccttcgtggttgtgtttgtattctccagcattgcaatcatctgcctcgccattctttatcgcgtcctgaagtgtttgaaaatagctcctagaaaggtgctaaaccccctgatgtggatcaccgcctttattaggtgggtttacaaaaagatggtggcacgggtcgcggataatatcaaccaggtgaatcgcgaaataggatggatggagggcgggcagctcgtactgggagacccagctcccattcctcgacacgccccaatcccgagatattctacttaccttatgctgttgctcatcatttcatacgcaagtgcctgcagcgaactgatccaggcttcctctaggattacaacctgttcgacggagggtgtgaacaccaagtgccggttaagcggcacagccctgatacgtgcagggtccgttggagctgaagcctgtctaatgctcaaaggcgtcaaggaggatcaaactaaattcctgaagatcaaaaccgtgtcaagtgagctttcttgccgcgaaggtcagagctattggacagggtccttttcacccaagtgtttgagctctagaaggtgccatctggtgggcgagtgtcacgtcaaccggtgcctctcctggcgagacaatgaaacaagtgcggagttcagctttgttggagaatctaccacaatgcgcgagaacaaatgcttcgagcagtgtggcgggtggggatgcggttgttttaatgtgaacccttcctgcctgttcgtgcatacctaccttcagtcagtaagaaaggaagccctgagggtctttaattgtattgactgggtgcacaagttgactctcgagatcacggatttcgacggcagtgttagcacaatcgatctgggggcttcgtcctctcggtttaccaactggggaagcgtgtcattaagtctggacgcagaaggcatttccggttctaatagcttctccttcatagagtcaccagggaaaggctatgccatcgtcgatgagccctttagcgaaattcctcgccaaggattcctaggcgagatcagatgcaacagtgaatcttccgtgctcagcgctcacgagtcgtgtctgagggccccaaatcttatttcatacaagcccatgatcgaccagttggaatgcactaccaacctgatagatccgtttgttgtgttcgagcgtgggtctctccctcagacacggaatgagaaaacctttgcagcgagtaagggaaaccgaggcgtacaggccttctccaaaggtagcgtccaagctgacctgactttaatgtttgataatttcgaagtggactttgtgggggccgcagtctcttgtgatgctgccttcctgaaccttacaggatgctatagctgtaatgcaggcgccagagtttgcttgtccatcacgtcaaccggtactggcacactcagtgctcataacaaggacgggagcctgcacattgtgctaccatctgagaacggaaccaaggatcagtgccagatcctgcattttacagtacccgaagtggaggaagagttcatgtactcctgtgacggcgacgagaggcctctcctggtcaaagggactcttattgcgatcgatccctttgacgatcgccgggaagccggaggcgagtcaaccgtggttaatccaaagagtggtagctggaacttcttcgactggttttccgggttgatgtcttggttcggaggccctctgaaaacgatattactcatttgcctgtatgtggcactttcgatcggtctgtttttcttgctcatttacctgggcagaaccgggctaagcaagatgtggctggctgccactaaaaaggcctcatga

SEQ ID NO: 11280 - RNA, 3204 nt, synthetic construct
  misc_feature 1..3204: note = derived and/or modified CDS sequence (opt3) from RVFV(Sudan 2V-2007)__JQ820490.1__Gn-Gc
  source 1..3204: mol_type = other RNA
atggccggcatcgctatgacagtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatagtcgcacattgccctccccaggacccatgtagtgtgcacgggtgcattgtctgcgcccatggcctgatcaattatcaatgtcacacagctttatccgccttcgtggttgtgttcgtatttagctctattgcaatcatctgcctggccattctctaccgcgtccttaagtgtctgaaaatagctcctagaaaggtgttgaaccccctaatgtggatcaccgccttcattaggtgggtttataaaaagatggtggcacgggtcgcggataatatcaaccaggtgaatcgcgaaataggatggatggagggcgggcagctggtactcggaaacccagctcccattcctcgacacgccccaatcccgagatactcaacttacctgatgcttctgttgatcgtgagtcatgcaagcgcctgctccgaactcattcaggcttcttcgaggatcacaacctgtagcacggagggtgttaacaccaagtgccggctgtccggcacagccttaattcgtgcagggtcagtcggagctgaagcctgtctgatgctaaaaggcgtgaaggaggaccaaactaaatttctcaagataaaaaccgtgagttctgagctgagctgccgcgaaggtcagtcctattggacagggtcattcagccccaagtgtctttcttccagaaggtgccacttggtcggcgagtgtcatgttaatcggtgcctgagttggcgagataacgaaactagcgcggagttttctttcgtgggagaatccaccacaatgcgcgagaataaatgctttgagcagtgtggcgggtggggatgcggttgtttcaacgtgaatccttcatgcctctttgtacacacctacctgcagagtgtcagaaaggaagcccttagggtgttcaactgtatcgactgggttcacaagctgactttggagattacggactttgatggcagcgtgtcgacaatcgacctcggggcttcctctagccggttcaccaattggggatcagtcagtctgtccttagatgcagaaggcatctctggtagcaactccttttcattcattgagagcccagggaaaggctatgccatagtggacgagcccttcagtgaaatccctcgccaaggatttctgggcgagattagatgcaattctgaatccagcgttctatcggctcatgagtcatgtctcagggccccaaacctgatctcttacaagcccatgattgatcagcttgaatgcactaccaatttgatcgacccgttcgtggtatttgagcgtgggagtctgcctcagacacggaacgataaaaccttcgcagcgtccaagggaaatcgaggcgtccaggcctttagcaaaggttctgtgcaagctgacctcactctgatgttcgataactttgaggtggacttcgtcggggccgcagttagctgtgatgctgcctttttaaatctgacaggatgctattcctgtaacgcaggcgccagagtgtgcctttcaataacgagtaccggtactggcacattgagcgctcacaacaaggacgggtctctccatatcgtactgccatccgaaaatggaaccaaggatcagtgccagattctacacttcacagtgcccgaggtcgaagaggaatttatgtactcatgtgacggcgacgagaggcctctgctcgtgaaagggactctgatggcgatcgatcccttcgacgatcgccgggaggccggaggcgaaagtaccgttgtgaacccaaagagcggttcctggaactttttcgactggttctctgggcttatgtcgtggtttggaggccctttgaaaacgattctgttaatctgcctctatgtcgcactgagcataggtcttttctttctgttgatttacctcggcagaaccgggctgtcaaagatgtggctagctgccaccaaaaaggcctcctga

SEQ ID NO: 11281 - RNA, 3204 nt, synthetic construct
  misc_feature 1..3204: note = derived and/or modified CDS sequence (opt3) from RVFV(35/74)__JF784387.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggagtggtccaaattcaggttagcggcgtgtggaaaaagccactttgcgtaggctatgaacgtgtggtcgtgaaaagagagctgagtgccaagcccatccagagggttgaaccttgtacaacttgcataaccaaatgtgagccacacgggttggtggtccggtctacaggatttaagatctccagcgcagtggcctgcgcttcgggtgtatgtgttaccggctctcaatccccctcaacggagattactctcaagtacccggggatcagtcagagctccggaggcgatattggtgtgcatatggcgcacgacgatcagtctgtcagctcaaaaatcgtggcacattgccctccccaggacccatgtctggtccacgggtgcatagtgtgcgcccatggcttaattaattatcaatgtcacacagctctgagtgccttcgttgtggtattcgtcttttccagcgtggcaatcatttgcctcgccatcctttacaaggttctgaaatgtttgaagatcgctcctcgcaaagtgctagatcccctgatgtggattaccgtcttcataagatgggtgtataagaagatggtagccagggtggcagacaacatcaatcaggttaaccgggaaattggatggatggagggcgggcagctcgcgctgggaaatccagctcccatccctcgccacgccccaataccgcgatactctacttaccttatgctgttgctcattgtctcatatgcaagtgcctgcagcgaactgatccaggcttcctctagaatcacaacctgttcgacggagggtgtgaacaccaaatgcaggttaagcggcacagccctgattcgggcagggtccgtgggagctgaagcctgtctaatgctcaagggcgtcaaagaggatcaaactaagtttctgaaaatcaagaccgtttcaagtgagctttcttgccgtgaaggtcagagctactggacagggtccttctcacccaaatgtttgagctctcgcagatgccatctggtgggcgagtgtcacgtgaacaggtgcctctcctggcgggacaatgaaaccagtgcggagtttagcttcgtaggagaatctactacaatgcgagagaacaagtgctttgagcagtgtggcgggtggggatgcggttgtttcaatgtcaacccttcctgcctgtttgtgcatacctatcttcagtcagttcgcaaggaagccctgagagtgttcaattgtattgactgggtccacaaattgactctcgagataacggattttgacggcagtgtgagcacaatcgatctgggggcttcgtcctctaggttcaccaactggggaagcgtttcattaagtctggacgcagaaggcatttccggttctaatagcttttccttcatcgagtcaccagggaagggctacgccatcgtggatgagcccttcagcgaaattcctcggcaaggatttctaggcgagatacgctgcaacagtgaatcttccgtactcagcgctcacgagtcgtgtctgagagccccaaatcttatctcatataaacccatgattgaccagttggaatgcactaccaacctgatcgatccgttcgtcgtgtttgagagggggtctctccctcagacacgtaatgacaagaccttcgcagcgagtaaaggaaaccggggcgtgcaggccttttccaagggtagcgtccaagctgatctgactttaatgttcgacaattttgaggttgatttcgtgggggccgcagtatcttgtgacgctgcctttctgaaccttacaggatgctacagctgtaatgcaggcgcccgagtgtgcttgtccattacgtcaaccggtactggcacactcagtgctcataacaaggatgggagcctgcacatcgtcctaccatctgaaaacggaaccaaagaccagtgccagatactgcatttcacagtgcccgaggttgaagaggaatttatgtattcctgtgacggcgatgagagacctctcctggtgaaggggactcttatcgcgattgaccccttcgatgacaggcgcgaggccggaggcgaatcaaccgtcgtgaatccaaaaagtggtagctggaactttttcgattggttctccgggttgatgtcttggtttggaggccctctgaagacgatcttactcatttgcctgtacgttgcactttcgatcggtctgttctttttgctcatatacctgggccggaccgggctaagcaaaatgtggctggctgccacaaagaaggcctcatga

SEQ ID NO: 11282 - RNA, 3204 nt, synthetic construct
  misc_feature 1..3204: note = derived and/or modified CDS sequence (opt3) from RVFV(200803169)__JF311384.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattatcaatgtcacacagctctgagtgccttcgtggttattttcgtgttttccagcaccgcaatcatctgcctcgccgtactttaccgcgtcctgaagtgtttgaaaattgctcctagaaaggtgctaaaccccctgatgtggataactgccttcatcaggtgggtttataaaaagatggtggcacgggtcgcggataatattaaccaggtgaatcgcgaaatcggatggatggagggcgggcagctcgctctgggaaacccagcccccatacctcgacacgcaccaattccgagatactctacataccttatgctgttgctcatcgtatcatatgccagtgcttgcagcgaactgatccaggcctcctctaggattaccacgtgttcgaccgagggtgtgaacacaaagtgccggttaagcggcactgcactgatccgtgctgggtccgttggagccgaagcgtgtctaatgctcaaaggcgtcaaggtggaccaaaccaaatttctgaagattaaaacagtgtcaagtgagctttcttgccgcgagggtcagagctactggactgggtccttctcacccaagtgtttgagctctagaaggtgccatctggtcggcgaatgtcacgttaatcggtgcctctcctggcgagataacgagaccagtgccgaatttagcttcgtgggagagtctacaaccatgcgcgaaaataaatgctttgagcagtgtggcgggtggggatgcggttgtttcaacgtgaatccttcctgcctgtttgtacatacttatcttcagtcagtcagaaaggaggctctgagggtgttcaactgtatagactgggttcacaagttgacgctcgaaatcacagactttgatggcagtgtgagcaccattgacctgggggcatcgtcctctcggttcactaattggggaagcgtctcattaagtctggatgccgagggcatctccggttctaacagcttttccttcatcgaatcaccagggaaaggctacgctattgtggacgagcccttcagcgagatacctcgccaaggatttctaggcgaagttagatgcaatagtgagtcttccgtgctcagcgcccacgaatcgtgtctgagggcaccaaaccttgtatcatataagcccatgatcgatcagttggagtgcaccacaaatctgattgacccgttcgtcgtgtttgaacgtgggtctctccctcagacccggaacgataaaactttcgcggccagtaagggaaatcgaggcgtgcaggctttttccaaaggtagcgtccaagccgacctgacattaatgttcgataactttgaggttgacttcgtgggggcagctgtatcttgtgatgccgcatttctgaatcttacgggatgctacagctgtaacgccggcgctagagtgtgcttgtccatcacctcaactggtacaggcaccctcagtgcgcataacaaggacgggagcctgcacattgtcctaccatctgagaatggaacaaaggatcagtgccagatcctgcatttcactgtgcccgaagttgaggaagagtttatgtattcctgtgacggcgacgaaaggcctctcctggtgaaagggacccttatagccatcgatcccttcgacgatcgccgggaggcaggaggcgagtcaacggtcgtgaacccaaagagtggtagctggaactttttcgactggttctccgggttgatgtcttggtttggaggccctctgaaaaccattttactcatctgcctgtacgttgctctttcgattggtctgttctttttgctcatctacctgggcagaacagggctaagcaagatgtggctggccgccactaaaaaggcttcatga

SEQ ID NO: 11283 - RNA, 3204 nt, synthetic construct
  misc_feature 1..3204: note = derived and/or modified CDS sequence (opt3) from RVFV(2269/74)__DQ380222.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaacataagggtaccatggactccggccagacgaaacgagaactgaagtcatttgatattagtcagtgccctaaaatcgggggacacggcagcaagaagtgcactggtgacgccgcgttctgttctgcctacgagtgcaccgcacagtacgctaatgcctattgttcccacgctaacgggtcaggaattgtgcaaatccaggtcagcggcgtttggaaaaagccactttgcgtgggctacgaacgtgtagtggtcaaaagagagctgagtgccaagcccatacagagggtggaaccttgtacaacttgcatcaccaaatgtgagccacatgggttggttgtgcggtctacaggatttaagatttccagcgcagtcgcctgcgcttcgggtgtgtgtgtaaccggctctcaatccccctcaacggagatcactctcaagtatccggggattagtcagagctccggaggcgatatcggtgttcacatggcgcatgacgatcagtctgtgagctcaaaaatagtcgcacactgccctccccaggacccatgtctggtgcatgggtgcattgtctgcgcccacggcttaatcaattaccaatgtcacacagctctgagtgccttcgtggttgtgttcgtattttccagcgtcgcaattatctgcctcgccatcctttataaggtgctgaaatgtttgaagattgctcctaaaaaggttctaaaccccctgatgtggataaccgccttcatccgctgggtgtacaagaaaatggtcgcaagagtggcggataatattaaccaggtaaatagggaaatcggatggatggagggcgggcagctcgctctgggaaacccagcccccatacctcggcatgcaccaattccgcgctattctacttaccttatgctgttgctcatcgtgtcatacgccagtgcttgcagcgaactgatccaggcctcctctcgaattacaacctgttcgacggagggtgttaacaccaagtgcagattaagcggcacagcactgatcagggctgggtccgtcggagccgaagcgtgtctaatgctcaaaggcgtgaaggaggaccaaactaaatttctgaagattaaaaccgtgtcaagtgagctttcttgccgggaaggtcagagctattggacagggtccttctcacccaagtgtttgagctctcgtcgctgccacctggtcggcgagtgtcatgttaatagatgcctctcctggagggataacgaaacttcagccgagtttagcttcgtgggagaatctaccacaatgcgggagaataagtgctttgagcagtgtggcgggtggggatgcggttgtttcaacgtgaatccttcctgcctgtttgtacacacctaccttcagtcagtccgaaaagaagctctgcgcgtgttcaactgtatagactgggttcacaagttgactctcgagatcacggactttgatggcagtgtgagcacaattgacctgggggcatcgtcctctagattcaccaattggggaagcgtctcattaagtctggatgccgaaggcatctccggttctaacagcttttccttcatcgagtcaccagggaaaggctatgctattgtggacgagcccttcagcgaaatacctaggcaaggatttctaggcgagatccggtgcaatagtgaatcttccgttctcagcgcccatgagtcgtgtctgcgcgcaccaaaccttatttcatacaagcccatgatcgatcagttggaatgcactaccaatctgattgacccgttcgtggtatttgagagagggtctctccctcagacaaggaacgataaaaccttcgcggccagtaagggaaatcgtggcgtccaggctttttccaagggtagcgtgcaagccgacctgactttaatgttcgataactttgaggtggacttcgtcggggcagctgtttcttgtgatgccgcatttctgaatcttacaggatgctatagctgtaacgccggcgctcgggtgtgcttgtccatcacgtcaaccggtactggcacactcagtgcgcacaacaaagacgggagcctgcatatagtactaccatctgaaaatggaaccaaggatcagtgccagatcctgcacttcacagtgcccgaggtcgaagaggaatttatgtactcctgtgacggcgacgagcgacctctcctggtgaaagggactcttattgccatcgatcccttcgacgatagaagggaggcaggaggcgaatcaaccgttgtgaacccaaagagtggtagctggaactttttcgactggttctccgggttgatgtcttggtttggaggccctctgaaaacgattttactcatctgcctgtatgtcgctctttcgataggtctgttctttttgctcatttacctgggccgcaccgggctaagcaagatgtggctggccgccacaaagaaagctagttga

SEQ ID NO: 11284 - RNA, 3204 nt, synthetic construct
  misc_feature 1..3204: note = derived and/or modified CDS sequence (opt3) from RVFV(SA-51 (Van Wyck))__DQ380195.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacgtggcagcaagaagtgcactggtgacgccgcgttctgttctgcctacgagtgcaccgcacagtatgctaatgcctactgttcccatgctaacgggtcaggaattgtgcaaatccaggtcagcggcgtttggaaaaagccactttgcgtgggctatgaaagagtagtggtcaaaagggagctgagtgccaagcccatacagcgggtggaaccttgtacaacttgcatcaccaaatgtgagccacacgggttggttgtgcgctctacaggatttaagatttccagcgcagtcgcctgcgcttcgggtgtgtgtgtaaccggctctcaatccccctcaacggagatcactctcaagtacccggggattagtcagagctccggaggcgatatcggtgttcacatggcgcatgacgatcagtctgtgagctcaaaaatagtcgcacactgccctccccaggacccatgtctggtgcatgggtgcattgtctgcgcccacggcttaatcaattatcaatgtcatacagctctgagtgccttcgtggttgtgttcgtattttccagcgtcgcaattatctgcctcgccatcctttacaaggtgctgaaatgtttgaagattgctcctagaaaagttctaaaccccctgatgtggataaccgccttcatcaggtgggtgtataagaagatggtcgcacgggtggcggataatattaaccaggtaaatcgcgaaatcggatggatggagggcgggcagctcgctctgggaaacccagcccccatacctcgacacgcaccaattccgagatactctacttaccttatgctgttgctcatcgtgtcatatgccagtgcttgcagcgaactgatccaggcctcctctaggattacaacctgttcgacggagggtgttaacaccaaatgccggttaagcggcacagcactgatccgtgctgggtccgtcggagccgaagcgtgtctaatgctcaagggcgtgaaagaggaccaaactaagtttctgaaaattaagaccgtgtcaagtgagctttcttgccgcgaaggtcagagctactggacagggtccttctcacccaaatgtttgagctctagaaggtgccacctggtcggcgagtgtcatgttaatcggtgcctctcctggcgagataacgaaaccagtgccgagtttagcttcgtgggagaatctactacaatgcgcgagaataagtgctttgagcagtgtggcgggtggggatgcggttgtttcaacgtgaatccttcctgcctgtttgtacacacctatcttcagtcagtcagaaaggaagctctgagggtgttcaactgtatagactgggttcataaattgactctcgaggtgacggactttgatggcagtgtcagcacaatcgacctgggggcatcgtcctctcggttcaccaattggggaagcgtgtcattaagtctggatgccgaaggcatttccggttctaacagcttttccttcatcgagtcaccagggaagggctacgctatcgttgacgagcccttcagcgaaattcctcgccaaggatttctaggcgagataagatgcaatagtgaatcttccgtgctcagcgcccacgagtcgtgtctgagggcaccaaaccttatctcatataaacccatgattgatcagttggaatgcactaccaatctgatcgacccgttcgtagtctttgagcgtgggtctctccctcagacacggaacgataagaccttcgcggccagtaaaggaaatcgaggcgtgcaggctttttccaagggtagcgtgcaagccgacctgactttaatgttcgataactttgaggtcgacttcgttggggcagctgtgtcttgtgatgccgcatttctgaatcttacaggatgctacagctgtaacgccggcgctagagtatgcttgtccattacgtcaaccggtactggcacactcagtgcgcacaacaaggacgggagcctgcatatcgtgctaccatctgaaaatggaaccaaagatcagtgccagatactgcacttcacagtccccgaggtggaagaggaatttatgtattcctgtgacggcgacgagaggcctctcctggttaaggggactcttatcgccattgatcccttcgacgatcgccgggaggcaggaggcgaatcaaccgtggtcaacccaaaaagtggtagctggaactttttcgactggttctccgggttgatgtcttggtttggaggccctctgaagacgatcttactcatttgcctgtacgtggctctttcgatcggtctgttctttttgctcatatacctgggcagaaccgggctaagcaaaatgtggctggccgccacaaagaaggcttcatga

SEQ ID NO: 11285 - RNA, 3204 nt, synthetic construct
  misc_feature 1..3204: note = derived and/or modified CDS sequence (opt3) from RVFV(OS-8)__DQ380185.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggagtggtccaaattcaggttagcggcgtgtggaaaaagccactttgcgtaggctatgaacgtgtggtcgtgaaaagagagctgagtgccaagcccatccagagggttgaaccttgtacaacttgcataaccaaatgtgagccacacgggttggtggtccggtctacaggatttaagatctccagcgcagtggcctgcgcttcgggtgtatgtgttaccggctctcaatccccctcaacggagattactctcaagtacccggggatcagtcagagctccggaggcgatattggtgtgcatatggcgcacgacgatcagtctgtcagctcaaaaatcgtggcacattgccctccccaggacccatgtctggtccacgggtgcatagtgtgcgcccatggcttaattaattatcaatgtcacacagctctgagtgccttcgttgtggtattcgtcttttccagcgtggcaatcatttgcctcgccatcctttacaaggttctgaaatgtttgaagatcgctcctcgcaaagtgctaaaccccctgatgtggattaccgccttcataagatgggtctataagaagatggtggcaagggtagcggataatatcaaccaggtgaatcgggaaattggatggatggagggcgggcagctcgctctgggaaacccagcccccatccctcgccacgcaccaataccgcgatactctacttaccttatgctgttgctcattgtttcatatgccagtgcttgcagcgaactgatccaggcctcctctagaatcacaacctgttcgacggagggtgtcaacaccaaatgcaggttaagcggcacagcactgattcgggctgggtccgtgggagccgaagcgtgtctaatgctcaagggcgtgaaagaggaccaaactaagtttctgcgtatcaaaaccgtctcaagtgagctttcttgccgcgaaggtcagagctactggacagggtccttctcacccaagtgtttgagctctagaaggtgccatctggttggcgagtgtcacgtgaatcggtgcctctcctggcgagataacgaaaccagtgccgagtttagcttcgtgggagaatctactacaatgcgcgagaataaatgctttgagcagtgtggcgggtggggatgcggttgtttcaacgtaaatccttcctgcctgtttgtccatacctatcttcagtcagtgagaaaggaagctctgagggttttcaactgtattgactgggtgcacaagttgactctcgagataacggactttgatggcagtgtcagcacaatcgacctgggggcatcgtcctctcggttcaccaattggggaagcgtgtcattaagtctggatgccgaaggcatttccggttctaacagcttttccttcatcgagtcaccagggaaaggctacgctatcgttgacgagcccttcagcgaaattcctcgccaaggatttctaggcgagataagatgcaatagtgaatcttccgtgctcagcgcccacgagtcgtgtctgagggcaccaaaccttatctcatataagcccatgattgatcagttggaatgcactaccaatctgatcgacccgttcgtagtctttgagcgtgggtctctccctcagacacggaacgataaaaccttcgcggccagtaagggaaatcgaggcgtgcaggctttttccaaaggtagcgtgcaagccgacctgactttaatgttcgataactttgaggtcgacttcgttggggcagctgtgtcttgtgatgccgcatttctgaatcttagcggatgctactcctgtaacgccggcgctagagtatgcttgtcaattacaagtacgggtaccggcactctcagcgcgcataacaaggacgggtctctgcacatcgtgctaccatccgaaaatggaacaaaggatcagtgccagatactgcatttcaccgtccccgaggtggaagaggaatttatgtattcatgtgacggcgacgagaggcctctcctggttaaagggacacttatcgccattgatcccttcgacgatcgccgggaggcaggaggcgaaagtactgtggtcaacccaaagagcggttcctggaactttttcgactggttctctgggttgatgtcgtggtttggaggccctctgaaaaccatcttactcatttgcctgtacgtggctcttagcatcggtctgttctttttgctcatatacctgggcagaacggggctatcaaagatgtggctggccgccaccaaaaaggcttcctga

SEQ ID NO: 11286 - RNA, 3204 nt, synthetic construct
  misc_feature 1..3204: note = derived and/or modified CDS sequence (opt3) from RVFV(KEN07-KUR340)__EF460404.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccctgaaaaagtgcgatgggcagttatccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattatcaatgtcacacagctctgagtgccttcgtggttattttcgtgttttccagcaccgcaatcatctgcctcgccgtactttaccgcatgctgaagtgtttgaaaattgctcctagaatagtcctaaaccccctgatgtggatcactgccttcattaggtgggtgtataagaaaatggttgcacgggtggcggataatatcaaccaggtcaatcgcgaaataggatggatggagggcgggcagctcgctctgggaaacccagcccccattcctcgacacgcaccaatcccgagatactctacataccttatgctgttgctcatcgtgtcatatgccagtgcttgcagcgaactgattcaggcctcctctaggatcaccacgtgttcgaccgagggtgtaaacacaaagtgccggttaagcggcactgcactgattcgtgctgggtccgtgggagccgaagcgtgtctaatgctcaagggcgttaaagaggaccaaaccaagtttctgaaaataaagacagtctcaagtgagctttcttgccgcgaaggtcagagctactggactgggtccttctcacccaaatgtttgagctctagaaggtgccatctggtgggcgagtgtcacgtgaatcggtgcctctcctggcgagataacgaaaccagtgccgagtttagcttcgtcggagaatctacaaccatgcgcgagaataagtgctttgagcagtgtggcgggtggggatgcggttgtttcaacgttaatccttcctgcctgtttgtgcatacttatcttcagtcagtgagaaaagaagctctgagggtattcaactgtatcgactgggtccacaagttgacgctcgagattacagactttgatggcagtgtgagcaccatcgacctgggggcatcgtcctctcggttcactaattggggaagcgtttcattaagtctggatgccgaaggcatctccggttctaacagcttttccttcattgagtcaccagggaagggctacgctatagtggacgagcccttcagcgaaatccctcgccaaggatttctaggcgagattagatgcaatagtgaatcttccgtcctcagcgcccacgagtcgtgtctgagggcaccaaaccttgtgtcatataaacccatgatcgatcagttggaatgcaccacaaatctgattgacccgttcgttgtgtttgagcgtgggtctctccctcagacccggaacgataagactttcgcggccagtaaaggaaatcgaggcgtacaggctttttccaagggtagcgtccaagccgacctgacattaatgttcgataactttgaggtggacttcgtgggggcagctgtctcttgtgatgccgcatttctgaatcttacgggatgctacagctgtaacgccggcgctagagtttgcttgtccatcacctcaactggtacaggcaccctcagtgcgcataacaaagacgggagcctgcacatagtgctaccatctgaaaatggaacaaaggatcagtgccagatcctgcatttcactgtacccgaggtggaagaggaatttatgtattcctgtgacggcgacgagaggcctctcctggtcaaggggacccttattgccatcgatcccttcgacgatcgccgggaggcaggaggcgaatcaacggtggttaacccaaaaagtggtagctggaactttttcgactggttctccgggttgatgtcttggtttggaggccctctgaagaccattttactcatctgcctgtacgtggctctttcgataggtctgttctttttgctcatttacctgggcagaacagggctaagcaaaatgtggctggccgccactaagaaggcttcatga

SEQ ID NO: 11287 - RNA, 3204 nt, synthetic construct
  misc_feature 1..3204: note = derived and/or modified CDS sequence (opt3) from RVFV(ANK-3837)__DQ380215.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaaactggactccggccagaccaagcgagaacttaaatcatttgatattagtcagtgccctaagatcgggggacatggcagcaagaaatgcacgggtgacgccgcgttctgttctgcctacgagtgcactgcacagtatgctaatgcctactgttcccacgctaacgggtcaggaattgtgcaaatccaggtcagcggcgtttggaagaaaccactgtgcgtgggctatgaacgtgtagtggtcaagagagagttgagtgccaaacccatacagagggtggaaccttgtaccacatgcatcactaagtgtgagccacacgggctcgttgtgcggtctaccggatttaagatttccagcgcagtcgcctgcgcttcgggtgtgtgtgtaacaggctctcaatccccctcaaccgagatcacgctgaaatacccggggattagtcagagctccggaggcgatatcggtgttcatatggcgcacgacgatcagtctgtgagctcaaagatagtcgcacattgccctccccaggacccatgtttagtgcacgggtgcattgtctgcgcccatggcctgatcaattatcaatgtcacactgctctcagtgccttcgtggttgtgttcgtattttccagcattgcaatcatctgccttgccattctgtaccgcgtcttgaaatgtctaaagatagctcctagaaaagtgctgaaccccctcatgtggatcacagccttcattaggtgggtttatcggaagatggtggcacgcgtcgcggataatatcaaccaggtgaatcgagaaataggatggatggagggcgggcagctggtacttggaaacccagctcccattcctagacacgtgccaatcccgaggtactctacctacctgatgttgctcctgatcgtttcatatgccagtgcatgcagcgaattaattcaggcctcctctcggatcactacatgttcgaccgagggtgtcaacacgaagtgccgtctgagcggcaccgctctaattcgcgccgggtccgtgggagcagaggcttgtctcatgctgaaaggcgtgaaggaagaccaaacaaaatttcttaagataaaaactgtctcaagtgagttgtcttgcagagaaggtcagagctactggaccgggtccttctcacccaagtgtctgagctctaggcggtgccatctcgttggcgagtgtcacgtgaatcgatgcctgtcctggcgcgataacgaaacaagtgccgagtttagcttcgtgggagaatctactaccatgagagagaataaatgctttgagcagtgtggcgggtggggatgcggttgtttcaacgtaaatccttcctgcctttttgtccatacatatctgcagtcagtgaggaaggaagcgttgcgggttttcaactgtatcgactgggtgcacaagctcaccctggagattactgactttgatggcagtgtcagcacgatcgacttaggggcctcgtcctctcgcttcacaaattggggaagcgtgtcactgagtctagatgctgaaggcatctccggttctaacagcttttccttcattgagtcaccagggaaaggctacgcaatagttgacgagcccttcagcgaaatccctagacaaggatttctcggcgagattaggtgcaatagtgaatcttccgtgctgagcgcccacgagtcgtgtcttcgtgctccaaacttgatctcatataagcccatgattgatcagctggaatgcaccactaatctcatcgacccgttcgtagtctttgagcgggggtctctgcctcagacccgaaacgataaaacattcgccgcaagtaagggaaatagaggcgtgcaggcgttttccaaaggtagcgtgcaagccgacttaaccctgatgttcgataactttgaggtcgacttcgttggggctgccgtgtcttgtgatgcagcttttcttaatttgactggatgctacagctgtaacgccggcgcaagggtatgcctctccataacatcaacgggtaccggcactctgagtgcccataacaaggacgggagcctacacatcgtgctgccatctgaaaatggaacaaaggatcagtgccagattctccatttcaccgtccccgaggtggaagaggaatttatgtattcctgtgacggcgacgagcgccctctgcttgttcgggggacattgatcgctattgatcccttcgacgatagaagggaggcgggaggcgaatcaactgtggtcaacccaaaaagtggtagctggaactttttcgactggttctccgggctgatgtcttggtttggaggccctttaaagaccatcctcctgatatgcctttacgtggccctgtcgattggtttgttctttctcctgatctacctaggccgcacggggctgagcaaaatgtggctcgcagctaccaagaaagcctcatga

SEQ ID NO: 11288 - RNA, 3204 nt, synthetic construct
  misc_feature 1..3204: note = derived and/or modified CDS sequence (opt3) from RVFV(Lunyo)__KU167026.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggtgtccggccagacgaaacgagaactgaagtcatttgacattagtcagtgccctaaaatcgggggacatggcagcaagaagtgcactggtgatgccgcgttctgttctgcctacgagtgcaccgcacagtatgctaatgcctactgttcccacgctaacgggtcaggaattgtccaaatccaggttagcggcgtgtggaaaaagccactttgcgtaggctatgaacgtgtggtcgtgaaaagagagctgagtgccaagcccatacagagggttgaaccttgtacaacttgcatcaccaaatgtgagccacacgggttggtggtccggtctacaggatttaagatttccagcgcagtggcctgcgcttcgggtgtatgtgttaccggctctcaatccccctcaacggagatcactctcaagtacccggggattagtcagagctccggaggcgacatcggtgtgcatatggcgcacgatgaccagtctgtcagctcaaaaatagtggcacattgccctccccaggatccatgtctggtccacgggtgcattgtgtgcgcccatggcttaatcaattatcaatgtcacacagctctgagtgccttcgttgtggtattcgtcttttccagcgtggcaattatctgcctcgccatcctttacaaggttctgaaatgtttgaagattgctcctcgcaaagtgctaaaccccctgatgtggataaccgccttcatcagatgggtctataagaagatggtggcaagggtagcggacaatattaaccaggtgaatcgggaaatcggatggatggagggcgggcagctcgctctgggaaacccagcccccatacctcgccacgcaccaattccgcgatactctacttaccttatgctgttgctcatcgtttcatatgccagtgcttgcagcgaactgatccaggcctcctctagaattacaacctgttcgacggagggtgtcaacaccaggtgccggttaagcggcacagcactgatccgtgctgggtccgtgggagccgaagcgtgtctaatgctcaaaggcgtgaaggaggatcaaactaaatttctgaagattaaaaccgtctcaagtgagctttcttgccgcgaaggtcagagctactggacagggtccttctcacccaagtgtttgagctctagaaggtgccatctggttggcgagtgtcacgtgaatcggtgcctctcctggcgagacaacgaaacaagtgccgagtttagcttcgtgggagaatctaccacaatgcgcgagaataaatgctttgagcagtgtggcgggtggggatgcggttgtttcaacgtaaatccttcctgcctgtttgtccatacctatcttcagtcagtgagaaaggaagctctgagggttttcaactgtatagattgggtgcacaagttgactctcgagatcacggactttgacggcagtgtcagcacaattgatctgggggcatcgtcctctcggttcaccaattggggaagcgtgtcattaagtctggacgccgaaggcatctccggttctaacagcttttccttcatcgagtcaccagggaaaggctacgctattgttgatgagcccttcagcgaaatacctcgccaaggatttctaggcgagatcagatgcaatagtgaatcttccgtgctcagcgcccacgagtcgtgtctgagggcaccaaaccttatttcatataagcccatgatcgaccagttggaatgcactaccaatctgattgatccgttcgtagtctttgagcgtgggtctctccctcagacacggaacgacaaaaccttcgcggccagtaagggaaatcgaggcgtgcaggctttttccaaaggtagcgtgcaagccgatctgactttaatgttcgacaactttgaggtcgatttcgttggggcagctgtgtcttgtgacgccgcatttctgaatcttacaggatgctacagctgtaacgccggcgctagagtatgcttgtccatcacgtcaaccggtactggcacactcagtgcgcataacaaggatgggagcctgcacatagtgctaccatctgaaaatggaaccaaggaccagtgccagatcctgcatttcacagtccccgaggtggaagaggaatttatgtattcctgtgatggcgacgagaggcctctcctggttaaagggactcttattgccatcgaccccttcgatgaccgccgggaggcaggaggcgaatcaaccgtggtcaacccaaagagtggtagctggaactttttcgattggttctccgggttgatgtcttggtttggaggccctctgaaaacgattttactcatctgcctgtacgtggctctttcgataggtctgttctttttgctcatttacctgggcagaaccgggctaagcaagatgtggctggccgccactaaaaaggcttcatga

SEQ ID NO: 11289 - RNA, 3204 nt, synthetic construct
  misc_feature 1..3204: note = derived and/or modified CDS sequence (opt3) from RVFV(200803167)__JF311382.1__Gn-Gc
  source 1..3204: mol_type = other RNA
atggccggcatcgctatgaccgtgctgcccgcactcgccgtcttcgcgcttgctcctgttgtgtttgccgaggacctgcacttgagaaataggccagggaagggacataattacattgatggtatgacacaggaagacgcaacttgcaaaccggtaacgtatgccggcgcttgtagctccttcgatgtgttactggagaaggggaaatttcccctattccaatcttacgcacaccatcggaccctcctggaagccgtccacgacacaataatcgctaaggccgatcctccatcatgcgaccttcagagtgcgcatggaaacccctgtatgaaagagaagctggtgatgaagactcactgccctaatgattatcagagcgcacactacttgaacaatgacggcaaaatggcctccgttaagtgtccacccaaatatgaactcaccgaggattgcaacttttgtcgccagatgacaggtgcttctctgaagaaagggtcgtaccctctgcaagacctcttctgccagtcaagcgaggatgacggaagtaagttaaagaccaaaatgaagggcgtgtgtgaagtcggcgtgcaggccctgaaaaagtgcgatgggcagctttccactgcacatgaggtagttccatttgctgtgttcaaaaattctaagaaagtctatttggacaagctggacctaaagacagaagagaacctcctgccggatagctttgtgtgtttcgagcacaaaggacaatacaagggtaccatggactccggccagacgaaacgagaacttaagtcatttgatattagtcagtgccccaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagcctctgtgcgtgggctatgaacgtgtagtggtcaaaagagagttgagtgccaagccaatacagagggtggaaccctgtacaacttgcatcaccaaatgtgagcctcacgggctcgttgtgcggtctacaggatttaagatttccagcgcagtcgcctgcgcttcgggtgtgtgtgtaaccggctctcaatccccatcaacggagatcgcgctgaagtaccccgggattagtcagagctccggaggcgatatcggtgttcatatggcacacgacgatcagtctgtgagctcaaaaatagtcgcccattgcccgcctcaggacccctgtttagtgcacgggtgcattgtctgcgctcatggcctgatcaattatcaatgtcacactgccctcagtgcattcgtggttgtgttcgtattttccagcattgccatcatctgccttgctattctgtaccgcgtcttgaagtgtctaaaaatagccccaagaaaggtgctgaaccctctcatgtggatcacagcattcattaggtgggtttataaaaagatggtggcgcgggtcgctgataatatcaaccaggtgaatcgcgaaataggatggatggagggcgggcagctggtacttggaaaccccgccccaattccccgacacgcacctatcccaagatactctacctacctgatgttgctcctgatcgtgtcatatgccagtgcttgcagcgaattaattcaggcctcctctaggatcactacatgttcgaccgagggtgttaacacgaagtgccggctgagcggcaccgcactaattcgtgctgggtccgtcggagccgaagcgtgtctcatgctgaaaggcgtgaaggaggaccaaacaaaatttcttaagataaaaactgtgtcaagtgagttgtcttgccgcgaaggtcagagctactggaccgggtccttctcaccgaagtgtctgagctctagaaggtgccatctcgtcggcgagtgtcacgttaatcggtgcctgtcctggcgagataacgaaacaagtgccgagtttagcttcgtgggagaatctactaccatgcgcgagaataaatgctttgagcagtgtggcgggtggggatgcggttgtttcaacgtgaatccctcctgcctttttgtacatacatatctgcagtcagtcagaaaggaggctttgagggtgttcaactgtatcgactgggttcacaagctcaccctggaaattactgactttgatggcagtgtgagcacgatcgacttaggggcatcgtcctctcggttcacaaattggggaagcgtctcactgagtctagatgccgaaggcatctccggttctaacagcttttccttcattgagtcacctgggaaaggctacgctatagtggacgagccattcagcgaaatcccccgccaaggatttctcggcgagattagatgcaatagtgaatcttccgttctgagcgcccacgagtcgtgtcttagggcacctaacttgatctcatataagccaatgattgatcagctggaatgcaccactaatctcatcgaccccttcgtggtatttgagcgtgggtctctgccgcagacccggaacgataaaacattcgcggccagtaagggaaatcgaggcgtccaggctttttccaaaggtagcgtgcaagccgacttaaccctgatgttcgataactttgaggtggacttcgtcggggcagctgtttcttgtgatgccgcatttcttaatttgactggatgctacagctgtaacgccggcgctagagtgtgcctctccataacatcaacgggtaccggcactctgagtgcgcataacaaggacgggagcctacacatcgtactgccttctgaaaatggaacaaaggatcagtgccagattctccatttcaccgtgccagaggtcgaagaggaatttatgtattcctgtgacggcgacgagaggcccctgcttgtgaaagggacattgatcgccattgatcctttcgacgatcgccgggaggcaggaggcgaatcaactgttgtgaaccccaagagtggtagctggaactttttcgactggttctccgggctgatgtcttggtttggaggcccattaaaaaccatgctcctgatctgcctttacgtcgctctgtcgataggtttgttctttctcctgatttacctaggcagaacggggctgagcaagatgtggctcgccgccaccaaaaaggcttcatga

SEQ ID NO: 11290 - RNA, 3204 nt, synthetic construct
  misc_feature 1..3204: note = derived and/or modified CDS sequence (opt3) from RVFV(2373/74)__DQ380194.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatggtcgcacattgccctccccaggacccatgtctggtgcacgggtgcatagtctgcgcccatggcttaattaattatcaatgtcacacagctctgagtgccttcgtggttgtgttcgtattttccagcgtcgcaatcatttgcctcgccatcctttacaaggtgctgaaatgtttgaagatcgctcctcgcaaagttctaaaccccctgatgtggattaccgccttcataagatgggtgtataagaagatggtcgcaagggtggcggataatatcaaccaggtaaatcgggaaattggatggatggagggcgggcagctcgctctgggaaacccagcccccatccctcgccacgcaccaataccgcgatactctacttaccttatgctgttgctcattgtgtcatatgccagtgcttgcagcgaactgatccaggcctcctctagaatcacaacctgttcgacggagggtgttaacaccaaatgcaggttaagcggcacagcactgattcgggctgggtccgtcggagccgaagcgtgtctaatgctcaagggcgtgaaagaggaccaaactaagtttctgaaaatcaagaccgtgtcaagtgagctttcttgccgtgaaggtcagagctactggacagggtccttctcacccaaatgtttgagctctcgcagatgccatctggtcggcgagtgtcacgttaataggtgcctctcctggcgggataacgaaaccagtgccgagtttagcttcgtgggagaatctactacaatgcgagagaataagtgctttgagcagtgtggcgggtggggatgcggttgtttcaacgtgaatccttcctgcctgtttgtacatacctatcttcagtcagtccgcaaggaagctctgagagtgttcaactgtattgactgggttcacaaattgactctcgagataacggactttgatggcagtgtgagcacactggacttaggggcatcgtcctctaggttcaccaattggggaagcgtctcactgagtctagatgccgaaggcatctccggttctaacagcttttccttcattgagtcaccagggaagggctacgctatcgtggacgagcccttcagcgaaatccctcggcaaggatttctcggcgagattcgctgcaatagtgaatcttccgttctgagcgcccacgagtcgtgtcttagagcaccaaacttgatatcatataaacccatgatcgatcagctggaatgcactaccaatctcattgacccgttcgtggtatttgagagggggtctctgcctcagacacgtaacgagaagaccttcgcggccagtaaaggaaatcggggcgtccaggctttttccaagggtagcgtgcaagccgatttaactctgatgttcgacaactttgaagtggatttcgtcggggcagctgtttcttgtgacgccgcatttcttaatttgacaggatgctacagctgtaacgccggcgctcgagtgtgcctctccatcacgtcaaccggtactggcacactgagtgcgcataacaaggatgggagcctacacattgtactgccatctgagaatggaaccaaagaccagtgccagatcctccatttcacagtgcccgaagtcgaggaagagtttatgtattcctgtgatggcgacgagagacctctgcttgtgaaggggactttgatagccatcgaccccttcgatgacaggcgcgaagcaggaggcgagtcaaccgttgtgaacccaaaaagtggtagctggaactttttcgattggttctccgggctgatgtcttggtttggaggccctttaaagacgattctcctgatctgcctttacgtcgctctgtcgattggtttgttctttctcctgatctacctaggccggaccgggctgagcaaaatgtggctcgccgccacaaagaaggcttcatga

SEQ ID NO: 11291 - RNA, 3204 nt, synthetic construct
  misc_feature 1..3204: note = derived and/or modified CDS sequence (opt3) from RVFV(Kenya 57 (Rintoul))__DQ380192.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagattaaacgagaactgaagtcatttgatatcagtcagtgccctaaaattgggggacatggcagcaagaagtgcacgggtgacgccgcgttctgttctgcctacgagtgcactgcacagtatgctaatgcctactgttcccacgctaacgggtcaggaatcgtgcaaatacaggtcagcggcgtttggaaaaagccactttgcgtgggctatgaacgtgtagtggtcaaaagagagctgagtgccaagcccatccagagggtggaaccttgtaccacatgcattactaaatgtgagccacacgggttggttgtgcggtctaccggatttaagatctccagcgcagtcgcctgcgcttcgggtgtgtgtgtaacaggctctcaatccccctcaaccgagattacgctcaagtacccggggatcagtcagagctccggaggcgatataggtgttcatatggcgcacgacgatcagtctgtgagctcaaaaattgtcgcacattgccctccccaggacccatgtctggtgcacgggtgcatcgtctgcgcccatggcttaattaattatcaatgtcacactgctctgagtgccttcgtggttgtgttcgtattttccagcgtcgcaatcatctgcctcgccattctttacaaggtgctgaaatgtttgaagatagctcctcgcaaagttctaaaccccctgatgtggatcacagccttcattagatgggtgtataagaagatggtcgcaagggtggcggataatatcaaccaggtaaatcgggaaataggatggatggagggcgggcagctcgtgctgggaaacccagctcccattcctcgccacgccccaatcccgcgatactctacctaccttatgctgttgctcatcgtttcatatgcaagtgcctgcagcgaactgattcaggcttcctctagaatcactacatgttcgaccgagggtgtcaacacgaaatgcaggttaagcggcaccgccctgattcgggcagggtccgtgggagctgaagcctgtctaatgctcaagggcgtgaaagaggaccaaacaaagtttctgaaaataaagactgtctcaagtgagctttcttgccgtgaaggtcagagctactggaccgggtccttctcacccaaatgtttgagctctcgcagatgccatctggttggcgagtgtcacgtgaataggtgcctctcctggcgggataacgaaacaagtgcggagtttagcttcgtgggagaatctactaccatgcgagagaataagtgctttgagcagtgtggcgggtggggatgcggttgtttcaacgtaaatccttcctgcctgtttgtccatacatatcttcagtcagtgcgcaaggaagccctgagagttttcaactgtatcgactgggtgcacaaattgaccctcgagattactgactttgatggcagtgtcagcacggtggacctgggggcttcgtcctctaggttcacaaattggggaagcgtttcattaagtctggatgcagaaggcatctccggttctaacagcttttccttcatcgagtcaccagggaagggctacgccattgtggacgagcccttcagcgaaataagtcggcaaggatttctaggcgagatccgctgcaattctgaatccagcgtactctcggctcacgagtcatgtctgagagcccctaaccttatttcttataaaccaatgatcgatcagttggaatgcaccactaatctgattgaccccttcgtcgtgtttgagagggggagtctcccgcagacccgtaacgataagacattcgcagcgtccaaaggaaatcggggcgtgcaggcctttagcaagggttctgtccaagctgacctgaccttaatgttcgataactttgaggttgacttcgtgggggccgcagtaagctgtgatgctgcctttctgaatcttactggatgctactcctgtaacgcaggcgcccgagtgtgcttgtcaatcacaagtacgggtaccggcactctcagcgctcataacaaggacgggtctctgcacatagtcctaccttccgaaaatggaacaaaagatcagtgccagatcctgcatttcaccgtgccagaggttgaagaggaatttatgtattcatgtgacggcgacgagagacccctcctggtgaaggggacacttattgcgatcgatcctttcgacgataggcgcgaggccggaggcgaaagtactgtcgtgaaccccaaaagcggttcctggaactttttcgactggttctctgggttgatgtcgtggtttggaggcccactgaagaccattttactcatctgcctgtacgttgcacttagcataggtctgttctttttgctcatttacctgggccggacggggctatcaaaaatgtggctggctgccaccaagaaggcctcctga

SEQ ID NO: 11292 - RNA, 3204 nt, synthetic construct
  misc_feature 1..3204: note = derived and/or modified CDS sequence (opt3) from RVFV(RVFBJ01/2016)__KX785331.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaacatgaattgaccgaggattgcaacttttgtcgccagatgacaggtgcttctctcaagaaagggtcgtatccactgcaagacctgttctgccagtcaagcgaggatgacggaagtaagctcaagaccaaaatgaagggcgtgtgtgaagtcggcgtgcaggccttaaagaagtgcgatgggcagctgtccactgcacacgaggtagttccgtttgctgtgttcaaaaattctaagaaagtctaccttgacaagttggacctgaagacagaagagaacctactccccgatagctttgtgtgtttcgagcataaaggacaatataagggtaccatggactccggccagacgaaacgagaactgaagtcatttgatattagtcagtgccctaaaatcgggggacacggcagcaagaagtgcactggtgacgccgcgttctgttctgcctacgagtgcaccgcacagtacgctaatgcctattgttcccacgctaacgggtcaggaattgtgcaaatccaggtcagcggcgtttggaaaaagccactttgcgtgggctacgaacgtgtagtggtcaaaagagagctgagtgccaagcccatacagagggtggaaccttgtacaacttgcatcaccaaatgtgagccacatgggttggttgtgcggtctacaggatttaagatttccagcgcagtcgcctgcgcttcgggtgtgtgtgtaaccggctctcaatccccctcaacggagatcactctcaagtatccggggattagtcagagctccggaggcgatatcggtgttcacatggcgcatgacgatcagtctgtgagctcaaaaatagtcgcacactgccctccccaggacccatgtctggtgcatgggtgcattgtctgcgcccacggcttaatcaattaccaatgtcacacagctctgagtgccttcgtggttgtgttcgtattttccagcgtcgcaattatctgcctcgccatcctttataaggtgctgcgctgtttgaaaattgctcctaagaaagttctaaaccccctgatgtggataaccgccttcatcagatgggtgtacaagaagatggtcgcaagggtggcggataatattaaccaggtaaatcgggaaatcggatggatggagggcgggcagctcgctctgggaaacccagcccccatacctcgccatgcaccaattccgcgatattctacttaccttatgctgttgctcatcatctcatacgccagtgcttgcagcgaactgattcaggcctcctctagaatcacaacctgttcgacggagggtgtgaacaccaaatgcaggttaagcggcacagcactgattcgggctgggtccgttggagccgaagcgtgtctaatgctcaagggcgtcaaagaggaccaaactaagtttctgaaaataaagaccgtgtcaagtgagctttcttgccgtgaaggtcagagctattggacagggtccttctcacccaaatgtttgagctctcgcagatgccacctggtgggcgagtgtcatgtcaataggtgcctctcctggcgggataacgaaaccagtgccgagtttagcttcgttggagaatctactacaatgcgagagaataagtgctttgagcagtgtggcgggtggggatgcggttgtttcaacgtgaatccttcctgcctgtttgtgcacacctaccttcagtcagtacgcaaggaagctctgagagtcttcaactgtatcgactgggtgcacaaattgactctcgagattacggactttgatggcagtgttagcacaatcgacctgggggcatcgtcctctaggttcaccaattggggaagcgtgtcattaagtctggatgccgaaggcatctccggttctaacagcttttccttcattgagtcaccagggaagggctatgctatagtcgacgagcccttcagcgaaatccctcggcaaggatttctaggcgagattcgctgcaatagtgaatcttccgtgctcagcgcccatgagtcgtgtctgagagcaccaaaccttatctcatacaaacccatgattgatcagttggaatgcactaccaatctgatcgacccgttcgttgtgtttgagagggggtctctccctcagacacgtaacgataagaccttcgcggccagtaaaggaaatcggggcgtacaggctttttccaagggtagcgtccaagccgacctgactttaatgttcgataactttgaggtggacttcgtgggggcagctgtctcttgtgatgccgcatttctgaatcttacaggatgctatagctgtaacgccggcgctcgagtttgcttgtccataacgtcaaccggtactggcacactcagtgcgcacaacaaggacgggagcctgcatatcgtgctaccatctgaaaatggaaccaaagatcagtgccagattctgcacttcacagtacccgaggtggaagaggaatttatgtactcctgtgacggcgacgagagacctctcctggtcaaggggactcttatcgccattgatcccttcgacgataggcgcgaggcaggaggcgaatcaaccgtggttaacccaaaaagtggtagctggaactttttcgactggttctccgggttgatgtcttggtttggaggccctctgaagacgatcttactcatatgcctgtatgtggctctttcgattggtctgttctttttgctcatctacctgggccggaccgggctaagcaaaatgtggctggccgccacaaagaaggcttcatga

SEQ ID NO: 11293 - RNA, 3204 nt, synthetic construct
  misc_feature 1..3204: note = derived and/or modified CDS sequence (opt3) from RVFV(clone 13)__DQ380213.1__Gn-Gc
  source 1..3204: mol_type = other RNA
atggccggcatcgctatgacagtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaacatgaattgaccgaggattgcaacttttgtcgccagatgacaggtgcttctctcaagaaagggtcgtatccactgcaagacctgttctgccagtcaagcgaggatgacggaagtaagctcaagaccaaaatgaagggcgtgtgtgaagtcggcgtgcaggccttaaagaagtgcgatgggcagctgtccactgcacacgaggtagttccgtttgctgtgttcaaaaattctaagaaagtctaccttgacaagttggacctgaagacagaagagaacctactccccgatagctttgtgtgtttcgagcataaaggacaatataagggtaccatggactccggccagacgaaacgagaactgaagtcatttgatattagtcagtgccctaaaatcgggggacacggcagcaagaagtgcactggtgacgccgcgttctgttctgcctacgagtgcaccgcacagtacgctaatgcctattgttcccacgctaacgggtcaggaattgtgcaaatccaggtcagcggcgtttggaaaaagccactttgcgtgggctacgaacgtgtagtggtcaaaagagagctgagtgccaagcccatacagagggtggaaccttgtacaacttgcatcaccaaatgtgagccacatgggttggttgtgcggtctacaggatttaagatttccagcgcagtcgcctgcgcttcgggtgtgtgtgtaaccggctctcaaaatccctccacggagatcactctcaagtatccggggatttcacagagtagcggaggcgatatcggtgttcacatggcgcatgacgatcagtccgtgtctagcaaaatagtcgcacactgccctccccaggacccatgtctggtgcatgggtgcattgtctgcgcccacggcttaatcaactaccaatgtcacacagctctgtcagccttcgtggttgtgttcgtatttagttccattgcaatcatctgcctcgccattctttatcgcgtcctgaagtgtttgaaaatagctcctagaaaggtgctaaatcccctgatgtggatcaccgccttcattaggtgggtttacaaaaagatggtggcacgggtcgcggataacatcaatcaggtgaaccgcgaaataggatggatggagggcgggcagctcgtactgggaaacccagctcccattcctcgacatgccccaatcccgagatatagcacttaccttatgctgttgctcatcgtgtcttacgcatcagcctgcagtgaactgattcaggctagctccaggatcacaacctgttctacggagggtgttaataccaagtgccggttatcgggcacagccctgattcgtgcagggagcgtcggagctgaagcctgtctaatgctcaaaggcgtgaaggacgatcaaactaaatttctgaagataaaaaccgtgtcctcagagcttagttgccgcgagggtcagtcttattggacagggagcttctcccccaagtgtttgtcaagcagaaggtgccacctggtcggcgaatgtcatgttaaccggtgcctctcttggcgagacaatgagacttccgcggaatttagtttcgtgggagagagcaccacaatgcgcgaaaacaaatgctttgagcagtgtggcgggtggggatgcggttgtttcaatgtgaacccttcttgcctgtttgtacacacctaccttcagtccgtcagaaaggaggccctgagggtgttcaattgtatcgactgggttcacaagttgactctcgaaattacggattttgacggctcagtgagtacaatcgatctgggggctagctcgtcccggttcaccaactggggatctgtcagcttatcactggacgcagagggcatcagtggttccaattcttttagcttcattgaatccccagggaaaggctatgccatagtggatgagcccttctcagagatccctcgccaaggatttctaggcgaaattagatgcaacagcgagagttctgttctctccgctcatgaaagctgtctgagggccccaaatcttatctcgtacaagcccatgattgaccagttggagtgcactaccaacctgatcgatccgttcgtggtatttgaacgtgggtcactccctcagacacggaatgagaaaaccttcgcagcgtctaagggaaaccgaggcgtccaggcctttagtaaaggttccgtgcaagctgacctgactttaatgttcgataattttgaggtggacttcgtcggggccgcagttagctgtgatgctgcctttctgaaccttacaggatgctattcttgtaacgcaggcgccagagtgtgcttgagcataacgtccaccggtactggcacactctcagctcacaataaggacgggagtctgcatatcgtactaccaagcgaaaacggaaccaaggatcagtgccagattctgcacttcacagtgcccgaggtcgaagaggaatttatgtactcttgtgacggcgacgagaggcctctcctggtgaaagggactcttatcgcgattgatcccttcgacgatcgccgggaggccggaggcgaatccaccgttgtgaatccaaagtcaggtagttggaactttttcgactggttcagcgggttgatgtcctggtttggaggccctctgaaaacgatcttactcatatgcctgtatgtcgcactttctattggtctgttctttttgctcatctacctgggcagaaccgggctatcgaagatgtggctggctgccaccaaaaaggccagctga

SEQ ID NO: 11294 - RNA, 3204 nt, synthetic construct
  misc_feature 1..3204: note = derived and/or modified CDS sequence (opt3) from RVFV__JQ068143.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccattgactccggccagacgaaacgagaactgaagtcatttgatatcagtcagtgccctaaaattgggggacatggcagcaagaagtgcactggtgacgccgcgttctgttctgcctacgagtgcaccgcacagtatgctaatgcctactgttcccacgctaacgggtcaggaatcgtgcaaatacaggtcagcggcgtttggaaaaagccactttgcgtgggctatgaacgtgtagtggtcaaaagagagctgagtgccaagcccatccagagggtggaaccttgtacaacttgcattaccaaatgtgagccacacgggttggttgtgcggtctacaggatttaagatctccagcgcagtcgcctgcgcttcgggtgtgtgtgtaaccggctctcaatccccctcaacggagattactctcaagtacccggggatcagtcagagctccggaggcgatataggtgttcatatggcgcacgacgatcagtctgtgagctcaaaaattgtcgcacattgccctccccaggacccatgtctggtgcacgggtgcatcgtctgcgcccatggcttaattaattatcaatgtcacacagctctgagtgccttcgtggttgtgttcgtattttccagcgtcgcaatcatctgcctcgccattctttacaaggtgctgcgctgtttgaaaatagctcctaagaaagttctaaaccccctgatgtggatcaccgccttcattagatgggtgtataagaagatggtcgcaagggtggcggataatatcaaccaggtaaatcgggaaataggatggatggagggcgggcagctcgctctgggaaacccagcccccattcctcgccacgcaccaatcccgcgatactctacttaccttatgctgttgctcatcatttcatatgccagtgcttgcagcgaactgatccaggcctcctctagaattacaacctgttcgacggagggtgtgaacaccaaatgcaggttaagcggcacagcactgatacgggctgggtccgttggagccgaagcgtgtctaatgctcaagggcgtcaaagaggaccaaactaagtttctgaaaatcaagaccgtgtcaagtgagctttcttgccgtgaaggtcagagctactggacagggtccttctcacccaaatgtttgagctctcgcagatgccatctggtgggcgagtgtcacgtcaataggtgcctctcctggcgggataacgaaaccagtgccgagtttagcttcgttggagaatctactacaatgcgagagaataagtgctttgagcagtgtggcgggtggggatgcggttgtttcaacgtgaatccttcctgcctgtttgtgcatacctatcttcagtcagtacgcaaggaagctctgagagtcttcaactgtattgactgggtgcacaaattgactctcgagatcacggactttgatggcagtgttagcacaatcgacctgggggcatcgtcctctaggttcaccaattggggaagcgtgtcattaagtctggatgccgaaggcatttccggttctaacagcttttccttcatagagtcaccagggaagggctacgctatcgtcgacgagcccttcagcgaaattcctcggcaaggatttctaggcgagatccgctgcaatagtgaatcttccgtgctcagcgcccacgagtcgtgtctgagagcaccaaaccttatttcatataaacccatgatcgatcagttggaatgcactaccaatctgatagacccgttcgttgtgtttgagagggggtctctccctcagacacgtaacgataagaccttcgcggccagtaaaggaaatcggggcgtacaggctttttccaagggtagcgtccaagccgacctgactttaatgttcgataactttgaggtggacttcgtgggggcagctgtctcttgtgatgccgcatttctgaatcttacaggatgctacagctgtaacgccggcgctcgagtttgcttgtccatcacgtcaaccggtactggcacactcagtgcgcataacaaggacgggagcctgcacattgtgctaccatctgaaaatggaaccaaagatcagtgccagatcctgcatttcacagtacccgaggtggaagaggaatttatgtattcctgtgacggcgacgagagacctctcctggtcaaggggactcttattgccatcgatcccttcgacgataggcgcgaggcaggaggcgaatcaaccgtggttaacccaaaaagtggtagctggaactttttcgactggttctccgggttgatgtcttggtttggaggccctctgaagacgatattactcatttgcctgtacgtggctctttcgatcggtctgttctttttgctcatttacctgggccggaccgggctaagcaaaatgtggctggccgccacaaagaaggcttcatga

SEQ ID NO: 11295 - RNA, 3204 nt, synthetic construct
  misc_feature 1..3204: note = derived and/or modified CDS sequence (opt3) from RVFV(SA-75)__DQ380189.1__Gn-Gc
  source 1..3204: mol_type = other RNA
atggccagaatcgctatgaccgtgctgcccgcactcgccgtcttcgcgcttgctcctgttgtgtttgccgaggacccacacctgaggaatcggccgggcaaggggcataattacattgatggaatgacacaggaagacgcaacttgcaaacccgtaacgtatgccggtgcttgtagctccttcgatgtgttgttagagaagggcaaatttcctctgttccaatcttacgcacaccatcgcaccctactcgaagccgtccacgacacaataatcgctaaggccgatccaccctcatgcgacctgcagagtgcgcatgggaacccttgtatgaaagagaaacttgtgatgaagactcactgcccaaatgattatcagagcgcacactacctgaacaatgacggaaaaatggcctccgttaagtgtccccctaaatatgaattgaccgaggattgcaacttttgtcgacagatgacaggcgcttctctcaagaaaggttcgtacccactgcaagacctgttctgccagtcaagcgaggatgacgggagtaagctcaagaccaaaatgaagggagtgtgtgaagtcggcgtgcaggccttaaagaagtgcgatggccagctgtccactgcacatgaggtagttccgtttgctgtgttcaaaaattctaagaaagtctatcttgacaagttggacctgaagacagaagagaacctactccccgatagctttgtgtgtttcgagcacaaagggcaatacaagggaaccatggactccggtcagacgaaacgtgaactgaagtcatttgatattagtcagtgccctaaaatcggcgggcatggaagcaagaagtgcactggcgacgccgcgttctgttctgcctacgagtgcaccgcacagtatgctaatgcctactgttcccacgctaacggttcaggggtggtccaaattcaggttagcggagtgtggaaaaagccactttgcgtaggctatgaaagagtggtcgtgaaaagggagctgagtgccaagcccatccagcgggttgaaccttgtacaacttgcataaccaaatgtgagccacacggcttggtggtccgctctacagggtttaagatctccagcgcagtggcctgcgcttcgggagtatgtgttaccggttctcaatccccctcaacggagattactctcaagtacccgggcatcagtcagagctccgggggagatattggcgtgcatatggcgcacgacgatcagtctgtcagctcaaaaatcgtggcacattgccctccccaggacccatgtctggtccacggttgcatagtgtgcgcccatgggttaattaattatcaatgtcacacagctctgagtgccttcgttgtggtattcgtcttttccagcgtggcaatcatttgcctcgccatcctttacaaggttctgaaatgtttgaagatcgctcctagaaaagtgctaaaccccctgatgtggattaccgtcttcataaggtgggtgtataagaagatggtagcccgggtggcagataatatcaaccaggttaatcgcgaaattggctggatggagggaggccagctcgcgctggggaacccagctcccatccctcgacacgccccaataccgagatactctacttaccttatgctgttgctcattgtctcatatgcaagtgcctgcagcgaactgatccaggcttcctctaggatcacaacctgttcgacggagggagtgaacaccaaatgccggttaagcggtacagccctgattcgtgcaggctccgtgggggctgaagcctgtctaatgctcaagggagtcaaagaggaccaaactaagtttctgaaaatcaagaccgtttcaagtgagctttcttgccgcgaaggccagagctactggacaggttccttctcacccaaatgtttgagctctagaaggtgccatctggtgggggagtgtcacgtgaatcggtgcctctcctggcgagataacgaaaccagtgcggagtttagcttcgtaggcgaatctactacaatgcgcgagaataagtgctttgagcagtgtggaggctgggggtgcggatgtttcaacgtcaatccttcctgcctgtttgtgcatacctatcttcagtcagttagaaaggaagccctgagggtgttcaactgtattgactgggtccacaaattgactctcgagataacggactttgatggtagtgtgagcacaatcgacctgggcgcttcgtcctctcggttcaccaattgggggagcgtttcattaagtctggatgcagaaggaatttccggctctaacagcttttccttcatcgagtcaccaggtaaggggtacgccatcgtggacgagcccttcagcgaaattcctcgccaaggctttctaggagagataagatgcaatagtgaatcttccgtactcagcgctcacgagtcgtgtctgagggccccaaaccttatctcatataaacccatgattgatcagttggaatgcactaccaatctgatcgacccgttcgtcgtgtttgagcgtggctctctccctcagacacggaacgataagaccttcgcagcgagtaaagggaatcgaggagtgcaggccttttccaagggcagcgtccaagctgacctgactttaatgttcgataactttgaggttgacttcgtgggtgccgcagtatcttgtgatgctgcctttctgaatcttacagggtgctacagctgtaacgcaggagccagagtgtgcttgtccattacgtcaaccggcactggtacactcagtgctcataacaaggacggcagcctgcacatcgtcctaccatctgaaaatgggaccaaagatcagtgccagatactgcatttcacagtgcccgaggttgaagaggaatttatgtattcctgtgacggagacgagaggcctctcctggtgaagggcactcttatcgcgattgatcccttcgacgatcgccgggaggccgggggagaatcaaccgtcgtgaacccaaaaagtggcagctggaactttttcgactggttctccggtttgatgtcttggtttgggggacctctgaagacgatcttactcatttgcctgtacgttgcactttcgatcggcctgttctttttgctcatatacctgggtagaaccggcctaagcaaaatgtggctggctgccacaaagaaggcctcatga

SEQ ID NO: 11296 - RNA, 3204 nt, synthetic construct
  misc_feature 1..3204: note = derived and/or modified CDS sequence (opt3) from RVFV(ANK-6087)__DQ380216.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaaactggactccggccagaccaagcgagaacttaaatcatttgatattagtcagtgccctaagatcgggggacatggcagcaagaaatgcacgggtgacgccgcgttctgttctgcctacgagtgcactgcacagtatgctaatgcctactgttcccacgctaacgggtcaggaattgtgcaaatccaggtcagcggcgtttggaagaaaccactgtgcgtgggctatgaacgtgtagtggtcaagagagagttgagtgccaaacccatacagagggtggaaccttgtaccacatgcatcactaagtgtgagccacacgggctcgttgtgcggtctaccggatttaagatttccagcgcagtcgcctgcgcttcgggtgtgtgtgtaacaggctctcaatccccctcaaccgagatcacgctgaaatacccggggattagtcagagctccggaggcgatatcggtgttcatatggcgcacgacgatcagtctgtgagctcaaagatagtcgcacattgccctccccaggacccatgtttagtgcacgggtgcattgtctgcgcccatggcctgatcaattatcaatgtcacactgctctcagtgccttcgtggttgtgttcgtattttccagcattgcaatcatctgccttgccattctgtaccgcgtcttgaaatgtctaaagatagctcctagaaaagtgctgaaccccctcatgtggatcacagccttcattaggtgggtttatcggaagatggtggcacgcgtcgcggataatatcaaccaggtgaatcgagaaataggatggatggagggcgggcagctggtacttggaaacccagctcccattcctagacacgtgccaatcccgaggtactctacctacctgatgttgctcctgatcgtttcatatgccagtgcatgcagcgaattaattcaggcctcctctcggatcactacatgttcgaccgagggtgtcaacacgaagtgccgtctgagcggcaccgctctaattcgcgccgggtccgtgggagcagaggcttgtctcatgctgaaaggcgtgaaggaagaccaaacaaaatttcttaagataaaaactgtctcaagtgagttgtcttgcagagaaggtcagagctactggaccgggtccttctcacccaagtgtctgagctctaggcggtgccatctcgttggcgagtgtcacgtgaatcgatgcctgtcctggcgcgataacgaaacaagtgccgagtttagcttcgtgggagaatctactaccatgagagagaataaatgctttgagcagtgtggcgggtggggatgcggttgtttcaacgtaaatccttcctgcctttttgtccatacatatctgcagtcagtgaggaaggaagcgttgcgggttttcaactgtatcgactgggtgcacaagctcaccctggagattactgactttgatggcagtgtcagcacgatcgacttaggggcctcgtcctctcgcttcacaaattggggaagcgtgtcactgagtctagatgctgaaggcatctccggttctaacagcttttccttcattgagtcaccagggaaaggctacgcaatagttgacgagcccttcagcgaaatccctagacaaggatttctcggcgagattaggtgcaatagtgaatcttccgtgctgagcgcccacgagtcgtgtcttcgtgctccaaacttgatctcatataagcccatgattgatcagctggaatgctctaccaatctcatcgacccgttcgtagtctttaaacgggggagtctgcctcagactcgaaacgataagaccttcgccgcatccaaaggaaatagaggcgtgcaggcgtttagcaagggttctgtgcaagccgacttaacactgatgttcgataactttgaggtcgacttcgttggggctgccgtgagctgtgatgcagcttttcttaatttgaccggatgctactcctgtaacgccggcgcaagggtatgcctctcaataacaagtactggtacgggcaccctgagcgcccataacaaggacgggtctctacacatcgtgctgccatccgagaatggaactaaagatcagtgccagattctccatttcacagtccccgaagtggaggaagagtttatgtattcatgtgacggcgacgaacgccctctgcttgttcgggggaccttgatcgctattgatcccttcgacgatagaagggaggcgggaggcgagagtacagtggtcaacccaaagagcggttcctggaactttttcgactggttctctgggctgatgtcgtggtttggaggccctttaaaaactatcctcctgatatgcctttacgtggccctgagcattggtttgttctttctcctgatctacctaggccgcaccgggctgtcaaagatgtggctcgcagctacgaaaaaggcctcctga

SEQ ID NO: 11297 - RNA, 3204 nt, synthetic construct
  misc_feature 1..3204: note = derived and/or modified CDS sequence (opt3) from RVFV(KEN/Kil-006/07)__HM586966.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcggatggaaacaaatgtatgaaggagaaacttgtgatgaagactcattgccctaatgactatcagagcgcacactacctgaacaatgatggcaagatggcctccgttaaatgtccacccaagtatgaattgaccgaggactgcaacttttgtcgccagatgacaggtgcttctctcaaaaaggggtcgtaccctctgcaagatctgttctgccagtcaagcgaggacgatggaagtaagctcaaaaccaagatgaaaggcgtgtgtgaagtcggcgtgcaggccttaaagaaatgcgacgggcagctgtccactgcacacgaggtagttccatttgctgtgttcaaaaattctaagaaggtctatcttgacaagttggatctgaaaacagaagagaacctactcccggacagctttgtgtgtttcgagcataagggacaatacaaaggtaccatggattccggccagacgaagcgagaactgaaatcatttgacattagtcagtgccccaagatcgggggacacggcagcaagaaatgcactggtgatgccgcgttctgttctgcctacgagtgcaccgcacagtatgctaatgcctactgttcccatgctaacgggtcaggaattgtgcaaatccaggtcagcggcgtttggaagaaacctctttgcgtgggctatgaacgtgtagtggtcaagagagagctgagtgccaaaccaatacagagggtggaaccctgtacaacttgcatcaccaagtgtgagcctcacgggttggttgtgcggtctacaggatttaagatttccagcgcagtcgcctgcgcttcgggtgtgtgtgtaaccggctctcaatccccatcaacggagatcactctcaaataccccgggattagtcagagctccggaggcgacatcggtgttcacatggcgcatgatgaccagtctgtgagctcaaagatagtcgcacactgcccgcctcaggatccctgtctggtgcatgggtgcattgtctgcgcccacggcttaatcaattatcaatgtcatacagctctgagtgccttcgtggttattttcgtgttttccagcaccgcaatcatctgcctcgccgtactttaccgcgtcctgaaatgtttgaagattgctccaagaaaagtgctaaaccctctgatgtggataactgccttcatcaggtgggtttataagaagatggtggcacgggtcgcggacaatattaaccaggtgaatcgcgaaatcggatggatggagggcgggcagctcgctctgggaaaccccgccccaataccccgacacgcacctattccaagatactctacataccttatgctgttgctcatcgtatcatatgccagtgcttgcagcgaactgatccaggcctcctctaggattaccacgtgttcgaccgagggtgtgaacacaaaatgccggttaagcggcactgcactgatccgtgctgggtccgttggagccgaagcgtgtctaatgctcaagggcgtcaaagaggatcaaaccaagtttctgaaaattaagacagtgtcaagtgagctttcttgccgcgaaggtcagagctactggactgggtccttctcaccgaaatgtttgagctctagaaggtgccacctggtgggcgagtgtcatgtcaatcggtgcctctcctggcgagacaacgaaaccagtgccgagtttagcttcgttggagaatctacaaccatgcgcgagaataagtgctttgagcagtgtggcgggtggggatgcggttgtttcaacgtgaatccctcctgcctgtttgtgcacacttatcttcagtcagtaagaaaggaagctctgagggtcttcaactgtatagactgggtgcataaattgacgctcgagatcacagattttgacggcagtgttagcaccattgatctgggggcatcgtcctctcggttcactaattggggaagcgtgtcattaagtctggacgccgaaggcatctccggttctaacagcttttccttcatcgagtcacctgggaagggctacgctattgtcgatgagccattcagcgaaataccccgccaaggatttctaggcgagatcagatgcaatagtgaatcttccgtgctcagcgcccacgagtcgtgtctgagggcacctaaccttgtttcatataaaccaatgattgaccagttggaatgcaccacaaatctgatcgatcccttcgtggtatttgagcgtgggtctctcccgcagacccggaacgacaagactttcgcggccagtaaaggaaatcgaggcgtccaggctttttccaagggtagcgtgcaagccgatctgacattaatgttcgacaactttgaggtggatttcgtcggggcagctgtttcttgtgacgccgcatttctgaatcttacgggatgctacagctgtaacgccggcgctagagtgtgcttgtccattacctcaactggtacaggcaccctcagtgcgcacaacaaggatgggagcctgcatatcgtactaccttctgaaaatggaacaaaagaccagtgccagatactgcacttcactgtgccagaggtcgaagaggaatttatgtattcctgtgacggcgatgagaggcccctcctggtgaaggggacccttatcgccattgaccctttcgatgaccgccgggaggcaggaggcgaatcaacggttgtgaaccccaaaagtggtagctggaactttttcgattggttctccgggttgatgtcttggtttggaggcccactgaagaccatcttactcatttgcctgtacgtcgctctttcgatcggtctgttctttttgctcatatacctgggcagaacagggctaagcaaaatgtggctggccgccactaagaaggcttcatga

SEQ ID NO: 11298 - RNA, 3204 nt, synthetic construct
  misc_feature 1..3204: note = derived and/or modified CDS sequence (opt3) from RVFV(MgH824)__DQ380210.1__Gn-Gc
  source 1..3204: mol_type = other RNA
atggccggcatcgctatgacagtgctgcccgcactcgccgtcttcgcgcttgctcctgttgtgtttgccgaggacccacacctgagaaacaggccggggaagggatacaattatattgatggtatgacacaggaagacgcaacttgcaaacccgtaacgtacgccggcgcttgtagctccttcgatgtgttgttagagaaggggaaatttcctctgttccaatcttatgcacatcaccggaccctactcgaagccgtccatgacacaataatcgctaaggccgatccaccctcatgcgacctgcagagtgcgcacggaaacccttgtatgaaagagaaacttgtgatgaagactcattgcccaaatgattaccagagcgcacactatctgaacaatgacggcaaaatggcctccgttaagtgtccccctaaatacgaattgaccgaggattgcaacttttgtcgccagatgacaggtgcttctctcaagaaagggtcgtatccactgcaagacctgttctgccagtcaagcgaggatgacggaagtaagctcaagaccaaaatgaagggcgtgtgtgaagtcggcgtgcaggccttaaagaagtgcgatgggcagctgtccactgcacacgaggtagttccgtttgctgtgttcaaaaattctaagaaagtctaccttgacaagttggacctgaagacagaagagaacctactccccgatagctttgtgtgtttcgagcgaaaaggacaatacaagggtaccatggactccggccagacgaaacgtgaactgaagtcatttgatattagtcagtgccctaaaatcgggggacatggcagcaagaagtgcactggtgacgccgcgttctgttctgcctatgagtgcaccacacagtacgcaaatgcttattgttcccacgccaacgggtcaggagtggtccaaattcaggttagcggcgtgtggaaaaagccactttgcgtaggctacgaaagagtggtcgtgaaaagggagctgagtgctaagcccatccagcgggttgaaccttgtactacctgcataacaaaatgtgagccacatgggttggtggtccgctctaccggatttaagatctccagcgccgtggcatgcgcctcgggtgtatgtgttacgggctctcaatccccctcaactgagattacactcaagtatccggggatcagtcagagctccggaggcgatattggtgtgcacatggctcacgacgatcagtctgtcagctcaaaaatcgtggcgcattgccctccccaggacccatgtctggtccacgggtgcatagtgtgcgcacatggcttaattaattaccaatgtcacaccgccctgagtgctttcgttgtggtattcgtcttttccagcatcgccattatctgcctcgcaatcctttatagagtgctgaagtgtttgaaaattgcccctaggaaggttctaaaccccctgatgtggataactgctttcatccggtggatttacaaaaagatggtggcccgcgtcgcagataatatcaaccaggtgaatcgagaaataggatggatggagggcgggcagctcgtactgggaaacccagcgcccattcctagacatgctccaatcccgaggtactctacatatcttatgctgttgctcatcgtgtcatacgccagtgcatgcagcgaactgattcaggcctcctctcggatcaccacgtgttcgaccgagggtgttgacacaaagtgccgtttaagcggcactgctctgattcgcgccgggtccgtcggagcagaggcttgtctaatgctcaaaggcgtgaaggaagatcaaaccaaatttctgaagataaaaacagtgtcaagtgagctttcttgcagagaaggtcagagctattggactgggtccttctcacccaagtgtttgagctctaggcggtgccacctggtcggcgagtgtcacgttaaccgatgcctctcctggcgcgacaatgaaaccagtgccgagtttagcttcgtgggagaatctacaaccatgagagagaacaaatgctttgagcagtgtggcgggtggggatgcggttgtttcaatgtgaacccttcctgcctgtttgtacatacttaccttcagtcagtcaggaaggaagcgctgcgggtgttcaattgtatcgactgggttcacaagttgacgctcgagattacagattttgacggcagtgtgagcaccatcgatctgggggcctcgtcctctcgcttcactaactggggaagcgtctcattaagtctggacgctgaaggcatctccggttctaatagcttttccttcattgagtcaccagggaaaggctatgcaatagtggatgagcccttccctgaaatcccaagacaaggatttctaggcgagattaggtgcaacagcgaaagttctgttctctccgcccatgagagctgtctgcgtgctcccaatcttatctcgtacaagccgatgattgaccagttggaatgcaccacaaacctgatcgatcctttcgtggtatttgagcgggggtcactcccacagacccgaaatgacaaaactttcgccgcatctaagggaaacagaggcgtccaggcgtttagtaaaggttccgtgcaagccgatctgacattaatgttcgacaattttgaggtggatttcgtcggggctgccgttagctgtgacgcagcttttctgaaccttacgggatgctattcttgtaatgccggcgcaagggtgtgcttgagcataacctccactggtacaggctcactcagtgcccacaacaaggatgggagcctgcacatcgtactaccctctgaaaacggaaccaaggaccagtgccagattctgcatttcacagtgcctgaggtcgaagaggaatttatgtactcctgtgacggcgatgagcgccccctcctggtgaaagggactcttatcgctattgacccattcgatgaccggagagaggcgggaggcgaatcaaccgttgtgaatcctaagagtggtagctggaactttttcgattggttctccgggttgatgtcttggtttggaggccccctgaaaacgatcttactcatatgcctgtacgtcgccctttcgattggtctgttctttttgctcatctatctgggcaggaccgggctaagcaagatgtggctggcagctaccaaaaaggcctcatga

SEQ ID NO: 11299 - RNA, 3204 nt, synthetic construct
  misc_feature 1..3204: note = derived and/or modified CDS sequence (opt3) from RVFV(KEN/Mal-032/07)__HM586967.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtcggttgcaggaagacgcaacatgcaaacccgtaacttatgccggcgcttgtagctccttcgatgtgttactggagaaggggaaatttcctctattccaatcttacgcacaccatcgcacgctcctggaagccgtccacgacaccataatcgctaaggccgatccaccctcatgcgaccttcagagtgcggatggaaacaaatgtatgaaggagaagctggtgatgaaaacacattgccctaatgactatcagagcgcacactacttgaacaatgatggcaagatggcctccgttaaatgtccacccaagtatgaactcactgaggactgcaacttttgtcgacagatgaccggtgcttctctgaaaaaggggtcgtaccctctgcaagatctcttctgccagtcaagcgaggacgatggaagtaagttaaaaacaaagatgaaaggcgtgtgtgaagtcggcgtgcaggccctgaagaaatgcgacgggcagctttccaccgcacacgaggtagttccatttgctgtgttcaagaatagtaaaaaggtctatttggacaagctggatctaaaaactgaagagaacctcctgccggacagctttgtgtgtttcgagcataagggacaatacaaaggtacaatggattccggccagaccaagcgtgaacttaaatcatttgacattagtcagtgccccaagatcgggggacacggcagcaagaaatgcacgggtgatgccgcgttctgttctgcctacgagtgcactgcacagtatgctaatgcctactgttcccatgctaacgggtcaggaattgtgcaaatccaggtcagcggcgtttggaagaaacctctgtgcgtgggctatgaaagagtagtggtcaagagggagttgagtgccaaaccaatacagcgggtggaaccctgtaccacatgcatcactaagtgtgagcctcacgggctcgttgtgcgctctaccggatttaagatttccagcgcagtcgcctgcgcttcgggtgtgtgtgtaacaggctctcaatccccatcaaccgagatcacgctgaaataccccgggattagtcagagctccggaggcgacatcggtgttcacatggcgcatgatgaccagtctgtgagctcaaagatagtcgcacactgcccgcctcaggatccctgtttagtgcatgggtgcattgtctgcgcccacggcctgatcaattatcaatgtcatactgctctcagtgccttcgtggttattttcgtgttttccagcacagcaatcatctgccttgccgtactgtacagagtcttgaaatgtctaaagattgctccaaggaaagtgctgaaccctctcatgtggataaccgccttcatccggtgggtttataagaagatggtggcacgcgtcgcggacaatattaaccaggtgaatcgagaaatcggatggatggagggcgggcagctggctcttggaaaccccgccccaatacccagacacgcacctattccaaggtactctacttacctgatgttgctcctgatcgtatcatatgccagtgcttgcagcgaattaatccaggcctcctctcggattacaacctgttcgacggagggtgtgaacaccaaatgccgtctgagcggcacagcactaatccgcgctgggtccgttggagccgaagcgtgtctcatgctgaagggcgtcaaagaggatcaaactaagtttcttaaaattaagaccgtgtcaagtgagttgtcttgcagagaaggtcagagctactggacagggtccttctcaccgaaatgtctgagctctaggcggtgccacctcgtgggcgagtgtcatgtcaatcgatgcctgtcctggcgcgacaacgaaacttctgccgagtttagcttcgttggagaatctaccacaatgagagagaataagtgctttgagcagtgtggcgggtggggatgcggttgtttcaacgtgaatccctcctgcctttttgtgcacacctatctgcagtcagtaaggaaggaggctttgcgggtcttcaactgtatagactgggtgcataaactcactctggaaatcacggattttgacggcagtgttagcacaattgatttaggggcatcgtcctctcgcttcaccaattggggaagcgtgtcactgagtctagacgccgaaggcatctccggttctaacagcttttccttcatcgagtcacctgggaagggctacgctattgtcgatgagccattcagcgaaatacccagacaaggatttctcggcgagatcaggtgcaatagtgaatcttccgtgctgagcgcccacgagtcgtgtcttcgtgcacctaacttggtttcatataaaccaatgattgaccagctggaatgcactaccaatctcatcgatcccttcgtggtatttgagcgggggtctctgccgcagacacgaaacgacaagaccttcgcggccagtaaaggaaatagaggcgtccaggctttttccaagggtagcgtgcaagccgatttaactctgatgttcgacaactttgaggtggatttcgtcggggcagctgtttcttgtgacgccgcatttcttaatttgacaggatgctacagctgtaacgccggcgctagggtgtgcctctccattacgtcaaccggtactggcacactgagtgcgcacaacaaggatgggagcctacatatcgtactgccttctgaaaatggaaccaaagaccagtgccagatactccacttcacagtgccagaggtcgaagaggaatttatgtattcctgtgacggcgatgagcgccccctgcttgtgaaggggactttgatcgccattgaccctttcgatgaccggagagaggcaggaggcgaatcaaccgttgtgaaccccaaaagtggtagctggaactttttcgattggttctccgggctgatgtcttggtttggaggcccattaaagacgatcctcctgatttgcctttacgtcgctctgtcgatcggtttgttctttctcctgatatacctaggcaggaccgggctgagcaaaatgtggctcgccgccacaaagaaggcttcatga

SEQ ID NO: 11300 - RNA, 3204 nt, synthetic construct
  misc_feature 1..3204: note = derived and/or modified CDS sequence (opt3) from RVFV(Kenya 56 (IB8))__DQ380190.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacagggcgacgcaacttgcaaacccgtaacgtatgccggggcttgtagctccttcgatgtgttgttagaaaagggaaaatttcctctgttccaatcttacgcacaccatcggaccctactcgaggccgtccacgacacaataatcgctaaggccgatccaccctcatgcgacctgcagagtgcgcatggcaacccttgtatgaaagaaaaacttgtgatgaagactcactgcccaaaggattatcagagcgcacactacctgaataacgacggtaagatggcctccgttaaatgtccccctaagtatgagttgaccgaagattgcaatttttgtcgccagatgacaggggcttctctcaaaaagggatcgtacccactgcaagacctgttctgccagtcaagcgaggatgacggcagtaagctcaaaaccaagatgaaaggcgtgtgtgaggtcggggtgcaggccttaaagaaatgcgatggacagctgtccactgcacatgaagtagttccgtttgctgtgttcaagaactctaaaaaggtctatcttgacaagttggacctgaaaacagaggaaaatctactccccgatagctttgtgtgtttcgagcacaagggtcaatacaaaggcaccatggactccgggcagacgaagcgagagctgaaatcatttgatattagtcagtgccctaagatcggaggccatggtagcaagaaatgcactggggacgccgcgttctgttctgcctacgaatgcaccgcacagtatgctaacgcctactgttcccacgctaatggatcaggcattgtgcaaatccaggtcagcggcgtttggaagcgtccactttgcgtggggtatgagagagtagtggtcaaaagggaactgagtgccaagcccatacagcgggtggagccttgtacaacttgcatcaccaaatgtgaaccacacggattggttgtgcgctctacaggttttaagatttccagcgcagtcgcctgcgcttcgggcgtgtgtgtaaccgggtctcaatccccctcaacggagatcactctcaagtacccgggaatgagtcagagctccggcggtgatattggggttcatatggcgcacgacgatcagtctgtgagctcaaaaatcgtcgcacattgccctccccaggacccatgtctggtgcacggctgcatagtctgcgcccatggattaattaactatcaatgtcacacagctctgagtgccttcgtggttgtgttcgtattttccagcgtcgcaatcatttgcctcgccatcctttacaaggtgctgaaatgtttgaagatcgctcctagaaaagttctaaatcccctgatgtggattaccgccttcataaggtgggtgtataagaagatggtcgcacgggtggcggataacatcaatcaggtaaaccgcgagattggctggatggaagggggacagccagctctcggtaatcccgcccctatcccacgacacgcaccgatacccagatactctacttacctgatgcttctgttgattgtgtcatatgccagtgcttgcagcgagctcatccaggcctcctctaggatcacaacctgttcgacggaaggcgttaacaccaaatgccggctgagcgggacagcattaattcgtgctggatccgtcggcgccgaggcgtgtctgatgctaaagggtgtgaaagaagaccaaactaagtttctcaaaatcaagaccgtgtcaagtgagctgtcttgccgcgaggggcagagctactggacaggctccttctcacctaaatgtcttagctctagaaggtgccatttggtcggagaatgtcacgttaaccggtgcctgtcctggcgagataatgagaccagtgccgaatttagcttcgtgggcgagtctactacaatgcgcgaaaacaagtgctttgagcagtgtgggggatggggttgcggctgtttcaatgtgaacccatcctgcctctttgtacatacctatctgcagtcagtcagaaaggaggctcttagggtgttcaattgtattgactgggttcacaaactgactttggaaataacggactttgatgggagtgtgagcacaatcgacctcggagcatcgtcctctcggttcaccaactggggcagcgtctcactgagtttagatgccgagggtatttccgggtctaatagcttttccttcatcgaatcacccggcaagggatacgctatcgtggacgagcctttcagcgagattccacgccaaggctttctgggggaaataagatgcaacagtgagtcttccgttctaagcgcccacgaatcgtgtctcagggcacccaatctgatctcatataaaccgatgattgatcagcttgagtgcactaccaacttgatcgaccctttcgtggcgtttgaacgtggatctctgccacagacacggaatgataagaccttcgccgctagtaaaggcaaccgaggtgtacaggccttttccaaggggagcgtccaagcagacctcactctgatgttcgataattttgaggtggacttcgtgggagctgccgtctcttgtgatgcagcctttttaaacctgacaggctgctacagctgtaatgctggtgcgagagtttgcctttccattacgtcaaccggcactgggacattgagtgcccataacaaggacggaagcctccacatcgtgctgccctctgagaacggcaccaaagatcagtgccagatactacatttcacagtacctgaagtggaggaagagtttatgtattcctgtgacggggacgaaaggcccctgctcgtcaagggaactctgatcgcaattgatccattcgacgatcgccgggaggctggcggtgagtcaaccgtggttaatcctaaaagtgggagctggaactttttcgactggttctccggacttatgtcttggtttggcggtcccttgaagacgatcctgttaatttgcctctacgtggccctgtcgatcggccttttctttctgttgatatacctcgggagaaccggactgagcaaaatgtggctagccgctacaaagaaggcatcatga

SEQ ID NO: 11301 - RNA, 3204 nt, synthetic construct
  misc_feature 1..3204: note = derived and/or modified CDS sequence (opt3) from RVFV(KEN/Gar-008/06)__HM586965.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagccgtgtttggaaaaagccactttgcgtgggctatgaaagagtagtggtcaaaagggagctgagtgccaagcccatacagcgggtggaaccttgtacaacttgcatcaccaaatgtgagccacacggcttggttgtgcgctctacagggtttaagatttccagcgcagtcgcctgcgcttcgggagtgtgtgtaaccggttctcaatccccctcaacggagatcactctcaagtacccgggcattagtcagagctccgggggagatatcggcgttcatatggcgcacgacgatcagtctgtgagctcaaaaatagtcgcacattgccctccccaggacccatgtctggtgcacggttgcattgtctgcgcccatgggttaatcaattatcaatgtcacacagctctgagtgccttcgtggttattttcgtgttttccagcaccgcaatcatctgcctcgccgtactttacagagtcctgaagtgtttgaaaattgctcctaggaaggtgctaaaccccctgatgtggataactgccttcatccggtgggtttataaaaagatggtggcacgcgtcgcggataatattaaccaggtgaatcgagaaatcggctggatggagggaggccagctcgctctggggaacccagcccccatacctagacacgcaccaattccgaggtactctacataccttatgctgttgctcatcgtatcatatgccagtgcttgcagcgaactgatccaggcctcctctcggattaccacgtgttcgaccgagggagtgaacacaaagtgccgtttaagcggtactgcactgatccgcgctggctccgttggggccgaagcgtgtctaatgctcaaaggagtcaaggaggaccaaaccaaatttctgaagattaaaacagtgtcaagtgagctttcttgcagagaaggccagagctactggactggttccttctcacccaagtgtttgagctctaggcggtgccatctggtgggggagtgtcacgtcaatcgatgcctctcctggcgcgataacgaaaccagtgccgagtttagcttcgttggcgaatctacaaccatgagagagaataaatgctttgagcagtgtggaggctgggggtgcggatgtttcaacgtgaatccttcctgcctgtttgtgcatacttatcttcagtcagtaaggaaggaagctctgcgggtcttcaactgtatagactgggtgcacaagttgacgctcgagatcacagactttgatggtagtgttagcaccattgacctgggcgcatcgtcctctcgcttcactaattgggggagcgtgtcattaagtctggatgccgaaggaatctccggctctaacagcttttccttcatcgagtcaccaggtaaagggtacgctattgtcgacgagcccttcagcgaaatacctagacaaggctttctaggagagatcaggtgcaatagtgaatcttccgtgctcagcgcccacgagtcgtgtctgcgtgcaccaaaccttgtttcatataagcccatgattgatcagttggaatgcaccacaaatctgatcgacccgttcgtggtatttgagcggggctctctccctcagacccgaaacgataaaactttcgcggccagtaaggggaatagaggagtccaggctttttccaaaggcagcgtgcaagccgacctgacattaatgttcgataacctgaaggtggactttgtcggtgcagctgtttcttgtgatgccgcattccttaatttgacggggtgctacagctgtaacgccggagctagggtgtgcctctccattacctcaactggcacaggtaccctgagtgcgcataacaaggacggcagcctacacatcgtactgccatctgagaatgggacaaaagatcagtgccagatactccattttactgtgcccgaagtcaaggaggagttcatgtattcctgtgacggagacgaacgcgccctgcttatgaaaggcaccttgatcgcaattgatccttttgacgatcggagagaagctgggggagagtcaacggtggttaaccccaagagtggcagctggaatttctttgactggttctccggtctgatgtcttggttcgggggaccattaaaaaccatcctcctgatttgcctttacgtggccctgtcgatcggcttgtttttcctcctgatatacctaggtaggacaggcctgagcaagatgtggctcgccgctactaagaaagcatcatga

SEQ ID NO: 11302 - RNA, 3204 nt, synthetic construct
  misc_feature 1..3204: note = derived and/or modified CDS sequence (opt3) from RVFV(KEN/Bar-035/07)__HM586969.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtcggttgcaggaagacgcaacatgcaaacccgtaacttatgccggcgcttgtagctccttcgatgtgttactggagaaggggaaatttcctctattccaatcttacgcacaccatcgcacgctcctggaagccgtccacgacaccataatcgctaaggccgatccaccctcatgcgaccttcagagtgcggatggaaacaaatgtatgaaggagaagctggtgatgaaaacacattgccctaatgactatcagagcgcacactacttgaacaatgatggcaagatggcctccgttaaatgtccacccaagtatgaactcactgaggactgcaacttttgtcgacagatgaccggtgcttctctgaaaaaggggtcgtaccctctgcaagatctcttctgccagtcaagcgaggacgatggaagtaagttaaaaacaaagatgaaaggcgtgtgtgaagtcggcgtgcaggccctgaagaaatgcgacgggcagctttccaccgcacacgaggtagttccatttgctgtgttcaagaatagtaaaaaggtctatttggacaagctggatctaaaaactgaagagaacctcctgccggacagctttgtgtgtttcgagcataagggacaatacaaaggtacaatggattccggccagaccaagcgtgaacttaaatcatttgacattagtcagtgccccaagatcgggggacacggcagcaagaaatgcacgggtgatgccgcgttctgttctgcctacgagtgcactgcacagtatgctaatgcctactgttcccatgctaacgggtcaggaattgtgcaaatccaggtcagcggcgtttggaagaaacctctgtgcgtgggctatgaaagagtagtggtcaagagggagttgagtgccaaaccaatacagcgggtggaaccctgtaccacatgcatcactaagtgtgagcctcacgggctcgttgtgcgctctaccggatttaagatttccagcgcagtcgcctgcgcttcgggtgtgtgtgtaacaggctctcaatccccatcaaccgagatcacgctgaaataccccgggattagtcagagctccggaggcgacatcggtgttcacatggcgcatgatgaccagtctgtgagctcaaagatagtcgcacactgcccgcctcaggatccctgtttagtgcatgggtgcattgtctgcgcccacggcctgatcaattatcaatgtcatactgctctcagtgccttcgtggttattttcgtgttttccagcacagcaatcatctgccttgccgtactgtacagagtcttgaaatgtctaaagattgctccaaggaaagtgctgaaccctctcatgtggataaccgccttcatccggtgggtttataagaagatggtggcacgcgtcgcggacaatattaaccaggtgaatcgagaaatcggatggatggagggcgggcagctggctcttggaaaccccgccccaatacccagacacgcacctattccaaggtactctacttacctgatgttgctcctgatcgtatcatatgccagtgcttgcagcgaattaatccaggcctcctctcggattacaacctgttcgacggagggtgtgaacaccaaatgccgtctgagcggcacagcactaatccgcgctagatccgttggggccgaagcgtgtctcatgctgaagggagtcaaagaggatcaaactaagtttcttaaaattaagaccgtgtcaagtgagttgtcttgcagggaaggccagagctactggacaggttccttctcaccgaaatgtctgagctctcggcgatgccacctcgtgggggagtgtcatgtcaatcgctgcctgtcctggagagacaacgaaacttctgccgagtttagcttcgttggcgaatctaccacaatgagggagaataagtgctttgagcagtgtggaggctgggggtgcggatgtttcaacgtgaatccctcctgcctttttgtgcacacctatctgcagtcagtacggaaggaggctttgcgcgtcttcaactgtatagactgggtgcataaactcactctggaaatcacggattttgacggtagtgttagcacaattgatttaggcgcatcgtcctctagattcaccaattgggggagcgtgtcactgagtctagacgccgaaggaatctccggctctaacagcttttccttcatcgagtcacctggtaaggggtacgctattgtcgatgagccattcagcgaaatacccaggcaaggctttctcggagagatccgttgcaatagtgaatcttccgtgctgagcgcccacgagtcgtgtcttcgggcacctaacttggtttcatataaaccaatgattgaccagctggaatgcactaccaatctcatcgatcccttcgtggtatttgagcgaggctctctgccgcagacaagaaacgacaagaccttcgcggccagtaaagggaataggggagtccaggctttttccaagggcagcgtgcaagccgatttaactctgatgttcgacaactttgaggtggatttcgtcggtgcagctgtttcttgtgacgccgcatttcttaatttgacagggtgctacagctgtaacgccggagctcgcgtgtgcctctccattacgtcaaccggcactggtacactgagtgcgcacaacaaggatggcagcctacatatcgtactgccttctgaaaatgggaccaaagaccagtgccagatactccacttcacagtgccagaggtcgaagaggaatttatgtattcctgtgacggagatgagcggcccctgcttgtgaagggcactttgatcgccattgaccctttcgatgacagaagggaggcagggggagaatcaaccgttgtgaaccccaaaagtggcagctggaactttttcgattggttctccggtctgatgtcttggtttgggggaccattaaagacgatcctcctgatttgcctttacgtcgctctgtcgatcggcttgttctttctcctgatatacctaggtcgcaccggcctgagcaaaatgtggctcgccgccacaaagaaggcttcatga

SEQ ID NO: 11303 - RNA, 3204 nt, synthetic construct
  misc_feature 1..3204: note = derived and/or modified CDS sequence (opt3) from RVFV(Smithburn)__DQ380193.1__Gn-Gc
  source 1..3204: mol_type = other RNA
atggccggcatcgctatgaccgtgttccccgcactggtcgtttttgccctcgcgcctgtggtattcgctgaggacccacaccttagaaacaggccggggaagggacataattacattgatggtatgacacaggaagacgccacttgcaaacccgtgacgtatgcaggcgcctgtagctcctttgatgtcctgttggagaaggggaaattccctttatttcaatcttacgctcaccatcggaccctgctagaagcagtgcacgacataatcattgccaaggctgatccaccctcatgcaacctccagagtgcccatggaaatccttgtatgaaagagaagctggttatgaagacatattgcccaaacgactaccagagcgcgcactatcttaataacgatggcaaaatggcatccgtgaagtgtccccctaaacacgaactgactgaggactgcaatttctgtcgccagatgaccggtgcctctttgaaggaggggtcgtacccactccaagatctgttttgccagtcaagcgaagacgatggaagtaaactgaagacaaagatgaaaggcgtctgtgaggtgggcgtacaggttctcaagaaatgcgacgggcagttatccaccgctcatgaagtggtcccgttcgccgtgtttaagaactctaaaaaggtgtatctggataaacttgacttgaagactgaggagaatctgctacccgacagcttcgtctgttttgaacacaagggacaatacaaaggtacaatggattccggccagatcaagcgagagctcaaatcattcgacattagtcagtgccctaagatcgggggacatggcagcaaaaagtgcaccggtgatgcagctttttgttctgcctacgaatgcacggcgcagtatgccaacgcatactgttcccacgctaatgggtcaggaatagttcaaatccaggtgagcggcgtatggaagaaaccactgtgcgtgggctatgagcgtgtcgtggttaagagagaacttagtgccaaacccattcagagggtggagccttgtactacctgcatcacaaagtgtgagccacacgggctggtcgtgcggtctactggattcaaaatttccagcgctgtagcctgcgcatcgggtgtttgtgtgaccggctctcaatccccctcaacagaaatcaccttgaagtacccggggataagtcagagctccggaggcgacattggtgtccatatggcccacgatgaccagtctgtgagctcaaagatcgtcgctcattgccctccccaggatccatgtctcgtgcacgggtgcattgtttgcgcgcatggcctgatcaactatcaatgtcacacggcattcagtgcctttgtggtagtcttcgtgttttccagcgttgtgatcatttgcttagctatactgtacaaagtcctcaagtgtcttaaaatcgcccctcgcaaggtgctgaatcccttgatgtggattactgcattcatcagatgggtatataaaaagatggtggccagggttgctgacaacataaatcaggtcaaccgggagattggatggatggaaggcgggcagctagtgctgggaaacccagcccccatccctcgccacgcaccaatcccgcgatactctacatacctcatgctgcttctgattgtgtcatatgcgagtgcttgcagcgagttgatccaggcctcctctagaattaccacttgttcgacagaaggtgtcaataccaagtgcaggctcagcggcacggcactgatacgggccgggtccgttggagctgaggcctgtttaatgctgaaaggcgtgaaggaggatcaaaccaaatttctaaagatcaaaacagtgtcaagtgaactctcttgccgtgagggtcagagctactggactgggtccttctcacccaagtgtctgagctctcgcagatgccatcttgtaggcgaatgtcacgtcaacaggtgcttgtcctggcgggacaatgagaccagtgcagaatttagcttcgtgggagagtctacaactatgcgagagaacaaatgctttgaacagtgtggcgggtggggatgcggttgtttcaatgttaacccttcctgcctgtttgtgcatacctatctccagtcagtccgcaaggaggctctgagagtgttcaattgtattgattgggttcacaaacttacactggaaatcaccgactttgacggcagtgtgagcactgtagatttgggggcctcgtcctctaggttcacgaactggggaagcgtctcactcagtctggacgcggagggcatctccggttctaatagcttctcctttattgagtcaccagggaagggctacgccatagtggatgaacccttcagcgagatccctcggcaaggatttttaggcgaaattcgctgcaacagtgagtcttccgtgctgagcgctcacgaatcgtgtctaagagcaccaaatctcatctcatataagcccatgattgaccagctggagtgcacaaccaaccttatcgatccgttcgtcgtttttgagagggggtctttgcctcagactcgtaatgacaaaaccttcgccgctagtaagggaaaccggggcgtgcaggccttttccaaaggtagcgtacaagcagatctgacactcatgttcgacaattttgaagtggatttcgtcggggcggccgtgtcttgtgacgctgcctttctgaacttaaccggatgctacagctgtaacgcaggcgctcgagtttgcctgtccataacttcaacaggtacgggcacccttagtgcccataataaggatgggagcttgcacatcgtgctcccatctgagaacggaactaaggaccagtgccagattctgcatttcacagtccccgaagtggaggaagagtttatgtattcctgtgatggcgacgagagacctctactggttaaagggaccctcatcgcaattgaccccttcgatgacaggcgcgaagccggaggcgagtcaacagtggtcaatccaaagagtggtagctggaacttctttgattggttctccgggctgatgtcttggtttggaggccctcttaaaactatcttgctgatatgcttatacgtagctctctcgattggtctgttctttttccttatctacctgggccggaccgggttgagcaagatgtggctcgcggccacgaaaaaggcatcatga

SEQ ID NO: 11304 - RNA, 3204 nt, synthetic construct
  misc_feature 1..3204: note = derived and/or modified CDS sequence (opt3) from RVFV(Beijing-01)__KX611606.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtgtaacacaggaagacgcaacttgcaaacccgtgacgtatgccggcgcttgtagctccttcgatgtcttgttagagaaggggaaatttcctctgttccaatcttacgcacaccatcggaccctactcgaagccgtgcacgacacaataatcgctaaggccgatccaccctcatgcgacctgcagagtgcgcatggaaacccttgtatgaaagagaaacttgttatgaagactcactgcccaaatgattatcagagcgcacactacctgaacaatgacggcaaaatggcctccgtgaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtctgtgaagtgggcgtacaggccttaaagaagtgcgatgggcgactgtccactgcacatgaggttgtgccgtttgctgtcttcaaaaattctaagaaagtgtatcttgacaagttggacctgaagacagaagagaacctactccccgatagctttgtgtgtttcgagcacaaaggacagtacaagggtaccatggactccggccaaacgaaacgtgaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtccagatccaagttagcggcgtgtggaaaaagccactttgcgtaggctatgaaagagtggtcgtgaaaagggagctgagtgccaagcccatacagcgggttgaaccttgtacaacttgcatcaccaaatgtgagccacacgggttggtggtccgctctacaggatttaagatttccagcgcagtggcctgcgcttcgggtgtatgtgttaccggctctcagtccccctcaacggagatcactctcaagtacccggggattagtcaaagctccggaggcgatatcggtgtgcatatggcgcacgacgatcagtctgtcagctcaaaaatagtgttcgactgccctccccaggatccatgtctggtccatgggtgcattgtgtgcgcacacggcttaatcaattatcagtgtcatacagccctgagtgctttcgttgtggtatttgtcttctccagcgtggccattatctgcctcgcaatcctttacaaggttctgagatgtttgaaaattgcccctaagaaagtgctaaaccccctgatgtggataaccgcttttatcaggtgggtctataagaagatggtggcccgggtagcagacaatattaaccaagtgaatcgcgaaatcggatggatggagggcgggcagctcgcgctgggaaacccagctcccatacctcgacacgccccaattccgagatactctacttaccttatgctgttgctcatcatctcatatgcaagtgcctgcagcgaactgattcaggcttcctctaggatcacaacctgttcgacggagggtgttaacaccaaatgccggttaagcggcacagccctgattcgtgcagggtccgtcggagctgaagcctgtctaatgttcgagggcgtgaaggaggatcagactaaatttctcaagataaaaaccgtgtcaagtgaactgtcttgccgcgagggtcaaagctactggacagggtccttctcacccaagtgtcttagctctagaaggtgccacttggtcggcgaatgtcatgttaatcggtgcctgtcctggcgagacaacgagacaagtgcggaatttagcttcgtgggagagtctaccacaatgcgcgagaataaatgctttgaacagtgtggcgggtggggatgcggttgtttcaacgtgaatccttcctgcctctttgtacacacctatctgcagtcagtcagaaaggaggcccttagggtgttcaactgtatcgactgggttcataagctgactttggaaattacggattttgacggcagtgtgagcacaatcgatctcggggcttcgtcctctcggttcaccaattggggaagcgtctcactgagtttagacgcagagggcatctccggttctaacagcttctcctttattgagtcaccagggaaaggctacgccatagtggatgaacccttcagcgagatccctcgccagggatttctgggcgaaattagatgcaatagtgagtcttccgttctaagcgctcacgaatcgtgtctcagggccccaaacctgatctcatataagcccatgattgaccaacttgagtgcactaccaatttgatcgatccgttcgtggtatttgagcgtgggtctctgcctcagacacggaacgacaaaaccttcgcagcgagtaagggaaatcgaggcgtccaggccttttccaaaggtagcgtgcaggctgatctcactctgatgttcgacaactttgaagtggatttcgtcggggccgcagtttcttgtgacgctgcctttttaaatctgacaggatgctacagctgtaacgcaggcgccagagtgtgcctttccataacgtcaaccggtactggcacattgagtgctcacaacaaggatgggagcctccatatcgtactgccatctgagaatggaaccaaggaccaatgccagattctacacttcacagtgcccgaagtcgaggaagagtttatgtattcctgtgacggcgatgagaggcctctgctcgtgaaagggactctgatcgcgattgaccccttcgatgaccgccgggaagccggaggcgagtcaaccgttgtgaacccaaagagtggtagctggaatttctttgattggttctccgggcttatgtcttggtttggaggccctttgaaaacgatcctgttaatatgcctctacgtcgcactgtcgattggtcttttctttctgttgatctacctcggcagaaccgggctgagcaagatgtggctagctgccactaaaaaggcctcatga

SEQ ID NO: 11305 - RNA, 3204 nt, synthetic construct
  misc_feature 1..3204: note = derived and/or modified CDS sequence (opt3) from RVFV(KEN/Bar-032/07)__HM586968.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaataggccggggaagggacataattacattgatggtcggttgcaggaagacgcaacatgcaaacccgtaacttatgccggcgcttgtagctccttcgatgtgttactggagaaggggaaatttcctctattccaatcttacgcacaccatcgcacgctcctggaagccgtccacgacaccataatcgctaaggccgatccaccctcatgcgaccttcagagtgcggatggaaacaaatgtatgaaggagaagctggtgatgaaaacacattgccctaatgactatcagagcgcacactacttgaacaatgatggcaagatggcctccgttaaatgtccacccaagtatgaactcactgaggactgcaacttttgtcgacagatgaccggtgcttctctgaaaaaggggtcgtaccctctgcaagatctcttctgccagtcaagcgaggacgatggaagtaagttaaaaacaaagatgaaaggcgtgtgtgaagtcggcgtgcaggccctgaagaaatgcgacgggcagctttccaccgcacacgaggtagttccatttgctgtgttcaagaatagtaaaaaggtctatttggacaagctggatctaaaaactgaagagaacctcctgccggacagctttgtgtgtttcgagcataagggacaatacaaaggtacaatggattccggccagaccaagcgtgaacttaaatcatttgacattagtcagtgccccaagatcgggggacacggcagcaagaaatgcacgggtgatgccgcgttctgttctgcctacgagtgcactgcacagtatgctaatgcctactgttcccatgctaacgggtcaggaattgtgcaaatccaggtcagcggcgtttggaagaaacctctgtgcgtgggctatgaaagagtagtggtcaagagggagttgagtgccaaaccaatacagcgggtggaaccctgtaccacatgcatcactaagtgtgagcctcacgggctcgttgtgcgctctaccggatttaagatttccagcgcagtcgcctgcgcttcgggtgtgtgtgtaacaggctctcaatccccatcaaccgagatcacgctgaaataccccgggattagtcagagctccgttggagacatcggcgtgcacatggcgcatgatgaccagtctgtcagctcaaagatagtggcacactgcccgcctcaggatccctgtttagtccatggttgcattgtgtgcgcccacgggctgatcaattatcaatgtcatactgctctcagtgccttcgttgtgattttcgtattttccagcacagcaatcatctgccttgccgtcctgtacagagtgttgaaatgtctaaagattgctccaaggaaagttctgaaccctctcatgtggataaccgccttcatccggtgggtgtataagaagatggtcgcacgcgtggcggacaatattaaccaggtaaatcgagaaatcggctggatggagggaggccagctggctcttgggaaccccgccccaatacccagacacgcacctattccaaggtactctacttacctgatgttgctcctgatcgtgtcatatgccagtgcttgcagcgaattaatccaggcctcctctcggattacaacctgttcgacggagggagttaacaccaaatgccgtctgagccacacagcactaatccgcgctggttccgtcggcgccgaagcgtgtctcatgctgaagggggtgaaagaggatcaaactaagtttcttaaaattaagaccgtgtcaagtgagttgtcttgcagagaaggacagagctactggacaggctccttctcaccgaaatgtctgagctctaggcggtgccatctcgtcggtgagtgtcacgttaatcgatgcctgtcctggcgcgacaacgaaacttctgccgagtttagcttcgtgggggaatctaccacaatgagagagaataagtgctttgagcagtgtggcggatggggctgcgggtgtttcaacgtgaatccctcctgcctttttgtacatacctatctgcagtcagtcaggaaggaggctttgcgggtgttcaactgtatagactgggttcacaaactcactctggaaatcacggattttgacggaagtgtgagcacaattgatttaggtgcatcgtcctctcgcttcaccaattggggcagcgtctcactgagtctagacgccgaagggatctccggatctaacagcttttccttcatcgagtcacctggcaagggttacgctattgtggatgagccattcagcgaaatacccagacaagggtttctcggcgagatcaggtgcaatagtgaatcttccgttctgagcgcccacgagtcgtgtcttcgtgcacctaacttggtgtcatataaaccaatgattgaccagctggaatgcactaccaatctcatcgatcccttcgtagtctttgagcggggatctctgccgcagacacgaaacgacaagaccttcgcggccagtaaaggcaatagaggggtgcaggctttttccaagggaagcgtgcaagccgatttaactctgaggttcgacaactttgaggtcgatttcgttggcgcagctgtgtcttgtgacgccgcatttcttaatttgacaggttgctacagctgtaacgccggggctcgcgtatgcctctccattacgtcaaccggaactggcacactgagtgcgcataacaaggatggtagcctacacatcgtgctgccttctgaaaatggcaccaaagaccagtgccagatactccatttcacagtcccagaggtggaagaggaatttatgtattcctgtgacggggatgagcggcccctgcttgttaagggaactttgatcgccattgaccctttcgatgacagaagggaggcaggcggggaatcaaccgtggtcaaccccaaaagtggaagctggaactttttcgattggttctccggcctgatgtcttggtttggtgggccattaaagacgatcctcctgatttgcctttacgtggctctgtcgatcggattgttctttctcctgatatacctaggccgcaccggtctgagcaaaatgtggctcgccgccacaaagaaggcttcatga

SEQ ID NO: 11306 - RNA, 3204 nt, synthetic construct
  misc_feature 1..3204: note = derived and/or modified CDS sequence (opt3) from RVFV(TAN/Dod-002/07)__HM586971.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggccgtaagaagtgcactggtgacgccgcgttctgtagcgcctacgagtgcaccgcacagtatgctaatgcctactgttctcacgctaacgggtccggaattgtgcaaatccaggtctcaggcgtttggaaaaagccactttgcgtgggctatgaaagagtagtggtcaaaagggagctgagcgccaagcccatacagcgggtggaaccttgtacaacttgcatcaccaaatgtgagccacacgggttggttgtgcgcagtacaggatttaagatttcttccgcagtcgcctgcgctagcggtgtgtgtgtaaccggctcgcaatctccctccacggagatcactctcaagtacccggggatttcacagagtagcggaggcgatatcggtgttcatatggcgcacgacgatcagtccgtgtctagcaaaatagtcgcacattgccctccccaggacccatgtctggtgcacgggtgcattgtctgcgcccaggcttggatcatttcacaatggcatacagccttaagtgcattcgtggttatcttcgtgttttccagcaccgccatcatttgtctggctgtactctatagagtccttaagtgcctgaaaatagcccctaggaaggtgttgaatcccctaatgtggatcactgcattcattcggtgggtttacaaaaagatggtggcgcgcgtcgctgataacatcaatcaggtgaaccgagaaataggctggatggagggaggccagctggccctcgggaatccagcacccattcctagacacgccccaatcccgaggtattctacatacctgatgcttctgttgatcgtatcatacgctagtgcctgtagcgaactcattcaagcatcctctcggatcaccacgtgctcgaccgagggagtgaacacaaagtgtcgtctgagcggtactgctttaattcgcgccggctccgttggggcggaagcctgcctgatgctaaaaggagtcaaggaggaccagaccaaatttctcaagataaaaacagtgtcaagtgagctgtcttgtagagaaggccagagctattggactggttccttctcacccaagtgccttagctctaggcggtgtcacttggtgggggagtgccatgtcaaccgatgtctgtcctggcgcgataatgaaaccagtgctgagtttagcttcgttggcgaatctacaaccatgagagagaacaaatgctttgagcagtgcggaggctgggggtgtggatgcttcaatgtgaacccttcctgtctctttgtgcacacttacctgcaatcagtaaggaaggaagcacttcgggtcttcaattgcatcgactgggtgcataagctgacgttggagattacagactttgatggtagtgttagcaccatcgacctcggcgcctcgtcctctcgcttcactaactgggggagcgtgtcactgagtttagatgctgaaggaatctccggctctaatagcttttccttcattgagtcaccaggtaaagggtatgccatagtcgacgagcccttcagcgaaatccctagacagggctttctgggagagattaggtgtaacagtgaatcttccgtgctaagcgcacacgagtcgtgcctccgtgcgccaaatctggtttcatacaagcccatgatcgatcagcttgaatgtaccacaaacttgattgacccgttcgtggtatttgagcggggctctctgcctcagacccgaaatgataaaactttcgccgctagtaaggggaacagaggagtccaagccttttccaaaggcagcgtgcaggcagacctcacactgatgttcgataattttgaggtggacttcgtcggtgctgccgtttcttgcgatgcagcctttttaaacctgacggggtgttatagctgcaatgctggagcgagggtgtgtctttccatcacctcaactggcacaggtaccttgagtgcccacaacaaggacggcagcctccatatagtactgccatctgaaaacgggacaaaggatcagtgccaaatcctacacttcactgtgcccgaggtcgaagaggaatttatgtactcctgcgacggagacgagcgccctctgctcgtgaaaggcaccctgattgcaatcgatcccttcgacgatcggagagaggctgggggagaatcaacggttgtgaatccaaagagtggcagctggaactttttcgactggttctccggtcttatgtcttggtttgggggacctttgaaaaccattctgttaatctgtctctatgtcgccctgtcgataggccttttctttctgttgatttacctcggtaggacaggcctgagcaagatgtggctagccgctactaaaaaggcatcatga

SEQ ID NO: 11307 - RNA, 3204 nt, synthetic construct
  misc_feature 1..3204: note = derived and/or modified CDS sequence (opt3) from RVFV(KEN/Gar-004/06)__HM586964.1__Gn-Gc
  source 1..3204: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccctgaaaaagtgcgatgggcagttatccactgcacatgaggtagttccgtttgctgtgttcaaaaattctcaaaaggtctatcttgacaaattggacctgaagacagaagagaacctactccccgatagctttgtgtgtttcgagcacaagggacagtacaaaggtaccatggactccggccagacgaagcgagaactgaaatcatttgatattagtcagtgccctaagatcgggggacatggccgtaaaaagagaactggtgacgccgcgttctgcagcgcctacgagtgtaccgcacaatatgctaatgcctactgctctagggctaacgggtccggaattgtgcagatccaggtctcacgggtttggaagaaaccactttgtgtgggctatgaacgcgtagtggtcaagagagagctgagcgccaaacccatacaaagggtggaaccttgcacaacttgtatcaccaagtgcgagccacacggcttggttgtgcggagtacagggtttaaaatttcttccgcagtcgcctgtgctagcggagtgtgcgtaaccggttcgcagtctccctccacggagatcactctcaagtacccgggcatttcacagagtagcgggggagatatcggcgttcacatggcgcatgacgatcagtccgtgtctagcaagatagtcgcacactgtcctccccaagacccatgcctggtgcatggttgtattgtctgcgcccacgggttaatcaataaccagtcacatagtgctctgtccgccttcgtggttattttcgtgtttagctctacagcaatcatctgcctcgccgtactttatcgcgtcctgaaatgtttgaagattgctcctcgaaaagtgctaaatcccctgatgtggataaccgccttcatcagatgggtttacaagaaaatggtggcaagggtcgcggataacattaatcaggtgaaccgggaaatcggctggatggagggaggccagctcgctctggggaacccagcccccatacctcgtcacgcaccaattccgcgctattcaacttaccttatgctgttgctcatcgtaagttacgccagcgcttgctccgaactgatccaagcctcttcgagaattacaacctgtagcacggagggagtgaataccaagtgcaggttatccggtacagcactgatccgggctggctcagttggggccgaagcgtgtctaatgctcaagggagtcaaagaggaccagactaagtttctgaaaattaagaccgtgagttctgagcttagctgccgagaaggccagtcctattggacaggttcattcagccccaaatgtttgtcttcccgcagatgccacctggtgggggagtgtcatgtcaacaggtgcctcagttggcgggataatgaaactagcgccgagttttctttcgttggcgaatccaccacaatgcgcgagaacaagtgttttgagcagtgcggaggctgggggtgcggatgtttcaatgtgaacccttcatgcctgtttgtgcacacctaccttcaaagtgtaagaaaagaagctctgagggtcttcaattgtatagactgggtgcataagttgactctcgagatcacggactttgatggtagcgtttcgacaattgacctgggcgcatcctctagccgtttcaccaactgggggtcagtgagtttatccctggatgccgaaggaatctctggcagcaattccttttcattcatcgagagcccaggtaaggggtatgctattgtcgacgagcccttcagtgaaatacctcggcagggctttctaggagagatccgatgcaactctgaatccagcgtgctctcggcccacgagtcatgtctgagagcaccaaatcttgtttcttacaaacccatgattgatcagttggaatgcactaccaacctgatcgacccgttcgtggtatttgagaggggcagtctccctcagacacgcaatgataagaccttcgcggcctccaaagggaaccggggagtccaggcttttagcaagggctctgtgcaagccgacctgactttaagattcgataattttgaggtggacttcgtcggtgcagctgttagctgtgatgccgcatttctgaaccttacagggtgctattcctgtaacgccggagctagggtgtgcttgtcaattacgagtaccggcactggtacactcagcgcgcacaataaagacggctctctgcatatcgtactaccatccgaaaacgggaccaaggatcagtgtcaaatactgcacttcacagtgcccgaggtcgaagaggaatttatgtactcatgcgacggagacgagcgccctctcctggtgaagggcactcttatcgccattgatcccttcgacgatcgacgggaggcagggggagaaagtaccgttgtgaatccaaaaagcggctcctggaactttttcgactggttctctggtttgatgtcgtggtttgggggacctctgaagacgatcttactcatttgcctgtatgtcgctcttagcatcggcctgttctttttgctcatatacctgggtcgtaccggcctatcaaaaatgtggctggccgccacaaagaaggcttcctga

SEQ ID NO: 11308 - RNA, 1680 nt, synthetic construct
  misc_feature 1..1680: note = derived and/or modified CDS sequence (opt3) from RVFV(ZH-548)__DQ380206.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcttagtgcgcatggaaacccttgtatgaaagagaagctggtgatgaagactcactgcccaaatgattatcagagcgcacactacttgaacaatgacggcaaaatggcctccgttaagtgtccccctaaatatgaactcaccgaggattgcaacttttgtcgccagatgacaggtgcttctctgaagaaagggtcgtacccactgcaggacctcttctgccaatcaagcgaggatgacggaagtaagttaaagaccaaaatgaagggcgtgtgtgaagtcggcgtgcaggccctgaaaaagtgcgatgggcagctttccactgcacatgaggtagttccgtttgctgtgttcaaaaattctaagaaagtctatttggacaagctggacctaaagacagaagagaacctcctgcccgatagctttgtgtgtttcgagcacaaaggacagtacaagggtaccatggactccggccaaacgaaacgagaacttaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcagatccaagtcagcggcgtttggaaaaagccactgtgcgtgggctatgaacgtgtagtggtcaaaagagagttgagtgccaagcccatacagagggtggaaccttgtacaacttgcatcaccaaatgtgagccacacgggctcgttgtgcggtctacaggatttaagatttccagcgcagtcgcctgcgcttcgggtgtgtgtgtaaccggctctcagtccccctcaacggagatcactctgaagtacccggggattagtcaaagctccggaggcgatatcggtgttcatatggcgcacgacgatcagtctgtgagctcaaaaatagtcgcacattgccctccccaggacccatgtttagtgcacgattgcattgtctgcgcccatgggctgatcaattatcagtgtcacacagctctcagtgccttcgtggttgtgttcgtattttccagcattgcaatcatctgccttgccattctgtaccgcgtcttgaagtgtctaaaaatagctcctagaaaggtgctgaaccccctcatgtggatcaccgccttcattaggtggatctataaaaagatggttgcacgggtggcggacaatataaaccaagtcaatcgcgaaattggctggatggagggaggccagctggtgcttgggaacccagctcccatccctcgacacgccccaatcccgagatactctacttacctgatgttgctcctgattgtatcatatgcaagtgcc

SEQ ID NO: 11309 - RNA, 1680 nt, synthetic construct
  misc_feature 1..1680: note = derived and/or modified CDS sequence (opt3) from RVFV(MP-12)__DQ380208.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcttagtgcgcatggaaacccttgtatgaaagagaagctggtgatgaagactcactgcccaaatgattatcagagcgcacaccatttgaacaatgacggcaaaatggcctccgttaagtgtccccctaaatacgaactcaccgaggattgcaacttttgtcgccagatgacaggtgcttctctgaagaaagggtcgtatccactgcaggacctcttctgccaatcaagcgaggatgacggaagtaagttaaagaccaaaatgaagggcgtgtgtgaagtcggcgtgcaggccctgaaaaagtgcgatgggcagctttccactgcacacgaggtagttccgtttgctgtgttcaaaaattctaagaaagtctacttggacaagctggacctaaagacagaagagaacctcctgcccgatagctttgtgtgtttcgagcataaaggacagtataagggtaccatggactccggccaaacgaaacgagaacttaagtcatttgatattagtcagtgccctaaaatcgggggacacggcagcaagaagtgcactggtgacgccgcgttctgttctgcctacgagtgcaccgcacagtacgctaatgcctattgttcccacgctaacgggtcaggaattgtgcagatccaagtcagcggcgtttggaaaaagccactgtgcgtgggctacgaacgtgtagtggtcaaaagagagttgagtgccaagcccatacagagggtggaaccttgtacaacttgcatcaccaaatgtgagccacatgggctcgttgtgcggtctacaggatttaagatttccagcgcagtcgcctgcgcttcgggtgtgtgtgtaaccggctctcagtccccctcaacggagatcactctgaagtatccggggattagtcaaagctccggaggcgatatcggtgttcacatggcgcatgacgatcagtctgtgagctcaaaaatagtcgcacactgccctccccaggacccatgtttagtgcatgattgcattgtctgcgcccacgggctgatcaattaccagtgtcacacagctctcagtgccttcgtggttgtgttcgtattttccagcattgcaatcatctgccttgccattctgtatcgcgtcttgaagtgtctaaaaatagctcctagaaaggtgctgaaccccctcatgtggatcaccgccttcattaggtggatctacaaaaagatggttgcacgggtggcggacaatataaaccaagtcaatcgcgaaattggctggatggagggaggccagctggtgcttgggaacccagctcccatccctcgacatgccccaatcccgagatattctacttacctgatgttgctcctgattgtatcatacgcaagtgcc

SEQ ID NO: 11310 - RNA, 1680 nt, synthetic construct
  misc_feature 1..1680: note = derived and/or modified CDS sequence (opt3) from RVFV(MP12)__Z30318.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcttagtgcgcatggaaacccttgtatgaaagagaagctggtgatgaagactcactgcccaaatgattatcagagcgcacaccatttgaacaatgacggcaaaatggcctccgttaagtgtccccctaaatacgaactcaccgaggattgcaacttttgtcgccagatgacaggtgcttctctgaagaaagggtcgtatccactgcaggacctcttctgccaatcaagcgaggatgacggaagtaagttaaagaccaaaatgaagggcgtgtgtgaagtcggcgtgcaggccctgaaaaagtgcgatgggcagctttccactgcacacgaggtagttccgtttgctgtgttcaaaaattctaagaaagtctacttggacaagctggacctaaagacagaagagaacctcctgcccgatagctttgtgtgtttcgagcataaaggacagtataagggtaccatggactccggccaaacgaaacgagaacttaagtcatttgatattagtcagtgccctaaaatcgggggacacggcagcaagaagtgcactggtgacgccgcgttctgttctgcctacgagtgcaccgcacagtacgctaatgcctattgttcccacgctaacgggtcaggaattgtgcagatccaagtcagcggcgtttggaaaaagccactgtgcgtgggctacgaacgtgtagtggtcaaaagagagttgagtgccaagcccatacagagggtggaaccttgtacaacttgcatcaccaaatgtgagccacatgggctcgttgtgcggtctacaggatttaagatttccagcgcagtcgcctgcgcttcgggtgtgtgtgtaaccggctctcagtccccctcaacggagatcactctgaagtatccggggattagtcaaagctccggaggcgatatcggtgttcacatggcgcatgacgatcagtctgtgagctcaaaaatagtcgcacactgccctccccaggacccatgtttagtgcatgattgcattgtctgcgcccacgggctgatcaattaccagtgtcacacagctctcagtgccttcgtggttgtgttcgtattttccagcattgcaatcatctgccttgccattctgtatcgcgtcttgaagtgtctaaaaatagctcctagaaaggtgctgaaccccctcatgtggatcaccgccttcattaggtggatctacaaaaagatggttgcacgggtggcgcataatataaaccaagtcaatcgcgaaattggctggatggagggaggccagctggtgcttgggaacccagctcccatccctcgacacgccccaatcccgagatattctacttacctgatgttgctcctgattgtatcatacgcaagtgcc

SEQ ID NO: 11311 - RNA, 1680 nt, synthetic construct
  misc_feature 1..1680: note = derived and/or modified CDS sequence (opt3) from RVFV(2007001811)__EU574040.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattatcaatgtcacacagctctgagtgccttcgtggttgtgttcgtattttccagcattgcaatcatctgcctcgccattctttaccgcgtcctgaagtgtttgaaaatagctcctagaaaggtgctaaaccccctgatgtggatcaccgccttcattaggtgggtttataaaaagatggtggcacgggtcgcggataatatcaaccaggtgaatcgcgaaataggatggatggagggcgggcagctcgtactgggaaacccagctcccattcctcgacacgccccaatcccgagatactctacttaccttatgctgttgctcatcgtgtcatatgcaagtgcc

SEQ ID NO: 11312 - RNA, 1680 nt, synthetic construct
  misc_feature 1..1680: note = derived and/or modified CDS sequence (opt3) from RVFV(2250/74)__DQ380209.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattatcaatgtcacacagctctgagtgccttcgtggttgtgttcgtattttccagcattgcaatcatctgcctcgccattctttaccgcgtcctgaagtgtttgaaaatagctcctagaaaggtgctaaaccccctgatgtggatcaccgccttcattaggtggatctataaaaagatggttgcacgggtggcggataatataaaccaggtcaatcgcgaaattggatggatggagggcgggcagctcgtgctgggaaacccagctcccatccctcgacacgccccaatcccgagatactctacttaccttatgctgttgctcattgtatcatatgcaagtgcc

SEQ ID NO: 11313 - RNA, 1680 nt, synthetic construct
  misc_feature 1..1680: note = derived and/or modified CDS sequence (opt3) from RVFV(T1)__DQ380201.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattatcaatgtcacacagctctgagtgccttcgtggttgtgttcgtattttccagcattgcaatcatctgcctcgccgtcctttaccgcgtgctgaagtgtttgaaaattgctcctagaaaggttctaaaccccctgatgtggataaccgccttcatcaggtggatttataaaaagatggtggcacgggtcgcggataatatcaaccaggtgaatcgcgaaataggatggatggagggcgggcagctcgtactgggaaacccagctcccattcctcgacacgccccaatcccgagatactctacttaccttatgctgttgctcatcgtgtcatatgcaagtgcc

SEQ ID NO: 11314 - RNA, 1680 nt, synthetic construct
  misc_feature 1..1680: note = derived and/or modified CDS sequence (opt3) from RVFV(Ken 199800523)__KU978777.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgccttttgttcccacgctaacgggtcaggaattgtgcaaatccaggtcagcggcgtttggaaaaagccactttgcgtgggctacgaacgtgtagtggtcaaaagagagctgagtgccaagcccatacagagggtggaaccttgtacaacttgcatcaccaaatgtgagccacacgggttggttgtgcggtctacaggattcaagatttccagcgcagtcgcctgcgcttcgggtgtgtgtgtaaccggctctcaatccccctcaacggagatcactctcaagtatccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattaccaatgtcacacagctctgagtgccttcgtggttgtgtttgtattctccagcattgcaatcatctgcctcgccattctttatcgcgtcctgaagtgtttgaaaatagctcctagaaaggtgctaaaccccctgatgtggatcaccgcctttattaggtgggtttacaaaaagatggtggcacgggtcgcggataatatcaaccaggtgaatcgcgaaataggatggatggagggcgggcagctcgtactgggaaacccagctcccattcctcgacacgccccaatcccgagatattctacttaccttatgctgttgctcatcgtgtcatacgcaagtgcc

SEQ ID NO: 11315 - RNA, 1680 nt, synthetic construct
  misc_feature 1..1680: note = derived and/or modified CDS sequence (opt3) from RVFV(1853/78)__DQ380220.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggagtggtccaaattcaggttagcggcgtgtggaaaaagccactttgcgtaggctatgaacgtgtggtcgtgaaaagagagctgagtgccaagcccatccagagggttgaaccttgtacaacttgcataaccaaatgtgagccacacgggttggtggtccggtctacaggatttaagatctccagcgcagtggcctgcgcttcgggtgtatgtgttaccggctctcaatccccctcaacggagattactctcaagtacccggggatcagtcagagctccggaggcgatattggtgtgcatatggcgcacgacgatcagtctgtcagctcaaaaatcgtggcacattgccctccccaggacccatgtctggtccacgggtgcatagtgtgcgcccatggcttaattaattatcaatgtcacacagctctgagtgccttcgttgtggtattcgtcttttccagcatcgcaattatctgcctcgccatcctttaccgcgtgctgaagtgtttgaaaattgctcctagaaaggttctaaaccccctgatgtggataaccgccttcatcaggtgggtgtataaaaagatggtcgcacgggtggcggataatattaaccaggtaaatcgcgaaatcggatggatggagggcgggcagctcgtgctgggaaacccagctcccatacctcgacacgccccaattccgagatactctacttaccttatgctgttgctcatcgtttcatatgcaagtgcc

SEQ ID NO: 11316 - RNA, 1680 nt, synthetic construct
  misc_feature 1..1680: note = derived and/or modified CDS sequence (opt3) from RVFV(73HB1449)__DQ380211.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaaaatccctccacggagatcactctcaagtacccggggatttcacagagtagcggaggcgatatcggtgttcatatggcgcacgacgatcagtccgtgtctagcaaaatagtcgcacattgccctccccaggacccatgtctggtgcacgggtgcattgtctgcgcccatggcttaatcaactatcaatgtcacacagctctgtcagccttcgtggttgtgttcgtatttagttccattgcaatcatctgcctcgccattctttaccgcgtcctgaagtgtttgaaaatagctcctagaaaggtgctaaatcccctgatgtggatcaccgccttcattaggtgggtttataaaaagatggtggcacgggtcgcggataacatcaatcaggtgaaccgcgaaataggatggatggagggcgggcagctcgtactgggaaacccagctcccattcctcgacacgccccaatcccgagatacagcacttaccttatgctgttgctcatcgtgtcttatgcatcagcc

SEQ ID NO: 11317 - RNA, 1680 nt, synthetic construct
  misc_feature 1..1680: note = derived and/or modified CDS sequence (opt3) from RVFV(2007000234)__JF326191.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattatcaatgtcacacagctctgagtgccttcgtggttattttcgtgttttccagcaccgcaatcatctgcctcgccgtactttaccgcgtcctgaagtgtttgaaaattgctcctagaaaggtgctaaaccccctgatgtggataactgccttcatcaggtgggtttataaaaagatggtggcacgggtcgcggataatattaaccaggtgaatcgcgaaatcggatggatggagggcgggcagctcgctctgggaaacccagcccccatacctcgacacgcaccaattccgagatactctacataccttatgctgttgctcatcgtatcatatgccagtgct

SEQ ID NO: 11318 - RNA, 1680 nt, synthetic construct
  misc_feature 1..1680: note = derived and/or modified CDS sequence (opt3) from RVFV(73HB1230)__DQ380221.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaaaaggaactgaaatcatttgatattagtcagtgccctaagatcgggggacatggcagcaagaaatgcactggtgacgccgcgttctgttctgcctacgagtgcaccgcacagtatgctaatgcctactgttcccacgctaacgggtcaggaattgtgcaaatccaggtcagcggcgtttggaagaaaccactttgcgtgggctatgaacgagtagtggtcaagcgtgagctgagtgccaaacccatacagagagtggaaccttgtacaacttgcatcaccaagtgtgagccacacgggttggttgtgaggtctacaggatttaagatttccagcgcagtcgcctgcgcttcgggtgtgtgtgtaaccggctctcaatccccctcaacggagatcactctcaaatacccggggattagtcagagctccggaggcgatatcggtgttcatatggcgcacgacgatcagtctgtgagctcaaagatagtcgcacattgccctccccaggacccatgtctggtgcacgggtgcattgtctgcgcccatggcttaatcaattatcaatgtcacacagctctgagtgccttcgtggttgtgttcgtattttccagcattgcaatcatctgcctcgccattctttaccgggtcctgaaatgtttgaagatagctcctcgcaaagtgctaaaccccctgatgtggatcaccgccttcattagatgggtttataagaagatggtggcaagggtcgcggataatatcaaccaggtgaatcgggaaataggatggatggagggcgggcagctcgtactgggaaacccagctcccattcctcgccacgccccaatcccgcgatactctacttaccttatgctgttgctcatcgtgtcatatgcaagtgcc

SEQ ID NO: 11319 - RNA, 1680 nt, synthetic construct
  misc_feature 1..1680: note = derived and/or modified CDS sequence (opt3) from RVFV(ZM-657)__DQ380204.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaaagcctactgttcccacgctaatgggtcaggaattgtgcaaatccaggtcagcggcgtttggaagaaaccactttgcgtgggctatgaacgtgtagtggtcaagagagagctgagtgccaaacccatacagagggtggaaccttgtacaacttgcatcaccaagtgtgagccacacgggttggttgtgcggtctacaggatttaagatttccagcgcagtcgcctgcgcttcgggtgtgtgtgtaaccggctctcaatccccctcaacggagatcactctcaaatacccggggattagtcagagctccggaggcgatatcggtgttcatatggcgcacgacgatcagtctgtgagctcaaagatagtcgcacattgccctccccaggacccatgtctggtgcacgggtgcattgtctgcgcccatggcttaatcaactatcaatgtcacacagctctgagtgccttcgtggttgtgttcgtattttccagcattgcaatcatctgcctcgccattctttaccgcgtcctgaaatgtttgaagatagctcctagaaaagtgctaaatcccctgatgtggatcaccgccttcattaggtggatctataagaagatggttgcacgggtggcggataacataaatcaggtcaaccgcgaaattggatggatggagggcgggcagctcgtgctgggaaatccagctcccatccctcgacacgccccaatcccgagatactctacttaccttatgctgttgctcattgtatcatatgcaagtgcc

SEQ ID NO: 11320 - RNA, 1680 nt, synthetic construct
  misc_feature 1..1680: note = derived and/or modified CDS sequence (opt3) from RVFV(Kenya 83 (21445))__DQ380198.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattatcaatgtcacacagctctgagtgccttcgtggttgtgttcgtattttccagcattgcaatcatctgcctcgccattctttaccgcgtcctgaagtgtttgaaaatagctcctagaaaggtgctaaaccccctgatgtggatcaccgccttcattaggtgggtttataaaaagatggtggcacgggtcgcggataatatcaaccaggtgaatcgcgaaataggatggatggagggcgggcagctcgctctgggaaacccagcccccattcctcgacacgcaccaatcccgagatactctacttaccttatgctgttgctcatcgtatcatatgccagtgct

SEQ ID NO: 11321 - RNA, 1680 nt, synthetic construct
  misc_feature 1..1680: note = derived and/or modified CDS sequence (opt3) from RVFV(SAUDI 200010901)__KU978778.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgccttttgttcccacgctaacgggtcaggaattgtgcaaatccaggtcagcggcgtttggaaaaagccactttgcgtgggctacgaacgtgtagtggtcaaaagagagctgagtgccaagcccatacagagggtggaaccttgtacaacttgcatcaccaaatgtgagccacacgggttggttgtgcggtctacaggattcaagatttccagcgcagtcgcctgcgcttcgggtgtgtgtgtaaccggctctcaatccccctcaacggagatcactctcaagtatccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattaccaatgtcacacagctctgagtgccttcgtggttgtgtttgtattctccagcattgcaatcatctgcctcgccattctttatcgcgtcctgaagtgtttgaaaatagctcctagaaaggtgctaaaccccctgatgtggatcaccgcctttattaggtgggtttacaaaaagatggtggcacgggtcgcggataatatcaaccaggtgaatcgcgaaataggatggatggagggcgggcagctcgtactgggaaacccagctcccattcctcgacacgccccaatcccgagatattctacttaccttatgctgttgctcatcatttcatacgcaagtgcc

SEQ ID NO: 11322 - RNA, 1680 nt, synthetic construct
  misc_feature 1..1680: note = derived and/or modified CDS sequence (opt3) from RVFV(2007004194)__EU574031.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgtccaacgacggcaaaatggcctctgttaagtgtccccctaaatatgaattgaccgaggattgcaatttttgtcgccagatgacaggtgcttcgctcaagaaagggtcatacccactgcaagacctgttctgccagagcagtgaggatgacggatccaagctcaagaccaaaatgaagggcgtgtgtgaagtcggcgtgcaggccttaaagaagtgcgatgggcagctgtctactgcacatgaggtagttccgtttgctgtgttcaaaaacagcaagaaagtctatcttgacaagttggacctgaagacagaagagaatctactccccgattcctttgtgtgtttcgagcacaaaggacaatacaagggtaccatggactcaggccagacgaaacgagaactgaagagttttgatattagccagtgccctaaaatcgggggacatggctctaagaagtgcactggtgacgccgcgttctgttccgcctacgagtgcaccgcacagtatgctaacgcctactgttcacacgctaatgggagcggaattgtgcaaatccaggtcagtggcgtttggaaaaagccactttgcgtgggctatgaacgtgtagtggtcaaaagagagctgtctgccaagcccatacagagggtggaaccttgtacaacttgcatcaccaaatgtgagccacacgggttggttgtgcggtccacaggatttaagattagctcggcagtcgcctgcgcttctggtgtgtgtgtaaccggctcccaatcacccagtacggagatcactctcaagtacccggggattagccagtcctctggaggcgatatcggtgttcatatggcgcacgacgatcagagcgtgtcaagtaaaatagtcgcacattgccctccccaggacccatgtctggtgcacgggtgcattgtctgcgcccatggcttaatcaactatcaatgtcacacagctctgtccgccttcgtggttgtgttcgtatttagctctattgcaatcatctgcctcgccattctttaccgcgtcctgaagtgtttgaaaatagctcctagaaaggtgctaaatcccctgatgtggatcaccgccttcattaggtgggtttataaaaagatggtggcacgggtcgcggataacatcaatcaggtgaaccgcgaaataggatggatggagggcgggcagctcgtactgggaaatccagctcccattcctcgacacgccccaatcccgagatactcaacttaccttatgctgttgctcatcgtgagttatgcaagcgcc

SEQ ID NO: 11323 - RNA, 1680 nt, synthetic construct
  misc_feature 1..1680: note = derived and/or modified CDS sequence (opt3) from RVFV(ZH-501-777)__DQ380202.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggaccctggccagacgaaacgagaactgaagtcctttgatatttcacagtgcccaaaaatcgggggacatggcagtaagaagtgcactggtgacgccgcgttctgtagcgcctacgagtgcaccgcacagtatgctaatgcctactgttctcacgctaacgggtccggaattgtgcaaatccaggtctcaggcgtttggaaaaagcccctttgcgtgggctatgaacgtgtagtggtcaaaagagagctgagcgccaagcctatacagagggtggaaccatgtacaacttgcatcaccaaatgtgagccccacgggttggttgtgcggagtacaggatttaagatttcttccgcagtcgcctgcgctagcggtgtgtgtgtaaccggctcgcaatctccgtccacggagatcactctcaagtaccctgggatttcacagagtagcggaggcgatatcggtgttcatatggcgcacgacgatcagtccgtgtctagcaaaatagtcgcacattgtcccccacaggacccttgcctggtgcacgggtgcattgtctgcgcccatggcttaatcaattatcaatgtcacacagctctgtcagccttcgtggttgtgttcgtatttagttccattgcaatcatctgcctcgccgtcctttaccgcgtgctgaagtgtttgaaaattgctcccagaaaggttctaaacccactgatgtggataaccgccttcatcaggtggatttataaaaagatggtggcacgggtcgcggataatatcaaccaggtgaatcgcgaaataggatggatggagggcgggcagctcgtactgggaaaccccgctcctattccacgacacgccccgatccccagatacagcacttaccttatgctgttgctcatcgtgtcttatgcatcagcc

SEQ ID NO: 11324 - RNA, 1680 nt, synthetic construct
  misc_feature 1..1680: note = derived and/or modified CDS sequence (opt3) from RVFV(ZC-3349)__DQ380207.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcaggcagtgtctagcaaaatagtcgcccattgccctccccaggacccatgtctggtgcacgggtgcattgtctgcgctcatggcttaatcaattatcaatgtcacacagccctgtcagcattcgtggttgtgttcgtatttagttccattgccatcatctgcctcgctattctttaccgcgtcctgaagtgtttgaaaatagcccctagaaaggtgctaaaccccctgatgtggatcaccgcattcattaggtggatctataaaaagatggttgcgcgggtggctgataatataaaccacgtcaatcgcgaaattggatggatggagggcgggcagctcgtgctgggaaacccagcccccatccctcgacatgcaccaatcccgagatacagcacttaccttatgctgttgctcattgtatcttatgcctcagct

SEQ ID NO: 11325 - RNA, 1680 nt, synthetic construct
  misc_feature 1..1680: note = derived and/or modified CDS sequence (opt3) from RVFV(200803166)__JF311381.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttaaagaaagggaagtttcctctgttccaatcttacgcacaccatcggaccctactcgaggccgtccacgacacaataatcgctaaagccgatccaccctcatgcgacctgcagagtgcgcatggaaacccttgtatgaaggaaaaacttgtgatgaagactcactgcccaaatgattatcagagcgcacactacctgaacaatgacggcaagatggcctccgttaaatgtccccctaagtatgagttgaccgaagattgcaacttttgtcgccagatgacaggtgcttctctcaaaaaggggtcgtacccactgcaagacctgttctgccagtcaagcgaggatgacggaagtaagctcaaaaccaagatgaaaggcgtgtgtgaggtcggcgtgcaggccttaaagaaatgcgatgggcagctgtccactgcacatgaagtagttccgtttgctgtgttcaaaaattctaagaaggtctatcttgacaagttggacctgaaaacagaggaaaacctactccccgatagctttgtgtgtttcgagcacaagggacaatacaaaggtaccatggactccggccagacgaagcgagagctgaaatcatttgatattagtcagtgccctaagatcgggggacatggcagcaagaaatgcactggtgacgccgcgttctgttctgcctacgaatgcaccgcacagtatgctaatgcctactgttcccacgctaacgggtcaggaattgtgcaaatccaggtcagcggcgtttggaagaaaccactttgcgtgggctatgagcgtgtagtggtcaagagagaactgagtgccaaacccatacagagggtggagccttgtacaacttgcatcaccaagtgtgaaccacacgggttggttgtgcggtctacaggatttaagatttccagcgcagtcgcctgcgcttcgggtgtgtgtgtaaccggctctcaatccccctcaacggagatcactctcaaatacccggggattagtcagagctccggaggcgatatcggtgttcatatggcgcacgacgatcagtctgtgagctcaaagatagtcgcacattgccctccccaggacccatgtctggtgcacgggtgcattgtctgcgcccatggcttaatcaattatcaatgtcacacagctctgagtgccttcgtggttgtgttcgtattttccagcattgcaatcatctgcctcgccattctttaccgcgtcctgaaatgtttgaagatagctcctagaaaagtgctaaaccccctgatgtggatcaccgccttcattaggtgggtttataagaagatggtggcacgggtcgcggataatatcaaccaggtgaatcgcgagataggatggatggaaggcgggcagctcgtactgggaaacccagctcccattcctcgacacgccccaatcccgagatactctacttaccttatgctgttgctcatcgtgtcatatgcaacagcc

SEQ ID NO: 11326 - RNA, 1680 nt, synthetic construct
  misc_feature 1..1680: note = derived and/or modified CDS sequence (opt3) from RVFV(1260/78)__DQ380214.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattatcaatgtcacacagctctgagtgccttcgtggttgtgttcgtattttccagcattgcaatcatctgcctcgccattcttcaccgcgtcctgaagtgtttgaaaatagctcctagaaaggtgctaaaccccctgatgtggatcaccgccttcattaggtgggtttacaaaaagatggtggcacgggtcgcggataatatcaaccaggtgaatcgcgaaataggatggatggagggcgggcagctcgtactgggaaacccagctcccattcctcgacatgccccaatcccgagatattctacttaccttatgctgttgctcatcgtgtcatacgcaagtgcc

SEQ ID NO: 11327 - RNA, 1680 nt, synthetic construct
  misc_feature 1..1680: note = derived and/or modified CDS sequence (opt3) from RVFV(T-46 (228113))__DQ380199.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccaaagactccggccagacgaagcgagaactgaaatcatttgatattagtcagtgccctaagatcgggggacatggcagcaagaaatgcactggtgacgccgcgttctgttctgcctacgagtgcaccgcacagtatgctaatgcctactgttcccacgctaacgggtcaggaattgtgcaaatccaggtcagcggcgtttggaagaaaccactttgcgtgggctatgaacgtgtagtggtcaagagagagctgagtgccaaacccatacagagggtggaaccttgtacaacttgcatcaccaagtgtgagccacacgggttggttgtgcggtctacaggatttaagatttccagcgcagtcgcctgcgcttcgggtgtgtgtgtaaccggctctcaatccccctcaacggagatcactctcaaatacccggggattagtcagagctccggaggcgatatcggtgttcatatggcgcacgacgatcagtctgtgagctcaaagatagtcgcacattgccctccccaggacccatgtctggtgcacgggtgcattgtctgcgcccatggcttaatcaattatcaatgtcacacagctctgagtgccttcgtggttgtgttcgtattttccagcattgcaatcatctgcctcgccgtcctttaccgcgtgctgaaatgtttgaagattgctcctagaaaagttctaaaccccctgatgtggataaccgccttcatcaggtggatttataagaagatggtggcacgggtcgcggataatatcaaccaggtgaatcgcgaaataggatggatggagggcgggcagctcgtactgggaaacccagctcccattcctcgacacgccccaatcccgagatactctacttaccttatgctgttgctcatcgtgtcatatgcaagtgcc

SEQ ID NO: 11328 - RNA, 1680 nt, synthetic construct
  misc_feature 1..1680: note = derived and/or modified CDS sequence (opt3) from RVFV(ZINGA J83 R1)__KU978776.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaagatggcctccgttaagtgtccccctaaatatgaattgaccgaggattgcaacttttgtcgcctcatgacaggtgcttctctgaagaaagggtcgtacccactgcaggacctcttctgccaatcaagcgaggatgacggaagtaagttaaagaccaaaatgaagggcgtgtgtgaagtcggcgtgcaggccctgaaaaagtgcgatgggcagctttccactgcacatgaggtagttccgtttgctgtgttcaaaaattctaagaaagtctatttggacaagctggacctaaagacagaagagaacctcctgcccgatagctttgtgtgtttcgagcacaaaggacagtacaagggtaccatggactccggccaaacgaaacgagaacttaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcagatccaagtcagcggcgtttggaaaaagccactgtgcgtgggctatgaacgtgtagtggtcaaaagagagttgagtgccaagcccatacagagggtggaaccttgtacaacttgcatcaccaaatgtgagccacacgggctcgttgtgcggtctacaggatttaagatttccagcgcagtcgcctgcgcttcgggtgtgtgtgtaaccggctctcagtccccctcaacggagatcactctgaagtacccggggattagtcaaagctccggaggcgatatcggtgttcatatggcgcacgacgatcagtctgtgagctcaaaaatagtcgcacattgccctccccaggacccatgtttagtgcacgggtgcattgtctgcgcccatggcctgatcaattatcagtgtcacacagctctcagtgccttcgtggttgtgttcgtattttccagcattgcaatcatctgccttgccattctgtaccgcgtcttgaagtgtctaaaaatagctcctagaaaggtgctgaaccccctcatgtggatcaccgccttcattaggtgggtttatcggaaaatggtggcacgcgtcgcggataatatcaaccaagtgaatcgagaaataggatggatggagggcgggcagctggtacttggaaacccagctcccattcctagacacgtgccaatcccgaggtactctacttacctgatgttgctcctgatcgtttcatatgccagtgca

SEQ ID NO: 11329 - RNA, 1680 nt, synthetic construct
  misc_feature 1..1680: note = derived and/or modified CDS sequence (opt3) from RVFV(clone 13)__DQ380213.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaacatgaattgaccgaggattgcaacttttgtcgccagatgacaggtgcttctctcaagaaagggtcgtatccactgcaagacctgttctgccagtcaagcgaggatgacggaagtaagctcaagaccaaaatgaagggcgtgtgtgaagtcggcgtgcaggccttaaagaagtgcgatgggcagctgtccactgcacacgaggtagttccgtttgctgtgttcaaaaattctaagaaagtctaccttgacaagttggacctgaagacagaagagaacctactccccgatagctttgtgtgtttcgagcataaaggacaatataagggtaccatggactccggccagacgaaacgagaactgaagtcatttgatattagtcagtgccctaaaatcgggggacacggcagcaagaagtgcactggtgacgccgcgttctgttctgcctacgagtgcaccgcacagtacgctaatgcctattgttcccacgctaacgggtcaggaattgtgcaaatccaggtcagcggcgtttggaaaaagccactttgcgtgggctacgaacgtgtagtggtcaaaagagagctgagtgccaagcccatacagagggtggaaccttgtacaacttgcatcaccaaatgtgagccacatgggttggttgtgcggtctacaggatttaagatttccagcgcagtcgcctgcgcttcgggtgtgtgtgtaaccggctctcaaaatccctccacggagatcactctcaagtatccggggatttcacagagtagcggaggcgatatcggtgttcacatggcgcatgacgatcagtccgtgtctagcaaaatagtcgcacactgccctccccaggacccatgtctggtgcatgggtgcattgtctgcgcccacggcttaatcaactaccaatgtcacacagctctgtcagccttcgtggttgtgttcgtatttagttccattgcaatcatctgcctcgccattctttatcgcgtcctgaagtgtttgaaaatagctcctagaaaggtgctaaatcccctgatgtggatcaccgccttcattaggtgggtttacaaaaagatggtggcacgggtcgcggataacatcaatcaggtgaaccgcgaaataggatggatggagggcgggcagctcgtactgggaaacccagctcccattcctcgacatgccccaatcccgagatatagcacttaccttatgctgttgctcatcgtgtcttacgcatcagcc

SEQ ID NO: 11330 - RNA, 1680 nt, synthetic construct
  misc_feature 1..1680: note = derived and/or modified CDS sequence (opt3) from RVFV(SA01-1322)__KX096942.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgccttttgttcccacgctaacgggtcaggaattgtgcaaatccaggtcagcggcgtttggaaaaagccactttgcgtgggctacgaacgtgtagtggtcaaaagagagctgagtgccaagcccatacagagggtggaaccttgtacaacttgcatcaccaaatgtgagccacacgggttggttgtgcggtctacaggattcaagatttccagcgcagtcgcctgcgcttcgggtgtgtgtgtaaccggctctcaatccccctcaacggagatcactctcaagtatccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattaccaatgtcacacagctctgagtgccttcgtggttgtgtttgtattctccagcattgcaatcatctgcctcgccattctttatcgcgtcctgaagtgtttgaaaatagctcctagaaaggtgctaaaccccctgatgtggatcaccgcctttattaggtgggtttacaaaaagatggtggcacgggtcgcggataatatcaaccaggtgaatcgcgaaataggatggatggagggcgggcagctcgtactgggagacccagctcccattcctcgacacgccccaatcccgagatattctacttaccttatgctgttgctcatcatttcatacgcaagtgcc

SEQ ID NO: 11331 - RNA, 1680 nt, synthetic construct
  misc_feature 1..1680: note = derived and/or modified CDS sequence (opt3) from RVFV(25010-24)__KM210509.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttgattgttcggtctacaggatttaagatctccagcgcagtggcctgcgcttcgggtgtctgtgtgaccggctctcaatccccctcaacggagattactctcaagtacccggggatcagtcagagctccggaggcgatataggtgtacatatggcgcacgacgatcagtctgttagctcaaaaattgtggcacattgccctccccaggacccatgtctggtccacgggtgcatcgtgtgcgcccatggcttaattaattatcaatgtcacacagctctgagtgccttcgtcgtggttttcgtgttttccagcgtagcaatcatctgcctcgccattctttacaaggtcctgaaatgtttgaagatagctcctaaaaaggtgctaaaccccctgatgtggatcaccgccttcattcgctgggtttataagaaaatggtggcaagagtcgcggataatatcaaccaggtgaatagggaaataggatggatggagggcgggcagctcgctctgggaaacccagcccccattcctcggcacgcaccaatcccgcgctactctacttaccttatgctgttgctcatcgtatcatatgccagtgct

SEQ ID NO: 11332 - RNA, 1680 nt, synthetic construct
  misc_feature 1..1680: note = derived and/or modified CDS sequence (opt3) from RVFV(200803162)__JF311377.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcgcaaaatgtgagccacacgggttggttgtgcggtctaccggatttaagatttccagcgccgtcgcttgcgcgtcgggtgtgtgtgtaacaggctctcaatccccctcaaccgagatcacgctcaagtacccggggattagtcagagctccggaggcgatatcggtgttcatatggcacacgacgatcagtctgtgagctcaaaaatagtcgcccattgccctccccaggacccatgtctggtgcacgattgcattgtctgcgctcatgggttaatcaattatcaatgtcacactgccctgagtgcattcgtggttattttcgtgttttccagcacagccatcatctgcctcgctgtactttaccgcgtcctgaagtgtttgaaaattgcccctagaaaggtgctaaaccccctgatgtggataaccgcattcatcaggtgggtttataaaaagatggtggcgcgggtcgctgacaatattaaccaggtgaatcgcgaaatcggctggatggagggaggccagctcgccctgcgaaacccagcacccatacctagacacgccccaattccgaggtactctacttaccttatgctgttgctcatcgtatcatatgctagtgcc

SEQ ID NO: 11333 - RNA, 1680 nt, synthetic construct
  misc_feature 1..1680: note = derived and/or modified CDS sequence (opt3) from RVFV(2007002476)__EU574036.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattatcaatgtcacacagctctgagtgccttcgtggttattttcgtgttttccagcaccgcaatcatctgcctcgccgtactttaccgcgtcctgaagtgtttgaaaattgctcctagaaaggtgctaaaccccctgatgtggataactgccttcatcaaatgggtttataagaagatggtggcaagggtcgcggataatattaaccaggtgaatcgggaaatcggatggatggagggcgggcagctcgctctgggaaacccagcccccatacctcgccacgcaccaattccgcgatactctacataccttatgctgttgctcatcgtatcatatgccagtgct

SEQ ID NO: 11334 - RNA, 1680 nt, synthetic construct
  misc_feature 1..1680: note = derived and/or modified CDS sequence (opt3) from RVFV(Hv-B375)__DQ380218.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaaaacgaattgaccgaggattgcaatttttgtcgccagatgacaggtgcttctctcaagaaagggtcgtatccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaactctaagaaagtctaccttgacaagttggacctgaagacagaagagaatctactccccgatagctttgtgtgtttcgagcacaaaggacaatataagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtacgctaacgcctattgttcccacgctaatgggtcaggaattgtgcaaatccaggtcagcggcgtttggaaaaagccactttgcgtgggctacgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtatccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaactaccaatgtcacacagctctgagtgccttcgtggttgtgttcgtattttccagcattgcaatcatctgcctcgccattctttatcgcgtcctgaagtgtttgaaaatagctcctagaaaggtgctaaatcccctgatgtggatcaccgccttcattaggtgggtttacaaaaagatggtggcacgggtcgcggataacatcaatcaggtgaaccgcgaaataggatggatggagggcgggcagctcgtactgggaaacccagctcccattcctcgacacgccccaatcccgagatattctacttaccttatgctgttgctcatcgtgtcatacgcaagtgcc

SEQ ID NO: 11335 - RNA, 1680 nt, synthetic construct
  misc_feature 1..1680: note = derived and/or modified CDS sequence (opt3) from RVFV(OS-1)__DQ380186.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggagtggtccaaattcaggttagcggcgtgtggaaaaagccactttgcgtaggctatgaacgtgtggtcgtgaaaagagagctgagtgccaagcccatccagagggttgaaccttgtacaacttgcataaccaaatgtgagccacacgggttggtggtccggtctacaggatttaagatctccagcgcagtggcctgcgcttcgggtgtatgtgttaccggctctcaatccccctcaacggagattactctcaagtacccggggatcagtcagagctccggaggcgatattggtgtgcatatggcgcacgacgatcagtctgtcagctcaaaaatcgtggcacattgccctccccaggacccatgtctggtccacgggtgcatagtgtgcgcccatggcttaattaattatcaatgtcacacagctctgagtgccttcgttgtggtattcgtcttttccagcgtggcaatcatttgcctcgccatcctttacaaggttctgaaatgtttgaagatcgctcctcgcaaagtgctaaaccccctgatgtggattaccgccttcataagatgggtctataagaagatggtggcaagggtagcggataatatcaaccaggtgaatcgggaaattggatggatggagggcgggcagctcgctctgggaaacccagcccccatccctcgccacgcaccaataccgcgatactctacttaccttatgctgttgctcattgtttcatatgccagtgct

SEQ ID NO: 11336 - RNA, 1680 nt, synthetic construct
  misc_feature 1..1680: note = derived and/or modified CDS sequence (opt3) from RVFV(2373/74)__DQ380194.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatggtcgcacattgccctccccaggacccatgtctggtgcacgggtgcatagtctgcgcccatggcttaattaattatcaatgtcacacagctctgagtgccttcgtggttgtgttcgtattttccagcgtcgcaatcatttgcctcgccatcctttacaaggtgctgaaatgtttgaagatcgctcctcgcaaagttctaaaccccctgatgtggattaccgccttcataagatgggtgtataagaagatggtcgcaagggtggcggataatatcaaccaggtaaatcgggaaattggatggatggagggcgggcagctcgctctgggaaacccagcccccatccctcgccacgcaccaataccgcgatactctacttaccttatgctgttgctcattgtgtcatatgccagtgct

SEQ ID NO: 11337 - RNA, 1680 nt, synthetic construct
  misc_feature 1..1680: note = derived and/or modified CDS sequence (opt3) from RVFV(Kenya 57 (Rintoul))__DQ380192.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagattaaacgagaactgaagtcatttgatatcagtcagtgccctaaaattgggggacatggcagcaagaagtgcacgggtgacgccgcgttctgttctgcctacgagtgcactgcacagtatgctaatgcctactgttcccacgctaacgggtcaggaatcgtgcaaatacaggtcagcggcgtttggaaaaagccactttgcgtgggctatgaacgtgtagtggtcaaaagagagctgagtgccaagcccatccagagggtggaaccttgtaccacatgcattactaaatgtgagccacacgggttggttgtgcggtctaccggatttaagatctccagcgcagtcgcctgcgcttcgggtgtgtgtgtaacaggctctcaatccccctcaaccgagattacgctcaagtacccggggatcagtcagagctccggaggcgatataggtgttcatatggcgcacgacgatcagtctgtgagctcaaaaattgtcgcacattgccctccccaggacccatgtctggtgcacgggtgcatcgtctgcgcccatggcttaattaattatcaatgtcacactgctctgagtgccttcgtggttgtgttcgtattttccagcgtcgcaatcatctgcctcgccattctttacaaggtgctgaaatgtttgaagatagctcctcgcaaagttctaaaccccctgatgtggatcacagccttcattagatgggtgtataagaagatggtcgcaagggtggcggataatatcaaccaggtaaatcgggaaataggatggatggagggcgggcagctcgtgctgggaaacccagctcccattcctcgccacgccccaatcccgcgatactctacctaccttatgctgttgctcatcgtttcatatgcaagtgcc

SEQ ID NO: 11338 - RNA, 1680 nt, synthetic construct
  misc_feature 1..1680: note = derived and/or modified CDS sequence (opt3) from RVFV(Sudan 2V-2007)__JQ820490.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatagtcgcacattgccctccccaggacccatgtagtgtgcacgggtgcattgtctgcgcccatggcctgatcaattatcaatgtcacacagctttatccgccttcgtggttgtgttcgtatttagctctattgcaatcatctgcctggccattctctaccgcgtccttaagtgtctgaaaatagctcctagaaaggtgttgaaccccctaatgtggatcaccgccttcattaggtgggtttataaaaagatggtggcacgggtcgcggataatatcaaccaggtgaatcgcgaaataggatggatggagggcgggcagctggtactcggaaacccagctcccattcctcgacacgccccaatcccgagatactcaacttacctgatgcttctgttgatcgtgagtcatgcaagcgcc

SEQ ID NO: 11339 - RNA, 1680 nt, synthetic construct
  misc_feature 1..1680: note = derived and/or modified CDS sequence (opt3) from RVFV(200803167)__JF311382.1__Gn
  source 1..1680: mol_type = other RNA
atggccggcatcgctatgaccgtgctgcccgcactcgccgtcttcgcgcttgctcctgttgtgtttgccgaggacctgcacttgagaaacaggccagggaagggacataattacattgatggtatgacacaggaagacgcaacttgcaaaccggtaacgtatgccggcgcttgtagctccttcgatgtgttactggagaaggggaaatttcccctattccaatcttacgcacaccatcggaccctcctggaagccgtccacgacacaataatcgctaaggccgatcctccatcatgcgaccttcagagtgcgcatggaaacccctgtatgaaagagaagctggtgatgaagactcactgccctaatgattatcagagcgcacactacttgaacaatgacggcaaaatggcctccgttaagtgtccacccaaatatgaactcaccgaggattgcaacttttgtcgccagatgacaggtgcttctctgaagaaagggtcgtaccctctgcaagacctcttctgccagtcaagcgaggatgacggaagtaagttaaagaccaaaatgaagggcgtgtgtgaagtcggcgtgcaggccctgaaaaagtgcgatgggcagctttccactgcacatgaggtagttccatttgctgtgttcaaaaattctaagaaagtctatttggacaagctggacctaaagacagaagagaacctcctgccggatagctttgtgtgtttcgagcacaaaggacaatacaagggtaccatggactccggccagacgaaacgagaacttaagtcatttgatattagtcagtgccccaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagcctctgtgcgtgggctatgaacgtgtagtggtcaaaagagagttgagtgccaagccaatacagagggtggaaccctgtacaacttgcatcaccaaatgtgagcctcacgggctcgttgtgcggtctacaggatttaagatttccagcgcagtcgcctgcgcttcgggtgtgtgtgtaaccggctctcaatccccatcaacggagatcgcgctgaagtaccccgggattagtcagagctccggaggcgatatcggtgttcatatggcacacgacgatcagtctgtgagctcaaaaatagtcgcccattgcccgcctcaggacccctgtttagtgcacgggtgcattgtctgcgctcatggcctgatcaattatcaatgtcacactgccctcagtgcattcgtggttgtgttcgtattttccagcattgccatcatctgccttgctattctgtaccgcgtcttgaagtgtctaaaaatagccccaagaaaggtgctgaaccctctcatgtggatcacagcattcattaggtgggtttataaaaagatggtggcgcgggtcgctgataatatcaaccaggtgaatcgcgaaataggatggatggagggcgggcagctggtacttggaaaccccgccccaattccccgacacgcacctatcccaagatactctacctacctgatgttgctcctgatcgtgtcatatgccagtgct

SEQ ID NO: 11340 - RNA, 1680 nt, synthetic construct
  misc_feature 1..1680: note = derived and/or modified CDS sequence (opt3) from RVFV(KEN/Gar-008/06)__HM586965.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagccgtgtttggaaaaagccactttgcgtgggctatgaaagagtagtggtcaaaagggagctgagtgccaagcccatacagcgggtggaaccttgtacaacttgcatcaccaaatgtgagccacacggcttggttgtgcgctctacagggtttaagatttccagcgcagtcgcctgcgcttcgggagtgtgtgtaaccggttctcaatccccctcaacggagatcactctcaagtacccgggcattagtcagagctccgggggagatatcggcgttcatatggcgcacgacgatcagtctgtgagctcaaaaatagtcgcacattgccctccccaggacccatgtctggtgcacggttgcattgtctgcgcccatgggttaatcaattatcaatgtcacacagctctgagtgccttcgtggttattttcgtgttttccagcaccgcaatcatctgcctcgccgtactttacagagtcctgaagtgtttgaaaattgctcctaggaaggtgctaaaccccctgatgtggataactgccttcatccggtgggtttataaaaagatggtggcacgcgtcgcggataatattaaccaggtgaatcgagaaatcggctggatggagggaggccagctcgctctggggaacccagcccccatacctagacacgcaccaattccgaggtactctacataccttatgctgttgctcatcgtatcatatgccagtgct

SEQ ID NO: 11341 - RNA, 1680 nt, synthetic construct
  misc_feature 1..1680: note = derived and/or modified CDS sequence (opt3) from RVFV(ANK-6087)__DQ380216.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaaactggactccggccagaccaagcgagaacttaaatcatttgatattagtcagtgccctaagatcgggggacatggcagcaagaaatgcacgggtgacgccgcgttctgttctgcctacgagtgcactgcacagtatgctaatgcctactgttcccacgctaacgggtcaggaattgtgcaaatccaggtcagcggcgtttggaagaaaccactgtgcgtgggctatgaacgtgtagtggtcaagagagagttgagtgccaaacccatacagagggtggaaccttgtaccacatgcatcactaagtgtgagccacacgggctcgttgtgcggtctaccggatttaagatttccagcgcagtcgcctgcgcttcgggtgtgtgtgtaacaggctctcaatccccctcaaccgagatcacgctgaaatacccggggattagtcagagctccggaggcgatatcggtgttcatatggcgcacgacgatcagtctgtgagctcaaagatagtcgcacattgccctccccaggacccatgtttagtgcacgggtgcattgtctgcgcccatggcctgatcaattatcaatgtcacactgctctcagtgccttcgtggttgtgttcgtattttccagcattgcaatcatctgccttgccattctgtaccgcgtcttgaaatgtctaaagatagctcctagaaaagtgctgaaccccctcatgtggatcacagccttcattaggtgggtttatcggaagatggtggcacgcgtcgcggataatatcaaccaggtgaatcgagaaataggatggatggagggcgggcagctggtacttggaaacccagctcccattcctagacacgtgccaatcccgaggtactctacctacctgatgttgctcctgatcgtttcatatgccagtgca

SEQ ID NO: 11342 - RNA, 1680 nt, synthetic construct
  misc_feature 1..1680: note = derived and/or modified CDS sequence (opt3) from RVFV(763/70)__DQ380188.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatggtttgaccgaagattgcaacttttgtcgccagatgacaggggcttctctcaagaaaggatcgtacccactgcaagacctgttctgccagtcaagcgaggatgacggcagtaagctcaagaccaaaatgaagggcgtgtgtgaggtcggggtgcaggccttaaagaagtgcgatggacagctgtccactgcacatgaagtagttccgtttgctgtgttcaaaaattctaagaaagtctatcttgacaagttggacctgaagacagaggaaaacctactccccgatagctttgtgtgtttcgagcacaaaggtcaatacaagggcaccatggactccgggcagacgaaacgagagctgaagtcatttgatattagtcagtgccctaaaatcggaggccatggtagcaagaagtgcactggggacgccgcgttctgttctgcctacgaatgcaccgcacagtatgctaatgcctactgttcccacgctaacggatcaggcattgtgcaaatccaggtcagcggcgtttggaaaaagccactttgcgtggggtatgagcgtgtagtggtcaaaagagaactgagtgccaagcccatacagagggtggagccttgtacaacttgcatcaccaaatgtgaaccacacggattggttgtgcggtctacaggttttaagatttccagcgcagtcgcctgcgcttcgggcgtgtgtgtaaccgggtctcaatccccctcaacggagatcactctcaagtacccgggaattagtcagagctccggcggtgatatcggggttcatatggcgcacgacgatcagtctgtgagctcaaaaatagtcgcacattgccctccccaggacccatgtctggtgcacggctgcattgtctgcgcccatggattaatcaattatcaatgtcacacagctctgagtgccttcgtggttgtgttcgtattttccagcgtcgcaattatctgcctcgccatcctttacaaggtgctgaaatgtttgaagattgctcctcgcaaagttctaaaccccctgatgtggataaccgccttcatcagatgggtgtataagaagatggtcgcaagggtggcggataatattaaccaggtaaatcgggagatcggctggatggaagggggacagctcgctctgggtaacccagcccccatacctcgccacgcaccaattccgcgatactctacttaccttatgctgttgctcatcgtgtcatatgccagtgct

SEQ ID NO: 11343 - RNA, 1680 nt, synthetic construct
  misc_feature 1..1680: note = derived and/or modified CDS sequence (opt3) from RVFV(BIME-01)__KX609032.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattatcaatgtcacacagctctgagtgccttcgtggttgtgttcgtattttccagcgtcgcaattatctgcctcgccatcctttacaaggtgctgcgctgtttgaaaattgctcctaagaaagttctaaaccccctgatgtggataaccgccttcatcagatgggtgtataagaagatggtcgcaagggtggcggataatattaaccaggtaaatcgggaaatcggatggatggagggcgggcagctcgctctgggaaacccagcccccatacctcgccacgcaccaattccgcgatactctacttaccttatgctgttgctcatcatctcatatgccagtgct

SEQ ID NO: 11344 - RNA, 1680 nt, synthetic construct
  misc_feature 1..1680: note = derived and/or modified CDS sequence (opt3) from RVFV(KEN07-KUR340)__EF460404.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcaaatccaggtcagcggcgtttggaaaaagccactttgcgtgggctatgaacgtgtagtggtcaaaagagagctgagtgccaagcccatacagagggtggaaccttgtacaacttgcatcaccaaatgtgagccacacgggttggttgtgcggtctacaggatttaagatttccagcgcagtcgcctgcgcttcgggtgtgtgtgtaaccggctctcaatccccctcaacggagatcactctcaagtacccggggattagtcagagctccggaggcgatatcggtgttcatatggcgcacgacgatcagtctgtgagctcaaaaatagtcgcacattgccctccccaggacccatgtctggtgcacgggtgcattgtctgcgcccatggcttaatcaattatcaatgtcacacagctctgagtgccttcgtggttattttcgtgttttccagcaccgcaatcatctgcctcgccgtactttaccgcatgctgaagtgtttgaaaattgctcctagaatagtcctaaaccccctgatgtggatcactgccttcattaggtgggtgtataagaaaatggttgcacgggtggcggataatatcaaccaggtcaatcgcgaaataggatggatggagggcgggcagctcgctctgggaaacccagcccccattcctcgacacgcaccaatcccgagatactctacataccttatgctgttgctcatcgtgtcatatgccagtgct

SEQ ID NO: 11345 - RNA, 1680 nt, synthetic construct
  misc_feature 1..1680: note = derived and/or modified CDS sequence (opt3) from RVFV(SA-51 (Van Wyck))__DQ380195.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacgtggcagcaagaagtgcactggtgacgccgcgttctgttctgcctacgagtgcaccgcacagtatgctaatgcctactgttcccatgctaacgggtcaggaattgtgcaaatccaggtcagcggcgtttggaaaaagccactttgcgtgggctatgaaagagtagtggtcaaaagggagctgagtgccaagcccatacagcgggtggaaccttgtacaacttgcatcaccaaatgtgagccacacgggttggttgtgcgctctacaggatttaagatttccagcgcagtcgcctgcgcttcgggtgtgtgtgtaaccggctctcaatccccctcaacggagatcactctcaagtacccggggattagtcagagctccggaggcgatatcggtgttcacatggcgcatgacgatcagtctgtgagctcaaaaatagtcgcacactgccctccccaggacccatgtctggtgcatgggtgcattgtctgcgcccacggcttaatcaattatcaatgtcatacagctctgagtgccttcgtggttgtgttcgtattttccagcgtcgcaattatctgcctcgccatcctttacaaggtgctgaaatgtttgaagattgctcctagaaaagttctaaaccccctgatgtggataaccgccttcatcaggtgggtgtataagaagatggtcgcacgggtggcggataatattaaccaggtaaatcgcgaaatcggatggatggagggcgggcagctcgctctgggaaacccagcccccatacctcgacacgcaccaattccgagatactctacttaccttatgctgttgctcatcgtgtcatatgccagtgct

SEQ ID NO: 11346 - RNA, 1680 nt, synthetic construct
  misc_feature 1..1680: note = derived and/or modified CDS sequence (opt3) from RVFV(Lunyo)__KU167026.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggtgtccggccagacgaaacgagaactgaagtcatttgacattagtcagtgccctaaaatcgggggacatggcagcaagaagtgcactggtgatgccgcgttctgttctgcctacgagtgcaccgcacagtatgctaatgcctactgttcccacgctaacgggtcaggaattgtccaaatccaggttagcggcgtgtggaaaaagccactttgcgtaggctatgaacgtgtggtcgtgaaaagagagctgagtgccaagcccatacagagggttgaaccttgtacaacttgcatcaccaaatgtgagccacacgggttggtggtccggtctacaggatttaagatttccagcgcagtggcctgcgcttcgggtgtatgtgttaccggctctcaatccccctcaacggagatcactctcaagtacccggggattagtcagagctccggaggcgacatcggtgtgcatatggcgcacgatgaccagtctgtcagctcaaaaatagtggcacattgccctccccaggatccatgtctggtccacgggtgcattgtgtgcgcccatggcttaatcaattatcaatgtcacacagctctgagtgccttcgttgtggtattcgtcttttccagcgtggcaattatctgcctcgccatcctttacaaggttctgaaatgtttgaagattgctcctcgcaaagtgctaaaccccctgatgtggataaccgccttcatcagatgggtctataagaagatggtggcaagggtagcggacaatattaaccaggtgaatcgggaaatcggatggatggagggcgggcagctcgctctgggaaacccagcccccatacctcgccacgcaccaattccgcgatactctacttaccttatgctgttgctcatcgtttcatatgccagtgct

SEQ ID NO: 11347 - RNA, 1680 nt, synthetic construct
  misc_feature 1..1680: note = derived and/or modified CDS sequence (opt3) from RVFV(2269/74)__DQ380222.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaacataagggtaccatggactccggccagacgaaacgagaactgaagtcatttgatattagtcagtgccctaaaatcgggggacacggcagcaagaagtgcactggtgacgccgcgttctgttctgcctacgagtgcaccgcacagtacgctaatgcctattgttcccacgctaacgggtcaggaattgtgcaaatccaggtcagcggcgtttggaaaaagccactttgcgtgggctacgaacgtgtagtggtcaaaagagagctgagtgccaagcccatacagagggtggaaccttgtacaacttgcatcaccaaatgtgagccacatgggttggttgtgcggtctacaggatttaagatttccagcgcagtcgcctgcgcttcgggtgtgtgtgtaaccggctctcaatccccctcaacggagatcactctcaagtatccggggattagtcagagctccggaggcgatatcggtgttcacatggcgcatgacgatcagtctgtgagctcaaaaatagtcgcacactgccctccccaggacccatgtctggtgcatgggtgcattgtctgcgcccacggcttaatcaattaccaatgtcacacagctctgagtgccttcgtggttgtgttcgtattttccagcgtcgcaattatctgcctcgccatcctttataaggtgctgaaatgtttgaagattgctcctaaaaaggttctaaaccccctgatgtggataaccgccttcatccgctgggtgtacaagaaaatggtcgcaagagtggcggataatattaaccaggtaaatagggaaatcggatggatggagggcgggcagctcgctctgggaaacccagcccccatacctcggcatgcaccaattccgcgctattctacttaccttatgctgttgctcatcgtgtcatacgccagtgct

SEQ ID NO: 11348 - RNA, 1680 nt, synthetic construct
  misc_feature 1..1680: note = derived and/or modified CDS sequence (opt3) from RVFV(MgH824)__DQ380210.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggatacaattatattgatggtatgacacaggaagacgcaacttgcaaacccgtaacgtacgccggcgcttgtagctccttcgatgtgttgttagagaaggggaaatttcctctgttccaatcttatgcacatcaccggaccctactcgaagccgtccatgacacaataatcgctaaggccgatccaccctcatgcgacctgcagagtgcgcacggaaacccttgtatgaaagagaaacttgtgatgaagactcattgcccaaatgattaccagagcgcacactatctgaacaatgacggcaaaatggcctccgttaagtgtccccctaaatacgaattgaccgaggattgcaacttttgtcgccagatgacaggtgcttctctcaagaaagggtcgtatccactgcaagacctgttctgccagtcaagcgaggatgacggaagtaagctcaagaccaaaatgaagggcgtgtgtgaagtcggcgtgcaggccttaaagaagtgcgatgggcagctgtccactgcacacgaggtagttccgtttgctgtgttcaaaaattctaagaaagtctaccttgacaagttggacctgaagacagaagagaacctactccccgatagctttgtgtgtttcgagcgaaaaggacaatacaagggtaccatggactccggccagacgaaacgtgaactgaagtcatttgatattagtcagtgccctaaaatcgggggacatggcagcaagaagtgcactggtgacgccgcgttctgttctgcctatgagtgcaccacacagtacgcaaatgcttattgttcccacgccaacgggtcaggagtggtccaaattcaggttagcggcgtgtggaaaaagccactttgcgtaggctacgaaagagtggtcgtgaaaagggagctgagtgctaagcccatccagcgggttgaaccttgtactacctgcataacaaaatgtgagccacatgggttggtggtccgctctaccggatttaagatctccagcgccgtggcatgcgcctcgggtgtatgtgttacgggctctcaatccccctcaactgagattacactcaagtatccggggatcagtcagagctccggaggcgatattggtgtgcacatggctcacgacgatcagtctgtcagctcaaaaatcgtggcgcattgccctccccaggacccatgtctggtccacgggtgcatagtgtgcgcacatggcttaattaattaccaatgtcacaccgccctgagtgctttcgttgtggtattcgtcttttccagcatcgccattatctgcctcgcaatcctttatagagtgctgaagtgtttgaaaattgcccctaggaaggttctaaaccccctgatgtggataactgctttcatccggtggatttacaaaaagatggtggcccgcgtcgcagataatatcaaccaggtgaatcgagaaataggatggatggagggcgggcagctcgtactgggaaacccagcgcccattcctagacatgctccaatcccgaggtactctacatatcttatgctgttgctcatcgtgtcatacgccagtgca

SEQ ID NO: 11349 - RNA, 1680 nt, synthetic construct
  misc_feature 1..1680: note = derived and/or modified CDS sequence (opt3) from RVFV__JQ068143.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccattgactccggccagacgaaacgagaactgaagtcatttgatatcagtcagtgccctaaaattgggggacatggcagcaagaagtgcactggtgacgccgcgttctgttctgcctacgagtgcaccgcacagtatgctaatgcctactgttcccacgctaacgggtcaggaatcgtgcaaatacaggtcagcggcgtttggaaaaagccactttgcgtgggctatgaacgtgtagtggtcaaaagagagctgagtgccaagcccatccagagggtggaaccttgtacaacttgcattaccaaatgtgagccacacgggttggttgtgcggtctacaggatttaagatctccagcgcagtcgcctgcgcttcgggtgtgtgtgtaaccggctctcaatccccctcaacggagattactctcaagtacccggggatcagtcagagctccggaggcgatataggtgttcatatggcgcacgacgatcagtctgtgagctcaaaaattgtcgcacattgccctccccaggacccatgtctggtgcacgggtgcatcgtctgcgcccatggcttaattaattatcaatgtcacacagctctgagtgccttcgtggttgtgttcgtattttccagcgtcgcaatcatctgcctcgccattctttacaaggtgctgcgctgtttgaaaatagctcctaagaaagttctaaaccccctgatgtggatcaccgccttcattagatgggtgtataagaagatggtcgcaagggtggcggataatatcaaccaggtaaatcgggaaataggatggatggagggcgggcagctcgctctgggaaacccagcccccattcctcgccacgcaccaatcccgcgatactctacttaccttatgctgttgctcatcatttcatatgccagtgct

SEQ ID NO: 11350 - RNA, 1680 nt, synthetic construct
  misc_feature 1..1680: note = derived and/or modified CDS sequence (opt3) from RVFV(RVFBJ01/2016)__KX785331.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaacatgaattgaccgaggattgcaacttttgtcgccagatgacaggtgcttctctcaagaaagggtcgtatccactgcaagacctgttctgccagtcaagcgaggatgacggaagtaagctcaagaccaaaatgaagggcgtgtgtgaagtcggcgtgcaggccttaaagaagtgcgatgggcagctgtccactgcacacgaggtagttccgtttgctgtgttcaaaaattctaagaaagtctaccttgacaagttggacctgaagacagaagagaacctactccccgatagctttgtgtgtttcgagcataaaggacaatataagggtaccatggactccggccagacgaaacgagaactgaagtcatttgatattagtcagtgccctaaaatcgggggacacggcagcaagaagtgcactggtgacgccgcgttctgttctgcctacgagtgcaccgcacagtacgctaatgcctattgttcccacgctaacgggtcaggaattgtgcaaatccaggtcagcggcgtttggaaaaagccactttgcgtgggctacgaacgtgtagtggtcaaaagagagctgagtgccaagcccatacagagggtggaaccttgtacaacttgcatcaccaaatgtgagccacatgggttggttgtgcggtctacaggatttaagatttccagcgcagtcgcctgcgcttcgggtgtgtgtgtaaccggctctcaatccccctcaacggagatcactctcaagtatccggggattagtcagagctccggaggcgatatcggtgttcacatggcgcatgacgatcagtctgtgagctcaaaaatagtcgcacactgccctccccaggacccatgtctggtgcatgggtgcattgtctgcgcccacggcttaatcaattaccaatgtcacacagctctgagtgccttcgtggttgtgttcgtattttccagcgtcgcaattatctgcctcgccatcctttataaggtgctgcgctgtttgaaaattgctcctaagaaagttctaaaccccctgatgtggataaccgccttcatcagatgggtgtacaagaagatggtcgcaagggtggcggataatattaaccaggtaaatcgggaaatcggatggatggagggcgggcagctcgctctgggaaacccagcccccatacctcgccatgcaccaattccgcgatattctacttaccttatgctgttgctcatcatctcatacgccagtgct

SEQ ID NO: 11351 - RNA, 1680 nt, synthetic construct
  misc_feature 1..1680: note = derived and/or modified CDS sequence (opt3) from RVFV(KEN/Kil-006/07)__HM586966.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcggatggaaacaaatgtatgaaggagaaacttgtgatgaagactcattgccctaatgactatcagagcgcacactacctgaacaatgatggcaagatggcctccgttaaatgtccacccaagtatgaattgaccgaggactgcaacttttgtcgccagatgacaggtgcttctctcaaaaaggggtcgtaccctctgcaagatctgttctgccagtcaagcgaggacgatggaagtaagctcaaaaccaagatgaaaggcgtgtgtgaagtcggcgtgcaggccttaaagaaatgcgacgggcagctgtccactgcacacgaggtagttccatttgctgtgttcaaaaattctaagaaggtctatcttgacaagttggatctgaaaacagaagagaacctactcccggacagctttgtgtgtttcgagcataagggacaatacaaaggtaccatggattccggccagacgaagcgagaactgaaatcatttgacattagtcagtgccccaagatcgggggacacggcagcaagaaatgcactggtgatgccgcgttctgttctgcctacgagtgcaccgcacagtatgctaatgcctactgttcccatgctaacgggtcaggaattgtgcaaatccaggtcagcggcgtttggaagaaacctctttgcgtgggctatgaacgtgtagtggtcaagagagagctgagtgccaaaccaatacagagggtggaaccctgtacaacttgcatcaccaagtgtgagcctcacgggttggttgtgcggtctacaggatttaagatttccagcgcagtcgcctgcgcttcgggtgtgtgtgtaaccggctctcaatccccatcaacggagatcactctcaaataccccgggattagtcagagctccggaggcgacatcggtgttcacatggcgcatgatgaccagtctgtgagctcaaagatagtcgcacactgcccgcctcaggatccctgtctggtgcatgggtgcattgtctgcgcccacggcttaatcaattatcaatgtcatacagctctgagtgccttcgtggttattttcgtgttttccagcaccgcaatcatctgcctcgccgtactttaccgcgtcctgaaatgtttgaagattgctccaagaaaagtgctaaaccctctgatgtggataactgccttcatcaggtgggtttataagaagatggtggcacgggtcgcggacaatattaaccaggtgaatcgcgaaatcggatggatggagggcgggcagctcgctctgggaaaccccgccccaataccccgacacgcacctattccaagatactctacataccttatgctgttgctcatcgtatcatatgccagtgct

SEQ ID NO: 11352 - RNA, 1680 nt, synthetic construct
  misc_feature 1..1680: note = derived and/or modified CDS sequence (opt3) from RVFV(SA-75)__DQ380189.1__Gn
  source 1..1680: mol_type = other RNA
atggccagaatcgctatgaccgtgctgcccgcactcgccgtcttcgcgcttgctcctgttgtgtttgccgaggacccacacctgaggaaccggccgggcaaggggcataattacattgatggaatgacacaggaagacgcaacttgcaaacccgtaacgtatgccggtgcttgtagctccttcgatgtgttgttagagaagggcaaatttcctctgttccaatcttacgcacaccatcgcaccctactcgaagccgtccacgacacaataatcgctaaggccgatccaccctcatgcgacctgcagagtgcgcatgggaacccttgtatgaaagagaaacttgtgatgaagactcactgcccaaatgattatcagagcgcacactacctgaacaatgacggaaaaatggcctccgttaagtgtccccctaaatatgaattgaccgaggattgcaacttttgtcgacagatgacaggcgcttctctcaagaaaggttcgtacccactgcaagacctgttctgccagtcaagcgaggatgacgggagtaagctcaagaccaaaatgaagggagtgtgtgaagtcggcgtgcaggccttaaagaagtgcgatggccagctgtccactgcacatgaggtagttccgtttgctgtgttcaaaaattctaagaaagtctatcttgacaagttggacctgaagacagaagagaacctactccccgatagctttgtgtgtttcgagcacaaagggcaatacaagggaaccatggactccggtcagacgaaacgtgaactgaagtcatttgatattagtcagtgccctaaaatcggcgggcatggaagcaagaagtgcactggcgacgccgcgttctgttctgcctacgagtgcaccgcacagtatgctaatgcctactgttcccacgctaacggttcaggggtggtccaaattcaggttagcggagtgtggaaaaagccactttgcgtaggctatgaaagagtggtcgtgaaaagggagctgagtgccaagcccatccagcgggttgaaccttgtacaacttgcataaccaaatgtgagccacacggcttggtggtccgctctacagggtttaagatctccagcgcagtggcctgcgcttcgggagtatgtgttaccggttctcaatccccctcaacggagattactctcaagtacccgggcatcagtcagagctccgggggagatattggcgtgcatatggcgcacgacgatcagtctgtcagctcaaaaatcgtggcacattgccctccccaggacccatgtctggtccacggttgcatagtgtgcgcccatgggttaattaattatcaatgtcacacagctctgagtgccttcgttgtggtattcgtcttttccagcgtggcaatcatttgcctcgccatcctttacaaggttctgaaatgtttgaagatcgctcctagaaaagtgctaaaccccctgatgtggattaccgtcttcataaggtgggtgtataagaagatggtagcccgggtggcagataatatcaaccaggttaatcgcgaaattggctggatggagggaggccagctcgcgctggggaacccagctcccatccctcgacacgccccaataccgagatactctacttaccttatgctgttgctcattgtctcatatgcaagtgcc

SEQ ID NO: 11353 - RNA, 1680 nt, synthetic construct
  misc_feature 1..1680: note = derived and/or modified CDS sequence (opt3) from RVFV(35/74)__JF784387.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggagtggtccaaattcaggttagcggcgtgtggaaaaagccactttgcgtaggctatgaacgtgtggtcgtgaaaagagagctgagtgccaagcccatccagagggttgaaccttgtacaacttgcataaccaaatgtgagccacacgggttggtggtccggtctacaggatttaagatctccagcgcagtggcctgcgcttcgggtgtatgtgttaccggctctcaatccccctcaacggagattactctcaagtacccggggatcagtcagagctccggaggcgatattggtgtgcatatggcgcacgacgatcagtctgtcagctcaaaaatcgtggcacattgccctccccaggacccatgtctggtccacgggtgcatagtgtgcgcccatggcttaattaattatcaatgtcacacagctctgagtgccttcgttgtggtattcgtcttttccagcgtggcaatcatttgcctcgccatcctttacaaggttctgaaatgtttgaagatcgctcctcgcaaagtgctagatcccctgatgtggattaccgtcttcataagatgggtgtataagaagatggtagccagggtggcagacaacatcaatcaggttaaccgggaaattggatggatggagggcgggcagctcgcgctgggaaatccagctcccatccctcgccacgccccaataccgcgatactctacttaccttatgctgttgctcattgtctcatatgcaagtgcc

SEQ ID NO: 11354 - RNA, 1680 nt, synthetic construct
  misc_feature 1..1680: note = derived and/or modified CDS sequence (opt3) from RVFV__M11157.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaagatggcctccgttaagtgtccccctaaatatggtttgaccgaagattgcaacttttgtcgccagatgacaggggcttctctcaagaaaggatcgtacccactgcaagacctgttctgccagtcaagcgaggatgacggcagtaagctcaagaccaaaatgaagggcgtgtgtgaggtcggggtgcaggcccataaaaagtgcgatggacagttatccactgcacacgaagtagttccgtttgctgtgttcaaaaattctaagaaagtctatctggacaaacttgacttgaagacagaggaaaacctgctacccgatagctttgtgtgtttcgagcataagggtcaatacaagggcaccatggactccgggcagacgaaacgagagctcaagtcatttgatattagtcagtgccctaaaatcggaggccacggtagcaagaagtgcactggggacgccgcgttctgttctgcctacgaatgcaccgcacagtatgctaatgcctactgttcccacgctaacggatcaggcattgtgcaaatccaggtcagcggcgtttggaaaaagccactgtgcgtggggtatgagcgtgtagtggtcaaaagagaacttagtgccaagcccatacagagggtggagccttgtacaacttgcatcaccaaatgtgaaccacatggactggttgtgcggtctacaggttttaagatttccagcgcagtcgcctgcgcttcgggcgtgtgtgtaaccgggtctcaatccccctcaacggagatcactttgaagtacccgggaattagtcagagctccggcggtgatatcggggttcacatggcgcatgacgatcagtctgtgagctcaaaaatagtcgcacactgccctccccaggacccatgtctcgtgcatggctgcattgtctgcgcccacggactgatcaattatcaatgtcacacagctttaagtgccttcgtggttgtgttcgtattttccagcattgcaatcatctgcctggccgtcctctaccgcgtgcttaagtgtctgaaaattgctcctagaaaggttttgaaccccctaatgtggataaccgccttcatcaggtggatttataaaaagatggtggcacgggtcgcgcataatatcaaccaggtgaatcgcgagataggctggatggaagggggacagctggtactcggtaacccagctcccattcctcgacacgccccaatcccgagatactctacttacctgatgcttctgttgatcgtgtcatatgcaagtgcc

SEQ ID NO: 11355 - RNA, 1680 nt, synthetic construct
  misc_feature 1..1680: note = derived and/or modified CDS sequence (opt3) from RVFV(KEN/Bar-035/07)__HM586969.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtcggttgcaggaagacgcaacatgcaaacccgtaacttatgccggcgcttgtagctccttcgatgtgttactggagaaggggaaatttcctctattccaatcttacgcacaccatcgcacgctcctggaagccgtccacgacaccataatcgctaaggccgatccaccctcatgcgaccttcagagtgcggatggaaacaaatgtatgaaggagaagctggtgatgaaaacacattgccctaatgactatcagagcgcacactacttgaacaatgatggcaagatggcctccgttaaatgtccacccaagtatgaactcactgaggactgcaacttttgtcgacagatgaccggtgcttctctgaaaaaggggtcgtaccctctgcaagatctcttctgccagtcaagcgaggacgatggaagtaagttaaaaacaaagatgaaaggcgtgtgtgaagtcggcgtgcaggccctgaagaaatgcgacgggcagctttccaccgcacacgaggtagttccatttgctgtgttcaaaaattctaagaaggtctatttggacaagctggatctaaaaactgaagagaacctcctgccggacagctttgtgtgtttcgagcataagggacaatacaaaggtacaatggattccggccagaccaagcgtgaacttaaatcatttgacattagtcagtgccccaagatcgggggacacggcagcaagaaatgcacgggtgatgccgcgttctgttctgcctacgagtgcactgcacagtatgctaatgcctactgttcccatgctaacgggtcaggaattgtgcaaatccaggtcagcggcgtttggaagaaacctctgtgcgtgggctatgaaagagtagtggtcaagagggagttgagtgccaaaccaatacagcgggtggaaccctgtaccacatgcatcactaagtgtgagcctcacgggctcgttgtgcgctctaccggatttaagatttccagcgcagtcgcctgcgcttcgggtgtgtgtgtaacaggctctcaatccccatcaaccgagatcacgctgaaataccccgggattagtcagagctccggaggcgacatcggtgttcacatggcgcatgatgaccagtctgtgagctcaaagatagtcgcacactgcccgcctcaggatccctgtttagtgcatgggtgcattgtctgcgcccacggcctgatcaattatcaatgtcatactgctctcagtgccttcgtggttattttcgtgttttccagcacagcaatcatctgccttgccgtactgtacagagtcttgaaatgtctaaagattgctccaaggaaagtgctgaaccctctcatgtggataaccgccttcatccggtgggtttataagaagatggtggcacgcgtcgcggacaatattaaccaggtgaatcgagaaatcggatggatggagggcgggcagctggctcttggaaaccccgccccaatacccagacacgcacctattccaaggtactctacttacctgatgttgctcctgatcgtatcatatgccagtgct

SEQ ID NO: 11356 - RNA, 1680 nt, synthetic construct
  misc_feature 1..1680: note = derived and/or modified CDS sequence (opt3) from RVFV(Kenya 56 (IB8))__DQ380190.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacagggcgacgcaacttgcaaacccgtaacgtatgccggggcttgtagctccttcgatgtgttgttagaaaagggaaaatttcctctgttccaatcttacgcacaccatcggaccctactcgaggccgtccacgacacaataatcgctaaggccgatccaccctcatgcgacctgcagagtgcgcatggcaacccttgtatgaaagaaaaacttgtgatgaagactcactgcccaaaggattatcagagcgcacactacctgaataacgacggtaagatggcctccgttaaatgtccccctaagtatgagttgaccgaagattgcaatttttgtcgccagatgacaggggcttctctcaaaaagggatcgtacccactgcaagacctgttctgccagtcaagcgaggatgacggcagtaagctcaaaaccaagatgaaaggcgtgtgtgaggtcggggtgcaggccttaaagaaatgcgatggacagctgtccactgcacatgaagtagttccgtttgctgtgttcaagaactctaaaaaggtctatcttgacaagttggacctgaaaacagaggaaaatctactccccgatagctttgtgtgtttcgagcacaagggtcaatacaaaggcaccatggactccgggcagacgaagcgagagctgaaatcatttgatattagtcagtgccctaagatcggaggccatggtagcaagaaatgcactggggacgccgcgttctgttctgcctacgaatgcaccgcacagtatgctaacgcctactgttcccacgctaatggatcaggcattgtgcaaatccaggtcagcggcgtttggaagcgtccactttgcgtggggtatgagagagtagtggtcaaaagggaactgagtgccaagcccatacagcgggtggagccttgtacaacttgcatcaccaaatgtgaaccacacggattggttgtgcgctctacaggttttaagatttccagcgcagtcgcctgcgcttcgggcgtgtgtgtaaccgggtctcaatccccctcaacggagatcactctcaagtacccgggaatgagtcagagctccggcggtgatattggggttcatatggcgcacgacgatcagtctgtgagctcaaaaatcgtcgcacattgccctccccaggacccatgtctggtgcacggctgcatagtctgcgcccatggattaattaactatcaatgtcacacagctctgagtgccttcgtggttgtgttcgtattttccagcgtcgcaatcatttgcctcgccatcctttacaaggtgctgaaatgtttgaagatcgctcctagaaaagttctaaatcccctgatgtggattaccgccttcataaggtgggtgtataagaagatggtcgcacgggtggcggataacatcaatcaggtaaaccgcgagattggctggatggaagggggacagccagctctcggtaatcccgcccctatcccacgacacgcaccgatacccagatactctacttacctgatgcttctgttgattgtgtcatatgccagtgct

SEQ ID NO: 11357 - RNA, 1680 nt, synthetic construct
  misc_feature 1..1680: note = derived and/or modified CDS sequence (opt3) from RVFV(KEN/Bar-032/07)__HM586968.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtcggttgcaggaagacgcaacatgcaaacccgtaacttatgccggcgcttgtagctccttcgatgtgttactggagaaggggaaatttcctctattccaatcttacgcacaccatcgcacgctcctggaagccgtccacgacaccataatcgctaaggccgatccaccctcatgcgaccttcagagtgcggatggaaacaaatgtatgaaggagaagctggtgatgaaaacacattgccctaatgactatcagagcgcacactacttgaacaatgatggcaagatggcctccgttaaatgtccacccaagtatgaactcactgaggactgcaacttttgtcgacagatgaccggtgcttctctgaaaaaggggtcgtaccctctgcaagatctcttctgccagtcaagcgaggacgatggaagtaagttaaaaacaaagatgaaaggcgtgtgtgaagtcggcgtgcaggccctgaagaaatgcgacgggcagctttccaccgcacacgaggtagttccatttgctgtgttcaaaaattctaagaaggtctatttggacaagctggatctaaaaactgaagagaacctcctgccggacagctttgtgtgtttcgagcataagggacaatacaaaggtacaatggattccggccagaccaagcgtgaacttaaatcatttgacattagtcagtgccccaagatcgggggacacggcagcaagaaatgcacgggtgatgccgcgttctgttctgcctacgagtgcactgcacagtatgctaatgcctactgttcccatgctaacgggtcaggaattgtgcaaatccaggtcagcggcgtttggaagaaacctctgtgcgtgggctatgaaagagtagtggtcaagagggagttgagtgccaaaccaatacagcgggtggaaccctgtaccacatgcatcactaagtgtgagcctcacgggctcgttgtgcgctctaccggatttaagatttccagcgcagtcgcctgcgcttcgggtgtgtgtgtaacaggctctcaatccccatcaaccgagatcacgctgaaataccccgggattagtcagagctccgttggagacatcggcgtgcacatggcgcatgatgaccagtctgtcagctcaaagatagtggcacactgcccgcctcaggatccctgtttagtccatggttgcattgtgtgcgcccacgggctgatcaattatcaatgtcatactgctctcagtgccttcgttgtgattttcgtattttccagcacagcaatcatctgccttgccgtcctgtacagagtgttgaaatgtctaaagattgctccaaggaaagttctgaaccctctcatgtggataaccgccttcatccggtgggtgtataagaagatggtcgcacgcgtggcggacaatattaaccaggtaaatcgagaaatcggctggatggagggaggccagctggctcttgggaaccccgccccaatacccagacacgcacctattccaaggtactctacttacctgatgttgctcctgatcgtgtcatatgccagtgct

SEQ ID NO: 11358 - RNA, 1680 nt, synthetic construct
  misc_feature 1..1680: note = derived and/or modified CDS sequence (opt3) from RVFV(Beijing-01)__KX611606.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtgtaacacaggaagacgcaacttgcaaacccgtgacgtatgccggcgcttgtagctccttcgatgtcttgttagagaaggggaaatttcctctgttccaatcttacgcacaccatcggaccctactcgaagccgtgcacgacacaataatcgctaaggccgatccaccctcatgcgacctgcagagtgcgcatggaaacccttgtatgaaagagaaacttgttatgaagactcactgcccaaatgattatcagagcgcacactacctgaacaatgacggcaaaatggcctccgtgaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtctgtgaagtgggcgtacaggccttaaagaagtgcgatgggcgactgtccactgcacatgaggttgtgccgtttgctgtcttcaaaaattctaagaaagtgtatcttgacaagttggacctgaagacagaagagaacctactccccgatagctttgtgtgtttcgagcacaaaggacagtacaagggtaccatggactccggccaaacgaaacgtgaactgaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtccagatccaagttagcggcgtgtggaaaaagccactttgcgtaggctatgaaagagtggtcgtgaaaagggagctgagtgccaagcccatacagcgggttgaaccttgtacaacttgcatcaccaaatgtgagccacacgggttggtggtccgctctacaggatttaagatttccagcgcagtggcctgcgcttcgggtgtatgtgttaccggctctcagtccccctcaacggagatcactctcaagtacccggggattagtcaaagctccggaggcgatatcggtgtgcatatggcgcacgacgatcagtctgtcagctcaaaaatagtgttcgactgccctccccaggatccatgtctggtccatgggtgcattgtgtgcgcacacggcttaatcaattatcagtgtcatacagccctgagtgctttcgttgtggtatttgtcttctccagcgtggccattatctgcctcgcaatcctttacaaggttctgagatgtttgaaaattgcccctaagaaagtgctaaaccccctgatgtggataaccgcttttatcaggtgggtctataagaagatggtggcccgggtagcagacaatattaaccaagtgaatcgcgaaatcggatggatggagggcgggcagctcgcgctgggaaacccagctcccatacctcgacacgccccaattccgagatactctacttaccttatgctgttgctcatcatctcatatgcaagtgcc

SEQ ID NO: 11359 - RNA, 1680 nt, synthetic construct
  misc_feature 1..1680: note = derived and/or modified CDS sequence (opt3) from RVFV(Smithburn)__DQ380193.1__Gn
  source 1..1680: mol_type = other RNA
atggccggcatcgctatgaccgtgttccccgcactggtcgtttttgccctcgcgcctgtggtattcgctgaggacccacaccttagaaacaggccggggaagggacataattacattgatggtatgacacaggaagacgccacttgcaaacccgtgacgtatgcaggcgcctgtagctcctttgatgtcctgttggagaaggggaaattccctttatttcaatcttacgctcaccatcggaccctgctagaagcagtgcacgacataatcattgccaaggctgatccaccctcatgcaacctccagagtgcccatggaaatccttgtatgaaagagaagctggttatgaagacatattgcccaaacgactaccagagcgcgcactatcttaataacgatggcaaaatggcatccgtgaagtgtccccctaaacacgaactgactgaggactgcaatttctgtcgccagatgaccggtgcctctttgaaggaggggtcgtacccactccaagatctgttttgccagtcaagcgaagacgatggaagtaaactgaagacaaagatgaaaggcgtctgtgaggtgggcgtacaggttctcaagaaatgcgacgggcagttatccaccgctcatgaagtggtcccgttcgccgtgtttaagaactctaaaaaggtgtatctggataaacttgacttgaagactgaggagaatctgctacccgacagcttcgtctgttttgaacacaagggacaatacaaaggtacaatggattccggccagatcaagcgagagctcaaatcattcgacattagtcagtgccctaagatcgggggacatggcagcaaaaagtgcaccggtgatgcagctttttgttctgcctacgaatgcacggcgcagtatgccaacgcatactgttcccacgctaatgggtcaggaatagttcaaatccaggtgagcggcgtatggaagaaaccactgtgcgtgggctatgagcgtgtcgtggttaagagagaacttagtgccaaacccattcagagggtggagccttgtactacctgcatcacaaagtgtgagccacacgggctggtcgtgcggtctactggattcaaaatttccagcgctgtagcctgcgcatcgggtgtttgtgtgaccggctctcaatccccctcaacagaaatcaccttgaagtacccggggataagtcagagctccggaggcgacattggtgtccatatggcccacgatgaccagtctgtgagctcaaagatcgtcgctcattgccctccccaggatccatgtctcgtgcacgggtgcattgtttgcgcgcatggcctgatcaactatcaatgtcacacggcattcagtgcctttgtggtagtcttcgtgttttccagcgttgtgatcatttgcttagctatactgtacaaagtcctcaagtgtcttaaaatcgcccctcgcaaggtgctgaatcccttgatgtggattactgcattcatcagatgggtatataaaaagatggtggccagggttgctgacaacataaatcaggtcaaccgggagattggatggatggaaggcgggcagctagtgctgggaaacccagcccccatccctcgccacgcaccaatcccgcgatactctacatacctcatgctgcttctgattgtgtcatatgcgagtgct

SEQ ID NO: 11360 - RNA, 1680 nt, synthetic construct
  misc_feature 1..1680: note = derived and/or modified CDS sequence (opt3) from RVFV(TAN/Dod-002/07)__HM586971.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctaagaaagtctatcttgacaagttggacctgaagacagaagagaacctactccccgatagctttgtgtgtttcgagcacaaaggacaatacaagggtaccatggactccggccagacgaaacgagaactgaagtcatttgatattagtcagtgccctaaaatcgggggacatggccgtaagaagtgcactggtgacgccgcgttctgtagcgcctacgagtgcaccgcacagtatgctaatgcctactgttctcacgctaacgggtccggaattgtgcaaatccaggtctcaggcgtttggaaaaagccactttgcgtgggctatgaaagagtagtggtcaaaagggagctgagcgccaagcccatacagcgggtggaaccttgtacaacttgcatcaccaaatgtgagccacacgggttggttgtgcgcagtacaggatttaagatttcttccgcagtcgcctgcgctagcggtgtgtgtgtaaccggctcgcaatctccctccacggagatcactctcaagtacccggggatttcacagagtagcggaggcgatatcggtgttcatatggcgcacgacgatcagtccgtgtctagcaaaatagtcgcacattgccctccccaggacccatgtctggtgcacgggtgcattgtctgcgcccaggcttggatcatttcacaatggcatacagccttaagtgcattcgtggttatcttcgtgttttccagcaccgccatcatttgtctggctgtactctatagagtccttaagtgcctgaaaatagcccctaggaaggtgttgaatcccctaatgtggatcactgcattcattcggtgggtttacaaaaagatggtggcgcgcgtcgctgataacatcaatcaggtgaaccgagaaataggctggatggagggaggccagctggccctcgggaatccagcacccattcctagacacgccccaatcccgaggtattctacatacctgatgcttctgttgatcgtatcatacgctagtgcc

SEQ ID NO: 11361 - RNA, 1680 nt, synthetic construct
  misc_feature 1..1680: note = derived and/or modified CDS sequence (opt3) from RVFV(KEN/Gar-004/06)__HM586964.1__Gn
  source 1..1680: mol_type = other RNA
atggccggcatcgctatgaccgtgctgcccgcactcgccgtcttcgcgcttgctcctgttgtgtttgccgaggacccacacctgagaaacaggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcagagtgcgcatggaaacccttgtatgaaagagaaacttgtgatgaagactcactgcccaaatgattatcagagcgcacactacctgaacaatgacggcaaaatggcctccgttaagtgtccccctaaatatgaattgaccgaggattgcaacttttgtcgccagatgacaggtgcttctctcaagaaagggtcgtacccactgcaagacctgttctgccagtcaagcgaggatgacggaagtaagctcaagaccaaaatgaagggcgtgtgtgaagtcggcgtgcaggccttaaagaagtgcgatgggcagctgtccactgcacatgaggtagttccgtttgctgtgttcaaaaattctcaaaaggtctatcttgacaaattggacctgaagacagaagagaacctactccccgatagctttgtgtgtttcgagcacaagggacagtacaaaggtaccatggactccggccagacgaagcgagaactgaaatcatttgatattagtcagtgccctaagatcgggggacatggccgtaaaaagagaactggtgacgccgcgttctgcagcgcctacgagtgtaccgcacaatatgctaatgcctactgctctagggctaacgggtccggaattgtgcagatccaggtctcacgggtttggaagaaaccactttgtgtgggctatgaacgcgtagtggtcaagagagagctgagcgccaaacccatacaaagggtggaaccttgcacaacttgtatcaccaagtgcgagccacacggcttggttgtgcggagtacagggtttaaaatttcttccgcagtcgcctgtgctagcggagtgtgcgtaaccggttcgcagtctccctccacggagatcactctcaagtacccgggcatttcacagagtagcgggggagatatcggcgttcacatggcgcatgacgatcagtccgtgtctagcaagatagtcgcacactgtcctccccaagacccatgcctggtgcatggttgtattgtctgcgcccacgggttaatcaataaccagtcacatagtgctctgtccgccttcgtggttattttcgtgtttagctctacagcaatcatctgcctcgccgtactttatcgcgtcctgaaatgtttgaagattgctcctcgaaaagtgctaaatcccctgatgtggataaccgccttcatcagatgggtttacaagaaaatggtggcaagggtcgcggataacattaatcaggtgaaccgggaaatcggctggatggagggaggccagctcgctctggggaacccagcccccatacctcgtcacgcaccaattccgcgctattcaacttaccttatgctgttgctcatcgtaagttacgccagcgct

SEQ ID NO: 11362 - RNA, 1521 nt, synthetic construct
  misc_feature 1..1521: note = derived and/or modified CDS sequence (opt3) from RVFV(ZH-548)__DQ380206.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggaagaccaaacaaaattcttaaagatcaaaactgtgtcctctgagctgtcgtgccgcgaagggcagtcatactggaccgggagctttagtcccaagtgtctatcctctcgacgttgccacctcgtaggcgagtgtcatgtgaatagatgcctgagctggagggataacgagacatccgctgagttctcatttgtcggtgaaagtaccactatgcgggaaaataagtgtttcgagcagtgcgggggatggggctgtggctgctttaacgtgaatcctagctgccttttcgttcacacatatctgcagtctgtgcgcaaagaggccttgagagtctttaactgtattgactgggtgcataagctcaccctggaaatcacggatttcgacgggtccgtatcaactattgatctgggagcaagcagttctaggtttaccaattggggttccgttagcctctcgttagacgccgagggcatctctgggtccaactcattcagttttatagaaagcccaggaaaaggctacgctatcgtggatgagccgttctccgaaattccccggcaaggttttctgggggagatccgctgcaattctgagagctcagtccttagtgcacacgaatcctgtttgcgagcccctaacctgattagctataagccaatgatcgaccagctagagtgcacaactaatctcatagatcccttcgtggtgttcgaaagaggatctctgcctcagaccaggaacgacaaaacatttgctgcctcaaagggcaatcggggcgtccaggcgttcagtaaggggagcgttcaagcagatcttaccctgatgtttgacaacttcgaggtggattttgtaggagccgctgtgtcctgtgacgccgcattcttgaatctcacgggttgctactcttgtaacgctggcgcccgtgtctgcctgtcgattactagcacagggaccggatccttatcagcgcataacaaagacggcagtctgcacatcgtgctcccatctgaaaatggtactaaggatcagtgtcagattcttcactttacagttcccgaggtggaggaagagttcatgtatagctgcgacggggatgaacgccctctgttggtcaaaggcaccctaatcgccatcgacccatttgatgacagaagggaggcaggaggcgaatccacggtggtaaacccgaagtcagggagctggaatttctttgattggttctctggactgatgtcctggtttggtggccccctcaaaaccattctgcttatatgtctgtacgttgctttgagtatcggactcttcttcctgttaatttatctgggacggacaggcctaagcaagatgtggctcgccgctactaaaaaggcctct

SEQ ID NO: 11363 - RNA, 1521 nt, synthetic construct
  misc_feature 1..1521: note = derived and/or modified CDS sequence (opt3) from RVFV(35/74)__JF784387.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggaagaccaaacaaaattcttaaagatcaaaactgtgtcctctgagctgtcgtgccgcgaagggcagtcatactggaccgggagctttagtcccaagtgtctatcctctcgacgttgccacctcgtaggcgagtgtcatgtgaatagatgcctgagctggagggataacgagacatccgctgagttctcatttgtcggtgaaagtaccactatgcgggaaaataagtgtttcgagcagtgcgggggatggggctgtggctgctttaacgtgaatcctagctgccttttcgttcacacatatctgcagtctgtgcgcaaagaggccttgagagtctttaactgtattgactgggtgcataagctcaccctggaaatcacggatttcgacgggtccgtatcaactattgatctgggagcaagcagttctaggtttaccaattggggttccgttagcctctcgttagacgccgagggcatctctgggtccaactcattcagttttatagaaagcccaggaaaaggctacgctatcgtggatgagccgttctccgaaattccccggcaaggttttctgggggagatccgctgcaattctgagagctcagtccttagtgcacacgaatcctgtttgcgagcccctaacctgattagctataagccaatgatcgaccagctagagtgcacaactaatctcatagatcccttcgtggtgttcgaaagaggatctctgcctcagaccaggaacgacaaaacatttgctgcctcaaagggcaatcggggcgtccaggcgttcagtaaggggagcgttcaagcagatcttaccctgatgtttgacaacttcgaggtggattttgtaggagccgctgtgtcctgtgacgccgcattcttgaatctcacgggttgctactcttgtaacgctggcgcccgtgtctgcctgtcgattactagcacagggaccggaactttatccgcgcataacaaagacggctcactgcacatcgtgctcccaagtgaaaatggtacaaaggatcagtgtcagattcttcactttaccgttcccgaggtggaggaagagttcatgtattcttgcgacggggatgaacgccctctgttggtcaaaggcacgctaatcgccatcgacccatttgatgacagaagggaggcaggaggcgaaagcaccgtggtaaacccgaagtccgggtcatggaatttctttgattggttcagcggactgatgtcttggtttggtggccccctcaaaacaattctgcttatatgtctgtacgttgctttgtccatcggactcttcttcctgttaatttatctgggacggactggcctaagtaagatgtggctcgccgctaccaaaaaggccagc

SEQ ID NO: 11364 - RNA, 1521 nt, synthetic construct
  misc_feature 1..1521: note = derived and/or modified CDS sequence (opt3) from RVFV(200803162)__JF311377.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggaagaccaaacaaaattcttaaagatcaaaactgtgtcctctgagctgtcgtgccgcgaagggcagtcatactggaccgggagctttagtcccaagtgtctatcctctcgacgttgccacctcgtaggcgagtgtcatgtgaatagatgcctgagctggagggataacgagacatccgctgagttctcatttgtcggtgaaagtaccactatgcgggaaaataagtgtttcgagcagtgcgggggatggggctgtggctgctttaacgtgaatcctagctgccttttcgttcacacatatctgcagtctgtgcgcaaagaggccttgagagtctttaactgtattgactgggtgcataagctcaccctggaaatcacggatttcgacgggtccgtatcaactattgatctgggagcaagcagttctaggtttaccaattggggttccgttagcctctcgttagacgccgagggcatctctgggtccaactcattcagttttatagaaagcccaggaaaaggctacgctatcgtggatgagccgttctccgaaattccccggcaaggttttctgggggagatccgctgcaattctgagagctcagtccttagtgcacacgaatcctgtttgcgagcccctaacctggtgagctataagccaatgattgaccagctagagtgcacaactaatctcatcgatcccttcgtggtcttcgaaagaggatctctgcctcagaccaggaacgacaaaacatttgctgcctcaaagggcaatcggggcgttcaggcgttcagtaaggggagcgtgcaagcagatcttaccctgatgtttgacaacttcgaggtagattttgtgggagccgctgtctcctgtgacgccgcattcttgaatctcacgggttgctactcttgtaacgctggcgcccgtgtgtgcctgtcgataactagcacagggaccggaactttatccgcgcataacaaagacggctcactgcacattgttctcccaagtgaaaatggtacaaaggatcagtgtcagatccttcactttaccgtgcccgaggtcgaggaagagttcatgtattcttgcgacggggatgaacgccctctgttggtgaaaggcacgctaattgccatcgacccatttgatgacagaagggaggcaggaggcgaaagcaccgtagttaacccgaagtccgggtcatggaatttctttgattggttcagcggactgatgtcttggtttggtggccccctcaaaacaatcctgcttatttgtctgtacgtggctttgtccataggactcttcttcctgttaatctatctgggacggactggcctaagtaagatgtggctcgccgctaccaaaaaggccagc

SEQ ID NO: 11365 - RNA, 1521 nt, synthetic construct
  misc_feature 1..1521: note = derived and/or modified CDS sequence (opt3) from RVFV(200803166)__JF311381.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggaagaccaaacaaaattcttaaagatcaaaactgtgtcctctgagctgtcgtgccgcgaagggcagtcatactggaccgggagctttagtcccaagtgtctatcctctcgacgttgccacctcgtaggcgagtgtcatgtgaatagatgcctgagctggagggataacgagacatccgctgagttctcatttgtcggtgaaagtaccactatgcgggaaaataagtgtttcgagcagtgcgggggatggggctgtggctgctttaacgtgaatcctagctgccttttcgttcacacatatctgcagtctgtgcgcaaagaggccttgagagtctttaactgtattgactgggtgcataagctcaccctggaaatcacggatttcgacgggtccgtatcaactattgatctgggagcaagcagttctaggtttaccaattggggttccgttagcctctcgttagacgccgagggcatctctgggtccaactcattcagttttatagaaagcccaggaaaaggctacgctatcgtggatgagccgttctccgaaattccccggcaaggttttctgggggagatccgctgcaattctgagagctcagtccttagtgcacacgaatcctgtttgcgagcccctaacctgattagctataagccaatgatcgaccagctagagtgcacaactaatctcatagatcccttcgtggtgttcgaaagaggatctctgcctcagaccaggaacgacaaaacatttgctgcctcaaagggcaatcggggcgtccaggcgttcagtaaggggagcgttcaagcagatcttaccctgatgtttgacaacttcgaggtggattttgtaggagccgctgtgtcctgtgacgccgcattcttgaatctcacgggttgctactcttgtaacgctggcgcccgtgtctgcctgtcgattactagcacagggaccggaactttatccgcgcataacaaagacggctcactgcacgtggttctcccaagtgaaaatggtacaaaggatcagtgtcagatccttcactttaccgtgcccgaggtcgaggaagagttcatgtattcttgcgacggggatgaacgccctctgttggtgaaaggcacgctaattgccatcgacccatttgatgacagaagggaggcaggaggcgaaagcaccgtagttaacccgaagtccgggtcatggaatttctttgattggttcagcggactgatgtcttggtttggtggccccctcaaaacaatcctgcttatttgtctgtacgtggctttgtccataggactcttcttcctgttaatctatctgggacggactggcctaagtaagatgtggctcgccgctaccaaaaaggccagc

SEQ ID NO: 11366 - RNA, 1521 nt, synthetic construct
  misc_feature 1..1521: note = derived and/or modified CDS sequence (opt3) from RVFV(SA-51 (Van Wyck))__DQ380195.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggaagaccaaacaaaattcttaaagatcaaaactgtgtcctctgagctgtcgtgccgcgaagggcagtcatactggaccgggagctttagtcccaagtgtctatcctctcgacgttgccacctcgtaggcgagtgtcatgtgaatagatgcctgagctggagggataacgagacatccgctgagttctcatttgtcggtgaaagtaccactatgcgggaaaataagtgtttcgagcagtgcgggggatggggctgtggctgctttaacgtgaatcctagctgccttttcgttcacacatatctgcagtctgtgcgcaaagaggccttgagagtctttaactgtattgactgggtgcataagctcaccctggaagtaacggatttcgacgggtccgtttcaactatcgatctgggagcaagcagttctaggtttaccaattggggttccgtgagcctctcgttagacgccgagggcatttctgggtccaactcattcagttttatcgaaagcccaggaaaaggctacgctatagtcgatgagccgttctccgaaatcccccggcaaggttttctgggggagattcgctgcaattctgagagctcagtgcttagtgcacacgaatcctgtttgcgagcccctaacctgatcagctataagccaatgattgaccagctagagtgcacaactaatctcatcgatcccttcgtggtcttcgaaagaggatctctgcctcagaccaggaacgacaaaacatttgctgcctcaaagggcaatcggggcgttcaggcgttcagtaaggggagcgtgcaagcagatcttaccctgatgtttgacaacttcgaggtagattttgtgggagccgctgtctcctgtgacgccgcattcttgaatctcacgggttgctactcttgtaacgctggcgcccgtgtgtgcctgtcgataactagcacagggaccggaactttatccgcgcataacaaagacggctcactgcacattgttctcccaagtgaaaatggtacaaaggatcagtgtcagatccttcactttaccgtgcccgaggtcgaggaagagttcatgtattcttgcgacggggatgaacgccctctgttggtgaaaggcacgctaattgccatcgacccatttgatgacagaagggaggcaggaggcgaaagcaccgtagttaacccgaagtccgggtcatggaatttctttgattggttcagcggactgatgtcttggtttggtggccccctcaaaacaatcctgcttatttgtctgtacgtggctttgtccataggactcttcttcctgttaatctatctgggacggactggcctaagtaagatgtggctcgccgctaccaaaaaggccagc

SEQ ID NO: 11367 - RNA, 1521 nt, synthetic construct
  misc_feature 1..1521: note = derived and/or modified CDS sequence (opt3) from RVFV(ZINGA J83 R1)__KU978776.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggaagaccaaacaaaattcttaaagatcaaaactgtgtcctctgagctgtcgtgccgcgaagggcagtcatactggaccgggagctttagtcccaagtgtctatcctctcgacgttgccacctcgtaggcgagtgtcatgtgaatagatgcctgagctggagggataacgagacatccgctgagttctcatttgtcggtgaaagtaccactatgcgggaaaataagtgtttcgagcagtgcgggggatggggctgtggctgctttaacgtgaatcctagctgccttttcgttcacacatatctgcagtctgtgcgcaaagaggccttgagagtctttaactgtattgactgggtgcataagctcaccctggaaatcacggatttcgacgggtccgtatcaactattgatctgggagcaagcagttctaggtttaccaattggggttccgttagcctctcgttagacgccgagggcatctctgggtccaactcattcagttttatagaaagcccaggaaaaggctacgctatcgtggatgagccgttctccgaaattccccggcaaggttttctgggggagatccgctgcaattctgagagctcagtccttagtgcacacgaatcctgtttgcgagcccctaacctgattagctataagccaatgatcgaccagctagagtgcacaactaatctcatagatcccttcgtggtgttcgaaagaggatctctgcctcagaccaggaacgacaaaacatttgctgcctcaaagggcaatcggggcgtccaggcgttcagtaaggggagcgttcaagcagatcttaccctgatgtttgacaacttcgaggtggattttgtaggagccgctgtgtcctgtgacgccgcattcttgaatctcacgggttgctactcttgtaacgctggcgcccgtgtctgcctgtcgattactagcacagggaccggaactttatccgcgcataacaaagacggctcactgcacatcgtgctcccaagtgaaaatggtacaaaggatcagtgtcagattcttcactttaccgttcccgaggtggaggaagagttcatgtattcttgcgacggggatgaacgccctctgttggtcagaggcacgctaatcgccatcgacccatttgatgacaggcgggaggcaggaggcgaaagcaccgtggtaaacccgaaatccgggtcatggaatttctttgattggttcagcggactgatgtcttggtttggtggccccctcaagacaattctgcttatatgtctgtacgttgctttgtccatcggactcttcttcctgttaatttatctgggacgaactggcctaagtaaaatgtggctcgccgctaccaagaaagccagc

SEQ ID NO: 11368 - RNA, 1521 nt, synthetic construct
  misc_feature 1..1521: note = derived and/or modified CDS sequence (opt3) from RVFV(Entebbe)__DQ380191.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggaagaccaaacaaaattcttaaagatcaaaactgtgtcctctgagctgtcgtgccgcgaagggcagtcatactggaccgggagctttagtcccaagtgtctatcctctcgacgttgccacctcgtaggcgagtgtcatgtgaatagatgcctgagctggagggataacgagacatccgctgagttctcatttgtcggtgaaagtaccactatgcgggaaaataagtgtttcgagcagtgcgggggatggggctgtggctgctttaacgtgaatcctagctgccttttcgttcacacatatctgcagtctgtgcgcaaagaggccttgagagtctttaactgtattgactgggtgcataagctcaccctggaaatcacggatttcgacgggtccgtatcaactgttgatctgggagcaagcagttctaggtttaccaattggggttccgtgagcctctcgttagacgccgagggcatttctgggtccaactcattcagttttatcgaaagcccaggaaaaggctacgctatagtcgatgagccgttctccgaaatcccccggcaaggttttctgggggagattcgctgcaattctgagagctcagtgcttagtgcacacgaatcctgtttgcgagcccctaacctgatcagctataagccaatgattgaccagctagagtgcacaactaatctcatcgatcccttcgtggtcttcgaaagaggatctctgcctcagaccaggaacgacaaaacatttgctgcctcaaagggcaatcggggcgttcaggcgttcagtaaggggagcgtgcaagcagatcttaccctgatgtttgacaacttcgaggtagattttgtgggagccgctgtctcctgtgacgccgcattcttgaatctcacgggttgctactcttgtaacgctggcgcccgtgtgtgcctgtcgataactagcacagggaccggaactttatccgcgcataacaaagacggctcactgcacattgttctcccaagtgaaaatggtacaaaggatcagtgtcagatccttcactttaccgtgcccgaggtcgaggaagagttcatgtattcttgcgacggggatgaacgccctctgttggtgaaaggcacgctaattgccatcgacccatttgatgacagaagggaggcaggaggcgaaagcaccgtagttaacccgaagtccgggtcatggaatttctttgattggttcagcggactgatgtcttggtttggtggccccctcaaaacaatcctgcttatttgtctgtacgtggctttgtccataggactcttcttcctgttaatctatctgggacggactggcctaagtaagatgtggctcgccgctaccaaaaaggccagc

SEQ ID NO: 11369 - RNA, 1521 nt, synthetic construct
  misc_feature 1..1521: note = derived and/or modified CDS sequence (opt3) from RVFV(Sudan 2V-2007)__JQ820490.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggaagaccaaacaaaattcttaaagatcaaaactgtgtcctctgagctgtcgtgccgcgaagggcagtcatactggaccgggagctttagtcccaagtgtctatcctctcgacgttgccacctcgtaggcgagtgtcatgtgaatagatgcctgagctggagggataacgagacatccgctgagttctcatttgtcggtgaaagtaccactatgcgggaaaataagtgtttcgagcagtgcgggggatggggctgtggctgctttaacgtgaatcctagctgccttttcgttcacacatatctgcagtctgtgcgcaaagaggccttgagagtctttaactgtattgactgggtgcataagctcaccctggaaatcacggatttcgacgggtccgtatcaactattgatctgggagcaagcagttctaggtttaccaattggggttccgttagcctctcgttagacgccgagggcatctctgggtccaactcattcagttttatagaaagcccaggaaaaggctacgctatcgtggatgagccgttctccgaaattccccggcaaggttttctgggggagatccgctgcaattctgagagctcagtccttagtgcacacgaatcctgtttgcgagcccctaacctgattagctataagccaatgatcgaccagctagagtgcacaactaatctcatagatcccttcgtggtgttcgaaagaggatctctgcctcagaccaggaacgacaaaacatttgctgcctcaaagggcaatcggggcgtccaggcgttcagtaaggggagcgttcaagcagatcttaccctgatgtttgacaacttcgaggtggattttgtaggagccgctgtgtcctgtgacgccgcattcttgaatctcacgggttgctactcttgtaacgctggcgcccgtgtctgcctgtcgattactagcacagggaccggaactttatccgcgcataacaaagacggctcactgcacatcgtgctcccaagtgaaaatggtacaaaggatcagtgtcagattcttcactttaccgttcccgaggtggaggaagagttcatgtattcttgcgacggggatgaacgccctctgttggtcaaaggcacgctaatggccatcgacccatttgatgacagaagggaggcaggaggcgaaagcaccgtggtaaacccgaagtccgggtcatggaatttctttgattggttcagcggactgatgtcttggtttggtggccccctcaaaacaatcctgcttatttgtctgtacgttgctttgtccataggactcttcttcctgttaatctatctgggacggactggcctaagtaagatgtggctcgccgctaccaaaaaggccagc

SEQ ID NO: 11370 - RNA, 1521 nt, synthetic construct
  misc_feature 1..1521: note = derived and/or modified CDS sequence (opt3) from RVFV(Sudan 86-2010)__JQ820489.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggaagaccaaacaaaattcttaaagatcaaaactgtgtcctctgagctgtcgtgccgcgaagggcagtcatactggaccgggagctttagtcccaagtgtctatcctctcgacgttgccacctcgtaggcgagtgtcatgtgaatagatgcctgagctggagggataacgagacatccgctgagttctcatttgtcggtgaaagtaccactatgcgggaaaataagtgtttcgagcagtgcgggggatggggctgtggctgctttaacgtgaatcctagctgccttttcgttcacacatatctgcagtctgtgcgcaaagaggccttgagagtctttaactgtattgactgggtgcataagctcaccctggaaatcacggatttcgacgggtccgtatcaactattgatctgggagcaagcagttctaggtttaccaattggggttccgttagcctctcgttagacgccgagggcatctctgggtccaactcattcagttttatagaaagcccaggaaaaggctacgctatcgtggatgagccgttctccgaaattccccggcaaggttttctgggggagatccgctgcaattctgagagctcagtccttagtgcacacgaatcctgtttgcgagcccctaacctgattagctataagccaatgatcgaccagctagagtgcacaactaatctcatagatcccttcgtgattttcgaaagaggatctctgcctcagaccaggaacgacaaaacatttgctgcctcaaagggcaatcggggcgtgcaggcgttcagtaaggggagcgtccaagcagatcttaccctgatgtttgacaacttcgaggttgattttgtgggagccgctgtatcctgtgacgccgcattcttgaatctcacgggttgctactcttgtaacgctggcgcccgtgtgtgcctgtcgatcactagcacagggaccggaactttatccgcgcataacaaagacggctcactgcacattgtcctcccaagtgaaaatggtacaaaggatcagtgtcagatccttcactttaccgtgcccgaggttgaggaagagttcatgtattcttgcgacggggatgaacgccctctgttggtgaaaggcacgctaatcgccattgacccatttgatgacagaagggaggcaggaggcgaaagcaccgtcgtgaacccgaagtccgggtcatggaatttctttgattggttcagcggactgatgtcttggtttggtggccccctcaaaacaatactgcttatctgtctgtacgtagctttgtccattggactcttcttcctgttaatctatctgggacggactggcctaagtaagatgtggctcgccgctaccaaaaaggccagc

SEQ ID NO: 11371 - RNA, 1521 nt, synthetic construct
  misc_feature 1..1521: note = derived and/or modified CDS sequence (opt3) from RVFV(Kenya 56 (IB8))__DQ380190.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggaagaccaaacaaaattcttaaagatcaaaactgtgtcctctgagctgtcgtgccgcgaagggcagtcatactggaccgggagctttagtcccaagtgtctatcctctcgacgttgccacctcgtaggcgagtgtcatgtgaatagatgcctgagctggagggataacgagacatccgctgagttctcatttgtcggtgaaagtaccactatgcgggaaaataagtgtttcgagcagtgcgggggatggggctgtggctgctttaacgtgaatcctagctgccttttcgttcacacatatctgcagtctgtgcgcaaagaggccttgagagtctttaactgtattgactgggtgcataagctcaccctggaaatcacggatttcgacgggtccgtatcaactattgatctgggagcaagcagttctaggtttaccaattggggttccgttagcctctcgttagacgccgagggcatctctgggtccaactcattcagttttatagaaagcccaggaaaaggctacgctatcgtggatgagccgttctccgaaattccccggcaaggttttctgggggagatccgctgcaattctgagagctcagtccttagtgcacacgaatcctgtttgcgagcccctaacctgattagctataagccaatgatcgaccagctagagtgcacaactaatctcatagatcccttcgtggctttcgaaagaggatctctgcctcagaccaggaacgacaaaacatttgccgcgtcaaagggcaatcggggcgtgcaggcattcagtaaggggagcgtccaagccgatcttaccctgatgtttgacaacttcgaggttgattttgtgggagctgccgtatcctgtgacgcagctttcttgaatctcacgggttgctactcttgtaacgccggcgcgcgtgtgtgcctgtcgattactagcacagggaccggaactttatccgcccataacaaagacggctcactgcacatcgtcctcccaagtgaaaatggtacaaaggatcagtgtcagattcttcactttaccgtgcccgaggttgaggaagagttcatgtattcttgcgacggggatgaacgccctctgttggtgaaaggcacgctaatcgcaatcgacccatttgatgacagaagggaggctggaggcgaaagcaccgtcgtgaacccgaagtccgggtcatggaatttctttgattggttcagcggactgatgtcttggtttggtggccccctcaaaacaattctgcttatatgtctgtacgtagccttgtccatcggactcttcttcctgttaatttatctgggacggactggcctaagtaagatgtggctcgctgccaccaaaaaggcaagc

SEQ ID NO: 11372 - RNA, 1521 nt, synthetic construct
  misc_feature 1..1521: note = derived and/or modified CDS sequence (opt3) from RVFV(ARD-38388)__DQ380187.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggaagaccaaacaaaattcttaaagatcaaaactgtgtcctctgagctgtcgtgccgcgaagggcagtcatactggaccgggagctttagtcccaagtgtctatcctctcgacgttgccacctcgtaggcgagtgtcatgtgaatagatgcctgagctggagggataacgagacatccgctgagttctcatttattggtgaaagtaccactatgcgggaaaataagtgtttcgagcagtgcgggggatggggctgtggctgctttaacgtcaatcctagctgccttttcgtgcacacatatctgcagtctgttcgcaaagaggccttgagagtgtttaactgtatcgactgggtccataagctcaccctggaaattacggatttcgacgggtccgtgtcaactatcgatctgggagcaagcagttctaggtttaccaattggggttccgtaagcctctcgttagacgccgagggcatatctgggtccaactcattcagttttatcgaaagcccaggaaaaggctacgctattgttgatgagccgttctccgaaatcccccggcaaggttttctgggggagattcgctgcaattctgagagctcaatccttagtgcacacgaatcctgtttgcgagcccctaacctgataagctataagccaatgattgaccagctagagtgcacaactaatctcatcgatcccttcgtggtcttcgaaagaggatctctgcctcagaccaggaacgacaaaacatttgctgcctcaaagggcaatcggggcgtgcaggcgttcagtaaggggagcgtgcaagcagatcttaccctgatgtttgacaacttcgaggtcgattttgttggagccgctgtgtcctgtgacgccgcattcttgaatctcacgggttgctactcttgtaacgctggcgcccgtgtatgcctgtcgattactagcacagggaccggaactttatccgcgcataacaaagacggctcactgcacatcgtgctcccaagtgaaaatggtacaaaggatcagtgtcagatccttcactttaccgtccccgaggtggaggaagagttcatgtattcttgcgacggggatgaacgccctctgttggttaaaggcacgctaattgccatagacccatttgatgacagaagggaggcaggaggcgaaagcaccgtggtcaacccgaagtccgggtcatggaatttctttgattggttcagcggactgatgtcttggtttggtggccccctcaaaacaatcctgcttatttgtctgtacgtggctttgtccatcggactcttcttcctgttaatatatctgggacggactggcctaagtaagatgtggctcgccgctaccaaaaaggccagc

SEQ ID NO: 11373 - RNA, 1521 nt, synthetic construct
  misc_feature 1..1521: note = derived and/or modified CDS sequence (opt3) from RVFV(Sudan 28-2010)__JQ820491.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggaagaccaaacaaaattcttaaagatcaaaactgtgtcctctgagctgtcgtgccgcgaagggcagtcatactggaccgggagctttagtcccaagtgtctatcctctcgacgttgccacctcgtaggcgagtgtcatgtgaatagatgcctgagctggagggataacgagacatccgctgagttctcatttgtcggtgaaagtaccactatgcgggaaaataagtgtttcgagcagtgcgggggatggggctgtggctgctttaacgtgaatcctagctgccttttcgttcacacatatctgcagtctgtgcgcaaagaggccttgagagtctttaactgtattgactgggtgcataagctcaccctggaaatcacggatttcgacgggtccgtatcaactattgatctgggagcaagcagttctaggtttaccaattggggttccgttagcctctcgttagacgccgagggcatctctgggtccaactcattcagttttatagaaagcccaggaaaaggctacgctatcgtggatgagccgttctccgaaattccccggcaaggttttctgggggagatccgctgcaattctgagagctcagtccttagtgcacacgaatcctgtttgcgagcccctaacctgattagctataagccaatgatcgaccagctagagtgcacaactaatctcatagatcccttcgtggtgttcgaaagaggatctctgcctcagaccaggaacgacaaaacatttgctgcctcaaagggcaatcggggcgtccaggcgttcagtaaggggagcgttcaagcagatcttaccctgatgtttgacaacttcgaggtggattttgtaggagccgctgtgtcctgtgacgccgcattcttgaatctcacgggttgctactcttgtaacgctggcgcccgtgtctgcctgtcgattactagcacagggaccggaactttatccgcgcataacaaagacggctcactgcacatcgtgctcccaagtgaaaatggtacaaaggatcagtgtcagattcttcactttaccgttcccgaggtggaggaagagttcatgtattcttgcgacggggatgaacgccctctgttggtcaaaggcacgctaatcgccatcgacccatttgatgacagaagggaggcaggaggcgaaagcaccgtggtaaacccgaagtccgggtcatggaatttctttgattggttcagcggactgatgtcttggtttggtggccccctcaaaacaattctgcttatatgtctgtacgttgtgttgtccatcggactcttcttcctgttaatttatctgggacggactggcctaagtaagatgtggctcgctgccaccaaaaaggctagc

SEQ ID NO: 11374 - RNA, 1521 nt, synthetic construct
  misc_feature 1..1521: note = derived and/or modified CDS sequence (opt3) from RVFV(200803167)__JF311382.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggaagaccaaacaaaattcttaaagatcaaaactgtgtcctctgagctgtcgtgccgcgaagggcagtcatactggaccgggagctttagtcccaagtgtctatcctctcgacgttgccacctcgtaggcgagtgtcatgtgaatagatgcctgagctggagggataacgagacatccgctgagttctcatttgtcggtgaaagtaccactatgcgggaaaataagtgtttcgagcagtgcgggggatggggctgtggctgctttaacgtgaatcctagctgccttttcgttcacacatatctgcagtctgtgcgcaaagaggccttgagagtctttaactgtattgactgggtgcataagctcaccctggaaatcacggatttcgacgggtccgtatcaactattgatctgggagcaagcagttctaggtttaccaattggggttccgttagcctctcgttagacgccgagggcatctctgggtccaactcattcagttttatagaaagcccaggaaaaggctacgctatcgtggatgagccgttctccgaaattccccggcaaggttttctgggggagatccgctgcaattctgagagctcagtccttagtgcacacgaatcctgtttgcgagcccctaacctgattagctataagccaatgatcgaccagctagagtgcacaactaatctcatagatcccttcgtggtgttcgaaagaggatctctgcctcagaccaggaacgacaaaacatttgctgcctcaaagggcaatcggggcgtccaggcgttcagtaaggggagcgttcaagcagatcttaccctgatgtttgacaacttcgaggtggattttgtaggagccgctgtgtcctgtgacgccgcattcttgaatctcacgggttgctactcttgtaacgctggcgcccgtgtctgcctgtcgattactagcacagggaccggaactttatccgcgcataacaaagacggctcactgcacatcgtgctcccaagtgaaaatggtacaaaggatcagtgtcagattcttcactttaccgttcccgaggtggaggaagagttcatgtattcttgcgacggggatgaacgccctctgttggtcaaaggcacgctaatcgccatcgacccatttgatgacagaagggaggcaggaggcgaaagcaccgtggtaaacccgaagtccgggtcatggaatttctttgattggttcagcggactgatgtcttggtttggtggccccctcaaaacaatgctgcttatttgtctgtacgttgctttgtccataggactcttcttcctgttaatctatctgggacggactggcctaagtaagatgtggctcgccgctaccaaaaaggccagc

SEQ ID NO: 11375 - RNA, 1521 nt, synthetic construct
  misc_feature 1..1521: note = derived and/or modified CDS sequence (opt3) from RVFV(73HB1230)__DQ380221.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggaagaccaaacaaaattcttaaagatcaaaactgtgtcctctgagctgtcgtgccgcgaagggcagtcatactggaccgggagctttagtcccaagtgtctatcctctcgacgttgccacctcgtaggcgagtgtcatgtgaatagatgcctgagctggagggataacgagacatccgctgagttctcatttgtcggtgaaagtaccattatgcgggaaaataagtgtttcgagcagtgcgggggatggggctgtggctgctttaacgtgaatcctagctgccttttcgttcacacttatctgcagtctgtgcgcaaagaggccttgagagtctttaactgtatcgactgggtgcataagctcacactggaaattaccgatttcgacgggtccgtatcaacgatcgatctgggagcaagcagttctaggtttactaattggggttccgttagcctctcgttagacgccgagggcatatctgggtccaactcattcagttttatcgaaagcccaggaaaaggctacgctattgtggatgagccgttctccgaaatcccccggcaaggttttctgggggagattcgctgcaattctgagagctcagtccttagtgcacacgaatcctgtttgcgagcccctaacctgatcagctataagccaatgatagaccagctagagtgcaccacaaatctcattgatcccttcgtggtgttcgaaagaggatctctgcctcagactaggaacgacaaaacctttgctgcctcaaagggcaatcggggcgtccaggcgttcagtaaggggagcgttcaagcagatcttacactgatgtttgacaacttcgaggtggattttgtaggagccgctgtgtcctgtgacgccgcattcttgaatctcaccggttgctactcttgtaacgctggcgcccgtgtctgcctgtcgatcacgagcactgggacaggaaccttatccgcgcataacaaagacggctcactgcacattgtgctcccaagtgaaaatggtactaaggatcagtgtcagatccttcactttacagttcccgaggtggaggaagagttcatgtattcttgcgacggggatgaacgccctctgttggtcaaaggcaccctaatcgccattgacccatttgatgacagaagggaggcaggaggcgaaagcacggtggtaaacccgaagtccgggtcatggaatttctttgattggttcagcggactgatgtcttggtttggtggccccctcaaaaccatactgcttatctgtctgtacgttgctttgtccattggactcttcttcctgttaatctatctgggacggacaggcctaagtaagatgtggctcgccgctactaaaaaggccagc

SEQ ID NO: 11376 - RNA, 1521 nt, synthetic construct
  misc_feature 1..1521: note = derived and/or modified CDS sequence (opt3) from RVFV(2250/74)__DQ380209.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggaagaccaaacaaaattcttaaagatcaaaactgtgtcctctgagctgtcgtgccgcgaagggcagtcatactggaccgggagctttagtcccaagtgtctatcctctcgacgttgccacctcgtaggcgagtgtcatgtgaatagatgcctgagctggagggataacgagacatccgctgagttctcatttgtcggtgaaagtaccactatgcgggaaaataagtgtttcgagcagtgcgggggatggggctgtggctgctttaacgtgaatcctagctgccttttcgttcacacatatctgcagtctgtgcgcaaagaggccttgagagtctttaactgtattgactgggtgcataagctcaccctggaaatcacggatttcgacgggtccgtatcaactattgatctgggagcaagcagttctaggtttaccaattggggttccgttagcctctcgttagacgccgagggcatctctgggtccaactcattcagttttatagaaagcccaggaaaaggctacgctatcgtggatgagccgttctccgaaattccccggcaaggttttctgggggagatccgctgcaattctgagagctcagtccttagtgcacacgaatcctgtttgcgagcccctaacctgattagctataagccaatgatcgaccagctagagtgcacaactaatctcatagatcccttcgtggtgttcgaaagaggatctctgcctcagaccaggaacgacaaaacatttgctgcctcaaagggcaatcggggcgtccaggcgttcagtaaggggagcgttcaagcagatcttaccctgatgtttgacaacttcgaggtggattttgtaggagccgctgtgtcctgtgacgccgcattcttgaatctcacgggttgctactcttgtaacgctggcgccaaagtctgcctgtcgattactagcacagggaccggatccttatcagcgcataacaaggacggcagtctgcacatcgtgctcccatctgaaaatggtactaaagatcagtgtcagattcttcactttacagttcccgaggtggaggaagagttcatgtatagctgcgacggggatgaacgtcctctgttggtcaagggcaccctaatcgccatcgacccatttgatgaccgcagagaggcaggaggcgaatccacggtggtaaacccgaaatcagggagctggaatttctttgattggttctctggactgatgtcctggtttggtggccccctcaagaccattctgcttatatgtctgtacgttgctttgagtatcggactcttcttcctgttaatttatctgggaaggacaggcctaagcaaaatgtggctcgccgctactaagaaggcctct

SEQ ID NO: 11377 - RNA, 1521 nt, synthetic construct
  misc_feature 1..1521: note = derived and/or modified CDS sequence (opt3) from RVFV(SAUDI 200010901)__KU978778.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggaagaccaaacaaaattcttaaagatcaaaactgtgtcctctgagctgtcgtgccgcgaagggcagtcatactggaccgggagctttagtcccaagtgtctatcctctcgacgttgccacctcgtaggcgagtgtcatgtgaatagatgcctgagctggagggataacgagacatccgctgagttctcatttgtcggtgaaagtaccactatgcgggaaaataagtgtttcgagcagtgcgggggatggggctgtggctgctttaacgtgaatcctagctgccttttcgttcacacatatctgcagtctgtgcgcaaagaggccttgagagtctttaactgtattgactgggtgcataagctcaccctggaaatcacggatttcgacgggtccgtatcaactattgatctgggagcaagcagttctaggtttaccaattggggttccgttagcctctcgttagacgccgagggcatctctgggtccaactcattcagttttatagaaagcccaggaaaaggctacgctatcgtggatgagccgttctccgaaattccccggcaaggttttctgggggagatccgctgcaattctgagagctcagtccttagtgcacacgaatcctgtttgcgagcccctaacctgattagctataagccaatgatcgaccagctagagtgcacaactaatctcatagatcccttcgtggtgttcgaaagaggatctctgcctcagaccaggaacgagaaaacatttgctgcctcaaagggcaatcggggcgtccaggcgttcagtaaggggagcgttcaagcagaccttaccctgatgtttgataacttcgaagtggactttgtaggagccgctgtgtcctgtgatgccgcattcttgaatctcacgggttgctactcttgtaacgctggcgcccgtgtctgcctgtcgattactagcacagggaccggaactttatccgcgcataacaaagacggctcactgcacatcgtgctcccaagtgagaatggtacaaaggaccagtgtcagattcttcactttaccgttcccgaggtggaagaggagttcatgtattcttgcgatggggacgaacgccctctgttggtcaaaggcacgctaatcgccatcgatccatttgacgatagaagggaagcaggaggcgagagcaccgtggtaaacccgaagtccgggtcatggaatttctttgactggttcagcggactgatgtcttggtttggtggccccctcaaaacaattctgcttatatgtctgtacgttgctttgtccatcggactcttcttcctgttaatttatctgggacggactggcctaagtaagatgtggctcgccgctaccaaaaaggccagc

SEQ ID NO: 11378 - RNA, 1521 nt, synthetic construct
  misc_feature 1..1521: note = derived and/or modified CDS sequence (opt3) from RVFV(Lunyo)__KU167026.1__Gc
  source 1..1521: mol_type = other RNA
tgcagcgagctgatccaggcctcctctagaattaccacatgttcaactgaaggcgtgaacacgaggtgccggctcagtgggaccgctcttatacgcgcaggaagcgtcggtgccgaggcgtgtctgatgttgaagggcgttaaagaagaccaaacaaagttcttaaaaatcaagactgtgtcctctgagctgtcgtgccgagaagggcagtcatactggaccgggagctttagtcccaaatgtctatcctctcgtagatgccacctcgtaggcgagtgtcatgtgaataggtgcctgagctggcgggataacgagacatccgctgagttctcatttgtcggtgaaagtaccactatgcgcgaaaataagtgtttcgagcagtgcgggggatggggctgtggctgctttaacgtgaatcctagctgccttttcgttcacacatatctgcagtctgtgagaaaggaggccttgagggtctttaactgtattgactgggtgcataaactcaccctggaaatcacggatttcgacgggtccgtatcaactattgatctgggagcaagcagttctcggtttaccaattggggttccgttagcctctcgttagacgccgagggcatctctgggtccaactcattcagttttatagaaagcccaggaaagggctacgctatcgtggatgagccgttctccgaaattccccgccaaggttttctgggggagatccgatgcaattctgagagctcagtccttagtgcacacgaatcctgtttgagagcccctaacctgattagctataaaccaatgatcgaccagctagagtgcacaactaatctcatagatcccttcgtggtgttcgaaaggggatctctgcctcagacccggaacgacaagacatttgctgcctcaaaaggcaatcgtggcgtccaggcgttcagtaaggggagcgttcaagcagatcttaccctgatgtttgacaacttcgaggtggattttgtaggagccgctgtgtcctgtgacgccgcattcttgaatctcacgggttgctactcttgtaacgctggcgcccgcgtctgcctgtcgattactagcacagggaccggaactttatccgcgcataacaaggacggctcactgcacatcgtgctcccaagtgaaaatggtacaaaagatcagtgtcagattcttcactttaccgttcccgaggtggaggaagagttcatgtattcttgcgacggggatgaaagacctctgttggtcaagggcacgctaatcgccatcgacccatttgatgacaggcgggaggcaggaggcgaaagcaccgtggtaaacccgaaatccgggtcatggaatttctttgattggttcagcggactgatgtcttggtttggtggccccctcaagacaattctgcttatatgtctgtacgttgctttgtccatcggactcttcttcctgttaatttatctgggacgaactggcctaagtaaaatgtggctcgccgctaccaagaaagccagc

SEQ ID NO: 11379 - RNA, 1521 nt, synthetic construct
  misc_feature 1..1521: note = derived and/or modified CDS sequence (opt3) from RVFV(25010-24)__KM210509.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggacgatcaaacaaaattcttaaagatcaaaactgtgtcctctgaactgtcgtgccgcgaggggcagtcatactggaccgggagctttagtcccaagtgtctatcctctcgacgttgccacctcgtaggcgaatgtcatgtgaatagatgcctgagctggagggacaacgagacatccgctgagttctcatttgtcggtgaaagtaccactatgcgggagaataagtgtttcgaacagtgcgggggatggggctgtggctgctttaacgtgaatcctagctgccttttcgttcacacatatctgcagtctgtgcgcaaagaggccttgagagtctttaactgtattgattgggtgcataagctcaccctggagatcacggacttcgatgggtccgtatcaactattgacctgggagcaagcagttctaggtttaccaattggggttccgttagcctctcgttagatgccgaaggcatctctgggtccaactcattcagttttatagagagcccaggaaaaggctacgctatcgtggacgaaccgttctccgagattccccggcaaggttttctgggggaaatccgctgcaattctgagagctcagtccttagtgcacacgagtcctgtttgcgagcccctaacctgattagctataagccaatgatcgatcagctagaatgcacaactaatctcatagaccccttcgtggtgttcgagagaggatctctgcctcagaccaggaacgataaaacatttgctgcctcaaagggcaatcggggcgtccaggcgttcagtaaggggagcgttcaagcagaccttaccctgatgtttgataacttcgaagtggactttgtaggagccgctgtgtcctgtgacgccgcattcttgaatctcacgggttgctactcttgtaacgctggcgcccgtgtctgcctgtcgattactagcacagggaccggaactttatccgcgcataacaaagatggctcactgcacatcgtgctcccaagtgagaatggtacaaaggaccagtgtcagattcttcactttaccgttcccgaagtggaggaggagttcatgtattcttgcgatggggacgaacgccctctgttggtcaaaggcacgctaatcgccatcgatccatttgacgatagaagggaagcaggaggcgagagcaccgtggtaaacccgaagtccgggtcatggaatttctttgactggttcagcggactgatgtcttggtttggtggccccctcaaaacaattctgcttatatgtctgtacgttgctttgtccatcggactcttcttcctgttaatttatctgggacggactggcctaagtaagatgtggctcgccgctaccaaaaaggccagc

SEQ ID NO: 11380 - RNA, 1521 nt, synthetic construct
  misc_feature 1..1521: note = derived and/or modified CDS sequence (opt3) from RVFV(2007000253)__JF326192.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgccggtgcggaggcttgtctgatgttgaaaggcgtcaaggaagaccaaacaaaattcttaaagatcaaaactgtttcctctgagctgtcgtgccgcgaagggcagtcatactggaccgggagctttagtcccaagtgtctatcctctcgacgttgccacctcgtgggcgagtgtcatgtaaatagatgcctgagctggagggataacgagacatccgccgagttctcatttgtgggtgaaagtaccactatgcgggaaaataagtgtttcgagcagtgcgggggatggggctgtggctgctttaacgtcaatcctagctgccttttcgtgcacacatatctgcagtctgttcgcaaagaggcattgagagtgtttaactgtattgactgggtccataagctcaccctggaaatcacggatttcgacgggtccgtgtcaactattgatctgggagccagcagttctaggtttaccaattggggttccgtaagcctctcgttagacgctgagggcatctctgggtccaactcattcagttttatagaaagcccaggaaaaggctacgcaatcgttgatgagccgttctccgaaattccccggcaaggttttctgggggagatccgctgcaattctgagagctcagtgcttagtgcccacgaatcctgtttgcgagctcctaacctggtcagctataagccaatgattgaccagctagagtgcacaactaatctcatcgatcccttcgtggtgttcgaaagaggatctctgcctcagaccaggaacgacaaaacatttgccgcgtcaaagggcaatcggggcgtccaggcattcagtaaggggagcgttcaagccgatcttaccctgatgtttgacaacttcgaggtggattttgtaggagctgccgtgtcctgtgacgcagctttcttgaatctcacgggttgctactcttgtaacgccggcgcgcgtgtctgcctgtcgataactagcacagggaccggaactttatccgcccataacaaagacggctcactgcacattgtgctcccaagtgaaaatggtacaaaggatcagtgtcagatccttcactttaccgttcccgaggtggaggaagagttcatgtattcttgcgacggggatgaacgccctctgttggtcaaaggcacgctaattgcaatcgacccatttgatgacagaagggaggctggaggcgaaagcaccgtggtaaacccgaagtccgggtcatggaatttctttgattggttcagcggactgatgtcttggtttggtggccccctcaaaacaatcctgcttatttgtctgtacgttgccttgtccataggactcttcttcctgttaatctatctgggacggactggcctaagtaagatgtggctcgctgccaccaaaaaggcaagc

SEQ ID NO: 11381 - RNA, 1521 nt, synthetic construct
  misc_feature 1..1521: note = derived and/or modified CDS sequence (opt3) from RVFV(ZC-3349)__DQ380207.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggaagaccaaacaaaattcttaaagatcaaaactgtgtcctctgagctgtcgtgccgcgaagggcagtcatactggaccgggagctttagtcccaagtgtctatcctctcgacgttgccacctcgtaggcgagtgtcatgtgaatagatgcctgagctggagggataacgagacatccgctgagttctcatttgtcggtgaaagtaccactatgcgggaaaataagtgtttcgagcagtgcgggggatggggctgtggctgctttaacgtgaatcctagctgccttttcgttcacacatatctgcagtctgtgcgcaaagaggccttgagagtctttaactgtattgactgggtgcataagctcaccctggaaatcacggatttcgacgggtccgtatcaactattgatctgggagcaagcagttctaggtttaccaattggggttccgttagcctctcgttagacgccgagggcatctctgggtccaactcattcagttttatagaaagcccaggaaaaggctacgctatcgtggatgagccgttctccgaaattccccggcaaggttttctgggggagatccgctgcaattctgagagctcagtccttagtgcacacgaatcctgtttgaaggcccctaacctgattagctataaaccaatgatcgaccagctagagtgcacaactaatctcatagatcccttcgtggtgttcgaacgaggatctctgcctcagaccagaaacgacaagacatttgctgcctcaaagggcaataggggcgtccaggcgttcagtaaagggagcgttcaagcagatcttaccctgatgtttgacaacttcgaggtggattttgtaggagccgctgtgtcctgtgacgccgcattcttgaatctcacgggttgctactcttgtaacgctggcgcccgggtctgcctgtcgattactagcacagggaccggatccttatcagcgcataacaaggacggcagtctgcacatcgtgctcccatctgaaaatggtactaaagatcagtgtcagattcttcactttacagttcccgaggtggaggaagagttcatgtatagctgcgacggggatgaacgtcctctgttggtcaagggcaccctaatcgccatcgacccatttgatgaccgcagagaggcaggaggcgaatccacggtggtaaacccgaaatcagggagctggaatttctttgattggttctctggactgatgtcctggtttggtggccccctcaagaccattctgcttatatgtctgtacgttgctttgagtatcggactcttcttcctgttaatttatctgggaaggacaggcctaagcaaaatgtggctcgccgctactaagaaggcctct

SEQ ID NO: 11382 - RNA, 1521 nt, synthetic construct
  misc_feature 1..1521: note = derived and/or modified CDS sequence (opt3) from RVFV(OS-1)__DQ380186.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggaagaccaaacaaaattcttaaagatcaaaactgtgtcctctgagctgtcgtgccgcgaagggcagtcatactggaccgggagctttagtcccaagtgtctatcctctcgacgttgccacctcgtaggcgagtgtcatgtgaatagatgcctgagctggagggataacgagacatccgctgagttctcatttgtcggtgaaagtaccactatgcgggaaaataagtgtttcgagcagtgcgggggatggggctgtggctgctttaacgtgaatcctagctgccttttcgttcacacatatctgcagtctgtgcgcaaagaggccttgaaggtctttaactgtattgactgggtgcataaactcaccctggaaatcacggatttcgacgggtccgtatcaactattgatctgggagcaagcagttctagatttaccaattggggttccgttagcctctcgttagacgccgagggcatctctgggtccaactcattcagttttatagaaagcccaggaaagggctacgctatcgtggatgagccgttctccgaaattcccaggcaaggttttctgggggagatccggtgcaattctgagagctcagtccttagtgcacacgaatcctgtttgcgcgcccctaacctgattagctataaaccaatgatcgaccagctagagtgcacaactaatctcatagatcccttcgtggtgttcgaacgaggatctctgcctcagaccagaaacgacaagacatttgctgcctcaaagggcaataggggcgtccaggcgttcagtaaagggagcgttcaagcagatcttaccctgatgtttgacaacttcgaggtggattttgtaggagccgctgtgtcctgtgacgccgcattcttgaatctcacgggttgctactcttgtaacgctggcgcccgggtctgcctgtcgattactagcacagggaccggaactttatccgcgcataacaaggacggctcactgcacatcgtgctcccaagtgaaaatggtacaaaagatcagtgtcagattcttcactttaccgttcccgaggtggaggaagagttcatgtattcttgcgacggggatgaacgtcctctgttggtcaagggcacgctaatcgccatcgacccatttgatgaccgcagagaggcaggaggcgaaagcaccgtggtaaacccgaaatccgggtcatggaatttctttgattggttcagcggactgatgtcttggtttggtggccccctcaagacaattctgcttatatgtctgtacgttgctttgtccatcggactcttcttcctgttaatttatctgggaaggactggcctaagtaaaatgtggctcgccgctaccaagaaggccagc

SEQ ID NO: 11383 - RNA, 1521 nt, synthetic construct
  misc_feature 1..1521: note = derived and/or modified CDS sequence (opt3) from RVFV(KEN/Gar-004/06)__HM586964.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggaagaccaaacaaaattcttaaagatcaaaactgtgtcctctgagctgtcgtgccgcgaagggcagtcatactggaccgggagctttagtcccaagtgtctatcctctcgacgttgccacctcgtaggcgagtgtcatgtgaatagatgcctgagctggagggataacgagacatccgctgagttctcatttgtcggtgaaagtaccactatgcgggaaaataagtgtttcgagcagtgcgggggatggggctgtggctgctttaacgtgaatcctagctgccttttcgttcacacatatctgcagtctgtgcgcaaagaggccttgagagtctttaactgtattgactgggtgcataagctcaccctggaaatcacggatttcgacgggtccgtatcaactattgatctgggagcaagcagttctaggtttaccaattggggttccgttagcctctcgttagacgccgagggcatctctgggtccaactcattcagttttatagaaagcccaggaaaaggctacgctatcgtggatgagccgttctccgaaattccccggcaaggttttctgggggagatccgctgcaattctgagagctcagtccttagtgcacacgaatcctgtttgcgagcccctaacctggtgagctataagccaatgattgaccagctagagtgcacaactaatctcatcgatcccttcgtggtcttcgaaagaggatctctgcctcagaccaggaacgacaaaacatttgctgcctcaaagggcaatcggggcgttcaggcgttcagtaaggggagcgtgcaagcagatcttaccctgcgttttgacaacttcgaggtagattttgtgggagccgctgtctcctgtgacgccgcattcttgaatctcacgggttgctactcttgtaacgctggcgcccgcgtgtgcctgtcgataactagcacagggaccggaactttatccgcgcataacaaagacggctcactgcacattgttctcccaagtgaaaatggtacaaaggatcagtgtcagatccttcactttaccgtgcccgaggtcgaggaagagttcatgtattcttgcgacggggatgaaagacctctgttggtgaaaggcacgctaattgccatcgacccatttgatgacaggcgggaggcaggaggcgaaagcaccgtagttaacccgaagtccgggtcatggaatttctttgattggttcagcggactgatgtcttggtttggtggccccctcaaaacaatcctgcttatttgtctgtacgtggctttgtccataggactcttcttcctgttaatctatctgggacgaactggcctaagtaagatgtggctcgccgctaccaaaaaggccagc

SEQ ID NO: 11384 - RNA, 1521 nt, synthetic construct
  misc_feature 1..1521: note = derived and/or modified CDS sequence (opt3) from RVFV(Smithburn)__DQ380193.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggaagaccaaacaaaattcttaaagatcaaaactgtgtcctctgagctgtcgtgccgcgaagggcagtcatactggaccgggagctttagtcccaagtgtctatcctctcgacgttgccacctcgtaggcgagtgtcatgtgaatagatgcctgagctggagggataacgagacatccgctgagttctcatttgtcggtgaaagtaccactatgcgggaaaataagtgtttcgagcagtgcgggggatggggctgtggctgctttaacgtgaatcctagctgccttttcgttcacacatatctgcagtctgtgcgcaaagaggccttgagagtctttaactgtattgactgggtgcataagctcaccctggaaatcacggatttcgacgggtccgtatcaactgttgatctgggagcaagcagttctaggtttaccaattggggttccgtgagcctctcgttagacgccgagggcatttctgggtccaactcattcagttttatcgaaagcccaggaaaaggctacgctatagtcgatgagccgttctccgaaatcccccggcaaggttttctgggggagattcgctgcaattctgagagctcagtgcttagtgcacacgaatcctgtttgcgagcccctaacctgatcagctataagccaatgattgaccagctagagtgcacaactaatctcatcgatcccttcgtggtcttcgaaagaggatctctgcctcagaccaggaacgacaaaacatttgctgcctcaaagggcaatcggggcgttcaggcgttcagtaaggggagcgtgcaagcagatcttaccctgatgtttgacaacttcgaggtagattttgtgggagccgctgtctcctgtgacgccgcattcttgaatctcacgggttgctactcttgtaacgctggcgcccgtgtgtgcctgtcgataactagcacagggaccggaactttatccgcgcataacaaagacggctcactgcacattgttctcccaagtgaaaatggtacaaaggatcagtgtcagatccttcactttaccgtgcccgaggtcgaggaagagttcatgtattcttgcgacggggatgaacgccctctgttggtgaaaggcacgctaattgccatcgacccatttgatgacagaagggaggcaggaggcgaaagcaccgtagttaacccgaagtccgggtcatggaatttctttgattggttcagcggactgatgtcttggtttggtggccccctcaaaacaatcctgcttatttgtctgtacgtggctttgtccataggactcttcttctttctgatctatttaggacggactggcctgagtaagatgtggctagccgctaccaaaaaggccagc

SEQ ID NO: 11385 - RNA, 1521 nt, synthetic construct
  misc_feature 1..1521: note = derived and/or modified CDS sequence (opt3) from RVFV(2008/00101)__HE687306.1__Gc
  source 1..1521: mol_type = other RNA
tgcagcgagctgatccaggcctcctctagaattacaacatgttcaactgaaggcgtgaacacgaagtgcaggctcagtgggaccgctcttatacgggcaggaagcgtcggtgccgaggcgtgtctgatgttgaaaggcgttaaggaagaccaaacaaaattcttaaagatcaaaactgtgtcctctgagctgtcgtgccgcgaagggcagtcatactggaccgggagctttagtcccaagtgtctatcctctcgacgttgccacctcgtaggcgagtgtcatgtgaatagatgcctgagctggagggataacgagacatccgctgagttctcatttgtcggtgaaagtaccactatgcgggaaaataagtgtttcgagcagtgcgggggatggggctgtggctgctttaacgtgaatcctagctgccttttcgttcacacatatctgcagtctgtgcgcaaagaggccttgagagtctttaactgtattgactgggtgcataagctcaccctggaaatcacggatttcgacgggtccgtatcaactattgatctgggagcaagcagttctaggtttaccaattggggttccgttagcctctcgttagacgccgagggcatctctgggtccaactcattcagttttatagaaagcccaggaaaaggctacgctatcgtggatgagccgttctccgaaattccccggcaaggttttctgggggagatccgctgcaattctgagagctcagtccttagtgcacacgaatcctgtttgcgagcccctaacctggtgagctataagccaatgattgaccagctagagtgcacaactaatctcatcgatcccttcgtggtcttcgaaagaggatctctgcctcagaccaggaacgacaaaacatttgctgcctcaaagggcaatcggggcgttcaggcgttcagtaaggggagcgtgcaagcagatcttaccctgatgtttgacaacttcgaggtagattttgtgggagccgctgtctcctgtgacgccgcattcttgaatctcacgggttgctactcttgtaacgctggcgcccgtgtgtgcctgtcgataactagcacagggaccggaactttatccgcgcataacaaagacggctcactgcacattgttctcccaagtgaaaatggtacaaaggatcagtgtcagatccttcactttaccgtgcccgaggtcgaggaagagttcatgtattcttgcgacggggatgaacgccctctgttggtgaaaggcacgctaattgccatcgacccatttgatgacagaagggaggcaggaggcgaaagcaccgtagttaacccgaagtccgggtcatggaatttctttgattggttcagcggactgatgtcttggtttggtggccccctcaaaacaactctgcttatctgtctgtacgtggctttgtccattggactcttcttcctgttaatatatctgggacggaccggcctaagtaagatgtggctcgccgctaccaaaaaggccagc

SEQ ID NO: 11386 - RNA, 1521 nt, synthetic construct
  misc_feature 1..1521: note = derived and/or modified CDS sequence (opt3) from RVFV(2007001292)__EU574046.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggaagaccaaacaaaattcttaaagatcaaaactgtgtcctctgagctgtcgtgccgcgaagggcagtcatactggaccggcagctttagtcccaagtgtctatcctctcgacgttgccacctcgtaggagagtgtcatgtgaatagatgcctgagctggagggataacgagacatccgctgagttctcatttgtcggtgaaagtaccactatgcgggaaaataagtgtttcgagcagtgcgggggatggggctgtggctgctttaacgtgaatcctagctgccttttcgttcacacatatctgcagtctgtgcgcaaagaggccttgagagtctttaactgtattgactgggtgcataagctcaccctggaaatcacggatttcgacgggtccgtatcaactattgatctgggagcaagcagttctaggtttaccaattggggttccgttagcctctcgttagacgccgagggcatctctgggtccaactcattcagttttatagaaagcccaggaaaaggctacgctatcgtggatgagccgttctccgaaattccccggcaaggttttctgggggagatccgctgcaattctgagagctcagtccttagtgcacacgaatcctgtttgcgagcccctaacctggtgagctataagccaatgattgaccagctagagtgcacaactaatctcatcgatcccttcgtggtcttcgaaagaggatctctgcctcagaccaggaacgacaaaacatttgctgcctcaaagggcaatcggggcgttcaggcgttcagtaaggggagcgtgcaagcagatcttaccctgatgtttgacaacttcgaggtagattttgtgggagccgctgtctcctgtgacgccgcattcttgaatctcacgggttgctactcttgtaacgctggcgcccgtgtgtgcctgtcgataactagcacagggaccggaactttatccgcgcataacaaagacggctcactgcacattgttctcccaagtgaaaatggtacaaaggatcagtgtcagatccttcactttaccgtgcccgaggtcgaggaagagttcatgtattcttgcgacggggatgaacgccctctgttggtgaaaggcacgctaattgccatcgacccatttgatgacagaagggaggcaggaggcgaaagcaccgtagttaacccgaagtccgggtcatggaatctgttcgattggtttagcggactcatgtcttggttcggtggccccctgaaaacaatccttctgatttgtttgtacgtggctctctccatagggctgtttttcttactgatctatctaggacggactggcctcagtaagatgtggctggccgctaccaaaaaggccagc

SEQ ID NO: 11387 - RNA, 1521 nt, synthetic construct
  misc_feature 1..1521: note = derived and/or modified CDS sequence (opt3) from RVFV(2007002445)__EU574037.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggaagaccaaacaaaattcttaaagatcaaaactgtgtcctctgagctgtcgtgccgcgaagggcagtcatactggaccgggagctttagtcccaagtgtctatcctctcgacgttgccacctcgtaggcgagtgtcatgtgaatagatgcctgagctggagggataacgagacatccgctgagttctcatttgtcggtgaaagtaccactatgcgggaaaataagtgtttcgagcagtgcgggggatggggctgtggctgctttaacgtgaatcctagctgccttttcgttcacacatatctgcagtctgtgcgcaaagaggccttgagagtctttaactgtattgactgggtgcataagctcaccctggaaatcacggatttcgacgggtccgtatcaactattgatctgggagcaagcagttctaggtttaccaattggggttccgttagcctctcgttagacgccgagggcatctctgggtccaactcattcagttttatagaaagcccaggaaaaggctacgctatcgtggatgagccgttctccgaaattccccggcaaggttttctgggggagatccgctgcaattctgagagctcagtccttagtgcacacgaatcctgtttgcgagcccctaacctggtgagctataagccaatgattgaccagctagagtgcacaactaatctcatcgatcccttcgtggtcttcgaaagaggatctctgcctcagaccaggaacgagaaaacatttgctgcctcaaagggcaatcggggcgttcaggcgttcagtaaggggagcatacaagcagaccttaccctgatgtttgataacttcgaagtggactttgtaggagccgctgtgtcctgtgatgccgcattcttgaatctcacgggttgctactcttgtaacgctggcgcccgtgtctgcctgtcgattactagcacagggaccggaactttatccgcgcataacaaagacggctcactgcacatcgtgctcccaagtgagaatggtacaaaggaccagtgtcagattcttcactttaccgttcccgaggtggaagaggagttcatgtattcttgcgatggggacgaacgccctctgttggtcaaaggcacgctaatcgccatcgatccatttgacgatagaagggaagcaggaggcgagagcaccgtggtaaacccgaagtccgggtcatggaatttctttgactggttcagcggactgatgtcttggtttggtggccccctcaaaacaattctgcttatatgtctgtacgttgctttgtccatcggactcttcttcctgttaatttatctgggacggactggcctaagtaagatgtggctcgccgctaccaaaaaggccagc

SEQ ID NO: 11388 - RNA, 1521 nt, synthetic construct
  misc_feature 1..1521: note = derived and/or modified CDS sequence (opt3) from RVFV(Ken 199800523)__KU978777.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggaagaccaaacaaaattcttaaagatcaaaactgtgtcctctgagctgtcgtgccgcgaagggcagtcatactggaccgggagctttagtcccaagtgtctatcctctcgacgttgccacctcgtaggcgagtgtcatgtgaatagatgcctgagctggagggataacgagacatccgctgagttctcatttgtcggtgaaagtaccactatgcgggaaaataagtgtttcgagcagtgcgggggatggggctgtggctgctttaacgtgaatcctagctgccttttcgttcacacatatctgcagtctgtgcgcaaagaggccttgagagtctttaactgtattgactgggtgcataagctcaccctggaaatcacggatttcgacgggtccgtatcaactattgatctgggagcaagcagttctaggtttaccaattggggttccgttagcctctcgttagacgccgagggcatctctgggtccaactcattcagttttatagaaagcccaggaaaaggctacgctatcgtggatgagccgttctccgaaattccccggcaaggttttctgggggagatccgctgcaattctgagagctcagtccttaacgcacacgaaagttgtttgcgagcccctaatctgatttcctataagccaatgatcgaccagctagagtgcacaactaacctcatagatcccttcgtggtgttcgaaagaggaagcctgcctcagaccaggaatgacaaaacatttgctgcctctaagggcaaccggggcgtccaggcgttctcaaaggggagtgttcaagcagatcttaccctgatgtttgacaatttcgaggtggattttgtaggagccgctgtgagctgtgacgccgcattcttgaacctcacgggttgctactcctgtaacgctggcgcccgtgtctgcctgtctattacttcgacagggaccggaactttaagcgcgcataataaagaaggctccctgcacatcgtgctcccatcagagaacggtacaaaggaccagtgtcagattcttcactttaccgttcccgaggtggaagaggagttcatgtatagttgcgatggggacgaacgccctctgttggtcaaaggcacgctaatcgccatcgatccatttgacgatagaagggaagcaggaggcgagtctaccgtggtaaatcccaagagcgggtcctggaacttctttgactggttctcaggactgatgagctggtttggtggcccgctcaaaacaattctgcttatatgtctgtacgttgctttgtctatcggactcttcttcctgttaatttatctgggacggactggcctatccaagatgtggctcgccgctaccaaaaaggccagt

SEQ ID NO: 11389 - RNA, 1521 nt, synthetic construct
  misc_feature 1..1521: note = derived and/or modified CDS sequence (opt3) from RVFV(clone 13)__DQ380213.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggacgatcaaacaaaattcttaaagatcaaaactgtgtcctctgaactgtcgtgccgcgaggggcagtcatactggaccgggagctttagtcccaagtgtctatcctctcgacgttgccacctcgtaggcgaatgtcatgtgaatagatgcctgagctggagggacaacgagacatccgctgagttctcatttgtcggtgaaagtaccactatgcgggagaataagtgtttcgaacagtgcgggggatggggctgtggctgctttaacgtgaatcctagctgccttttcgttcacacatatctgcagtctgtgcgcaaagaggccttgagagtctttaactgtattgattgggtgcataagctcaccctggagatcacggacttcgatgggtccgtatcaactattgacctgggagcaagcagttctaggtttaccaattggggttccgttagcctctcgttagatgccgaaggcatctctgggtccaactcattcagttttatagagagcccaggaaaaggctacgctatcgtggacgaaccgttctccgagattccccggcaaggttttctgggggaaatccgctgcaattctgagagctcagtccttagtgcacacgagtcctgtttgcgagcccctaacctgattagctataagccaatgatcgatcagctagaatgcacaactaatctcatagaccccttcgtggtgttcgagagaggatctctgcctcagaccaggaacgagaaaacatttgctgcctcaaagggcaatcggggcgtccaggcgttcagtaaggggagcgttcaagcagatcttaccctgatgtttgacaacttcgaagtggattttgtaggagccgctgtgtcctgtgacgccgcattcttgaatctcacgggttgctactcttgtaacgctggcgcccgtgtctgcctgtcgattactagcacagggaccggaactttatccgcgcataacaaagacggctcactgcacatcgtgctcccaagtgaaaatggtacaaaggatcagtgtcagattcttcactttaccgttcccgaggtggaggaagagttcatgtattcttgcgacggggatgaacgccctctgttggtcaaaggcacgctaatcgccatcgacccatttgatgacagaagggaggcaggaggcgaaagcaccgtggtaaacccgaagtccgggtcatggaatttctttgattggttcagcggactgatgtcttggtttggtggccccctcaaaacaattctgcttatatgtctgtacgttgctttgtccatcggactcttcttcctgttaatttatctgggacggactggcctaagtaagatgtggctcgccgctaccaaaaaggccagc

SEQ ID NO: 11390 - RNA, 1521 nt, synthetic construct
  misc_feature 1..1521: note = derived and/or modified CDS sequence (opt3) from RVFV(2373/74)__DQ380194.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggaagaccaaacaaaattcttaaagatcaaaactgtgtcctctgagctgtcgtgccgcgaagggcagtcatactggaccggcagctttagtcccaagtgtctatcctctcgacgttgccacctcgtaggagagtgtcatgtgaatagatgcctgagctggagggataacgagacatccgctgagttctcatttgtcggtgaaagtaccactatgcgggaaaataagtgtttcgagcagtgcgggggatggggctgtggctgctttaacgtgaatcctagctgccttttcgttcacacatatctgcagtctgtgcgcaaagaggccttgagagtctttaactgtattgactgggtgcataagctcaccctggaaatcacggatttcgacgggtccgtatcaactctggatctcggagcaagcagttctaggtttaccaattggggttccgttagcttatcgctggacgccgagggcatttctgggtccaactcattcagttttatcgaaagcccaggaaaaggctacgctatagtggatgagccgttctccgaaatcccccggcaaggttttcttggggagattcgctgcaattctgagagctcagtcttgagtgcacacgaatcctgtctgcgagcccctaacctaatcagctataagccaatgattgaccagctcgagtgcacaactaatctgatcgatcccttcgtggtgttcgaaagaggatctcttcctcagaccaggaacgagaaaacatttgctgcctcaaagggcaatcggggcgtccaggcgttcagtaaggggagcgttcaagcagacctgaccttgatgtttgataacttcgaagtggactttgtaggagccgctgtgtcctgtgatgccgcattcctcaatctgacgggttgctactcttgtaacgctggcgcccgtgtctgcttatcgataactagcacagggaccggaactctgtccgcgcataacaaagacggctcactccacattgtgcttccaagtgagaatggtacaaaggaccagtgtcagatcctgcactttaccgttcccgaggtggaagaggagttcatgtattcttgcgatggggacgaacgccctttgctagtcaaaggcacgctgattgccatcgatccatttgacgatagaagggaagcaggaggcgagagcaccgtggtaaacccgaagtccgggtcatggaatttctttgactggttcagcggactcatgtcttggtttggtggccccctgaaaacaatccttctgatttgtttgtacgttgctctctccatagggctgttcttcttactgatctatctaggacggactggcctcagtaagatgtggctggccgctaccaaaaaggccagc

SEQ ID NO: 11391 - RNA, 1521 nt, synthetic construct
  misc_feature 1..1521: note = derived and/or modified CDS sequence (opt3) from RVFV(OS-8)__DQ380185.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggaagaccaaacaaaattcttacgcatcaagactgtgtcctctgagctgtcgtgccgagaagggcagtcatactggaccgggagctttagtcccaaatgtctatcctctcgtagatgccacctcgtaggcgagtgtcatgtgaataggtgcctgagctggcgggataacgagacatccgctgagttctcatttgtcggtgaaagtaccactatgcgcgaaaataagtgtttcgagcagtgcgggggatggggctgtggctgctttaacgtgaatcctagctgccttttcgttcacacatatctgcagtctgtgagaaaggaggccttgagggtctttaactgtattgactgggtgcataaactcaccctggaaatcacggatttcgacgggtccgtatcaactattgatctgggagcaagcagttctcggtttaccaattggggttccgttagcctctcgttagacgccgagggcatctctgggtccaactcattcagttttatagaaagcccaggaaagggctacgctatcgtggatgagccgttctccgaaattccccgccaaggttttctgggggagatccgatgcaattctgagagctcagtccttagtgcacacgaatcctgtttgagagcccctaacctgattagctataaaccaatgatcgaccagctagagtgcacaactaatctcatagatcccttcgtggtgttcgaaaggggatctctgcctcagacccggaacgacaagacatttgctgcctcaaaaggcaatcgtggcgtccaggcgttcagtaaggggagcgttcaagcagatcttaccctgatgtttgacaacttcgaggtggattttgtaggagccgctgtgtcctgtgacgccgcattcttgaatctctctggttgctactcgtgtaacgctggcgcccgcgtctgcctgagcattacgtccactgggacaggaaccttatcagcgcataacaaggacggcagtctgcacatcgtgctcccatctgaaaatggtactaaagatcagtgtcagattcttcactttacagttcccgaggtggaggaagagttcatgtatagctgcgacggggatgaaagacctctgttggtcaagggcaccctaatcgccatcgacccatttgatgacaggcgggaggcaggaggcgaatccacggtggtaaacccgaaatcagggagctggaatttctttgattggttctctggactgatgtcctggtttggtggccccctcaagaccattctgcttatatgtctgtacgttgctttgagtatcggactcttcttcctgttaatttatctgggacgaacaggcctaagcaaaatgtggctcgccgctactaagaaagcctct

SEQ ID NO: 11392 - RNA, 1521 nt, synthetic construct
  misc_feature 1..1521: note = derived and/or modified CDS sequence (opt3) from RVFV(KEN/Bar-035/07)__HM586969.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcacgcagcgtcggagccgaggcgtgtctgatgttgaaaggtgttaaggaagaccaaacaaaattcttaaagatcaaaactgtgtcctctgagctgtcgtgccgagaaggccagtcatactggaccgggagctttagtcccaagtgtctatcctctcgtagatgccacctcgtaggagagtgtcatgtgaataggtgcctgagctggcgggataacgagacatccgctgagttctcatttgtcggcgaaagtaccactatgcgcgaaaataagtgtttcgagcagtgcggtgggtggggatgtggctgctttaacgtgaatcctagctgccttttcgttcacacatatctgcagtctgtgagaaaagaggccttgagggtctttaactgtattgactgggtgcataagctcaccctggaaatcacggatttcgacggctccgtatcaactattgatctgggggcaagcagttctcggtttaccaattggggatccgttagcctctcgttagacgccgagggtatctctggctccaactcattcagttttatagaaagcccagggaaaggatacgctatcgtggatgagccgttctccgaaattccccgccaaggctttctgggtgagatccgatgcaattctgagagctcagtccttagtgcacacgaatcctgtttgagagcccctaacctggtgagctataagccaatgattgaccagctagagtgcacaactaatctcatcgatcccttcgtggtcttcgaaagggggtctctgcctcagacccggaacgacaaaacatttgctgcctcaaagggaaatcgtggcgttcaggcgttcagtaagggcagcgtgcaagcagatcttaccctgatgtttgacaacttcgaggtagattttgtgggggccgctgtctcctgtgacgccgcattcttgaatctcacgggatgctactcttgtaacgctggtgcccgcgtgtgcctgtcgataactagcacaggcaccgggactttatccgcgcataacaaagacggatcactgcacattgttctcccaagtgaaaatggcacaaaggatcagtgtcagatccttcactttaccgtgcccgaggtcgaggaagagttcatgtattcttgcgacggtgatgaaagacctctgttggtgaaagggacgctaattgccatcgacccatttgatgacaggcgggaggcaggcggagaaagcaccgtagttaacccgaagtccggctcatggaatttctttgattggttcagcgggctgatgtcttggtttggaggtcccctcaaaacaatcctgcttatttgtctgtacgtggctttgtccataggcctcttcttcctgttaatctatctggggcgaactggactaagtaagatgtggctcgccgctaccaaaaaggccagc

SEQ ID NO: 11393 - RNA, 1521 nt, synthetic construct
  misc_feature 1..1521: note = derived and/or modified CDS sequence (opt3) from RVFV(MgH824)__DQ380210.1__Gc
  source 1..1521: mol_type = other RNA
tgcagcgagctgatccaggcctcctctagaattaccacatgttcaactgaaggcgtggacacgaagtgcaggctcagtgggaccgctcttatacgggcaggaagcgtcggtgccgaggcgtgtctgatgttgaaaggcgttaaggaagatcaaacaaaattcttaaagatcaaaactgtgtcctctgagctgtcgtgccgcgaagggcagtcatactggaccgggagctttagtcccaagtgtctatcctctcgacgttgccacctcgtaggcgagtgtcatgtgaacagatgcctgagctggagggacaatgagacatccgctgagttctcatttgtcggtgaaagtaccactatgcgggaaaacaagtgtttcgagcagtgcgggggatggggctgtggctgctttaatgtgaaccctagctgccttttcgttcacacatatctgcagtctgtgcgcaaagaggccttgagagtctttaattgtattgattgggtgcataagctcaccctggaaatcacggacttcgatgggtccgtatcaactattgacctgggagcaagcagttctaggtttaccaactggggttccgttagcctctcgttagatgccgagggcatctctgggtccaattcattcagttttatagaaagcccaggaaaaggctacgctatcgtggacgagccgttccccgaaattcctcggcaaggttttctgggggagatccgctgcaactccgagtctagcgtcctttcagcacacgaaagttgtttgcgagccccaaatctgatttcctataagcccatgatcgatcagctagagtgcacaactaacctcatagaccctttcgtggtgttcgaaagaggaagcctgccacagaccaggaatgataaaacatttgctgcctctaagggcaaccggggcgtccaggcgttctcaaaggggagtgttcaagcagaccttaccctgatgtttgataatttcgaggtggactttgtaggagccgctgtgagctgtgacgccgcattcttgaacctcacgggttgctactcctgtaatgctggcgcccgtgtctgcctgtctattacttcgacagggaccggcagcttatccgcgcataacaaagatggatcactgcacatcgtgctccccagtgaaaacggtactaaggaccagtgtcagattcttcactttacagttcctgaggtggaggaagagttcatgtattcttgcgatggggacgaacgcccactgttggtcaaaggcaccctaatcgccatcgatccgtttgacgatagaagggaggcaggaggcgaaagcacggtggtaaatcccaagtccgggtcatggaacttctttgactggttcagcggactgatgtcttggtttggtggccctctcaaaaccattctgcttatatgtctgtacgttgctttgtccatcggactcttcttcctgttaatttatctgggacggacaggcctaagtaagatgtggctcgccgctactaaaaaggccagc

SEQ ID NO: 11394 - RNA, 1521 nt, synthetic construct
  misc_feature 1..1521: note = derived and/or modified CDS sequence (opt3) from RVFV(200803169)__JF311384.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggtggaccaaacaaaattcttaaagatcaaaactgtatcctctgaactgtcgtgccgcgaggggcagtcatactggaccgggagctttagtcccaagtgtctatcctctcgacgttgccacctcgtgggcgaatgtcatgtcaatagatgcctgagctggagggataacgagacatccgctgagttctcatttgtgggtgaaagtaccactatgcgggagaataagtgtttcgaacagtgcgggggatggggctgtggctgctttaacgttaatcctagctgccttttcgtgcacacatatctgcagtctgtccgcaaagaggccttgagagtgtttaactgtattgactgggtacataagctcaccctggagatcacggatttcgacgggtccgtttcaactattgatctgggagcaagcagttctaggtttaccaattggggttccgtgagcctctcgttagacgccgaaggcatctctgggtccaactcattcagttttatagagagcccaggaaaaggctacgctatcgtcgatgaaccgttctccgagattccccggcaaggttttctgggggaagtgcgctgcaattctgagagctcagtgcttagtgcacacgagtcctgtttgcgagcccctaacctggtcagctataagccaatgatcgaccagctagaatgcacaactaatctcattgatcccttcgttgtgttcgagagaggatctctgcctcagaccaggaacgacaaaacatttgctgcctcaaagggcaatcggggcgtacaggcgttcagtaaggggagcgtgcaagcagatcttaccctgatgtttgacaacttcgaagtcgattttgtgggagccgctgtttcctgtgacgccgcattcttgaatctcacgggttgctactcttgtaacgctggcgcccgtgtgtgcctgtcgatcactagcacagggaccggaactttatccgcgcataacaaagacggctcactgcacatagtcctcccaagtgagaatggtacaaaggatcagtgtcagattcttcactttaccgtgcccgaagtagaggaggagttcatgtattcttgcgacggggatgaacgccctctgttggttaaaggcacgctaatcgccattgacccatttgatgacagaagggaagcaggaggcgagagcaccgtggtcaacccgaagtccgggtcatggaatttctttgattggttcagcggactgatgtcttggtttggtggccccctcaaaacaatcctgcttatctgtctgtacgtggctttgtccattggactcttcttcctgttaatatatctgggacggactggcctaagtaagatgtggctcgccgctaccaaaaaggccagc

SEQ ID NO: 11395 - RNA, 1521 nt, synthetic construct
  misc_feature 1..1521: note = derived and/or modified CDS sequence (opt3) from RVFV(2007001811)__EU574040.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggaagaccaaacaaaattcttaatgatcaagactgtgtcctctgagctgtcgtgccgcgaagggcagtcatactggaccgggagctttagtcccaaatgtctatcctctcgacgttgccacctcgtaggcgagtgtcatgtgaatagatgcctgagctggagggataacgagacatccgctgagttctcatttgtcggtgaaagtaccactatgcgggaaaataagtgtttcgagcagtgcgggggatggggctgtggctgctttaacgtgaatcctagctgccttttcgttcacacatatctgcagtctgtgcgcaaggaggccttgagagtctttaactgtattgactgggtgcataaactcaccctggaaatcacggatttcgacgggtccgtatcaactattgatctgggagcaagcagttctaggtttaccaattggggttccgttagcctctcgttagacgccgagggcatctctgggtccaactcattcagttttatagaaagcccaggaaagggctacgctatcgtggatgagccgttctccgaaattccccggcaaggttttctgggggagatccgctgcaattctgagagctcagtccttagtgcacacgaatcctgtttgcgagcccctaacctgattagctataaaccaatgatcgaccagctagagtgcacaactaatctcatagatcccttcgtggtgttcgaaagaggatctctgcctcagaccaggaacgagaagacatttgctgcctcaaaaggcaatcggggcgtccaggcgttcagtaaggggagcgttcaagcagaccttaccctgatgtttgataacttcgaagtggactttgtaggagccgctgtgtcctgtgatgccgcattcttgaatctcacgggttgctactcttgtaacgctggcgcccgtgtctgcctgtcgattactagcacagggaccggaactttatccgcgcataacaaggacggctcactgcacatcgtgctcccaagtgagaatggtacaaaagaccagtgtcagattcttcactttaccgttcccgaggtggaagaggagttcatgtattcttgcgatggggacgaacgccctctgttggtcaagggcacgctaatcgccatcgatccatttgacgatagaagggaagcaggaggcgagagcaccgtggtaaacccgaaatccgggtcatggaatttctttgactggttcagcggactgatgtcttggtttggtggccccctcaagacaattctgcttatatgtctgtacgttgctttgtccatcggactcttcttcctgttaatttatctgggacggactggcctaagtaaaatgtggctcgccgctaccaagaaagccagc

SEQ ID NO: 11396 - RNA, 1521 nt, synthetic construct
  misc_feature 1..1521: note = derived and/or modified CDS sequence (opt3) from RVFV(Kenya 57 (Rintoul))__DQ380192.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggaagaccaaacaaaattcttaaagatcaaaactgtgtcctctgagctgtcgtgccgcgaagggcagtcatactggaccgggagctttagtcccaagtgtctatcctctcgacgttgccacctcgtaggcgagtgtcatgtgaatagatgcctgagctggagggataacgagacatccgctgagttctcatttgtcggtgaaagtaccactatgcgggaaaataagtgtttcgagcagtgcgggggatggggctgtggctgctttaacgtgaatcctagctgccttttcgttcacacatatctgcagtctgtgcgcaaagaggccttgagagtctttaactgtattgactgggtgcataagctcaccctggaaatcacggatttcgacgggtccgtatcaactgttgatctgggagcaagcagttctaggtttaccaattggggttccgtgagcctctcgttagacgccgagggcatttctgggtccaactcattcagttttatcgaaagcccaggaaaaggctacgctatagtcgatgagccgttctccgaaatctctcggcaaggttttctgggggagattcgctgcaatagcgagtcaagtgtgctttccgcacacgaaagctgtttgcgagcccccaacctgatctcttataagcctatgattgaccagctagagtgcacaactaatctcatcgatccattcgtggtcttcgaaagaggatcactgccccagaccaggaacgacaaaacatttgctgccagtaagggcaatcggggcgttcaggcgttcagcaaggggtccgtgcaagcagatcttaccctgatgtttgacaacttcgaggtagattttgtgggagccgctgtctcttgtgacgccgcattcttgaatctcacgggttgctactcgtgtaacgctggcgcccgtgtgtgcctgagcataacttccacagggaccggaactttatcagcgcataacaaagacggcagtctgcacattgttctcccttctgaaaatggtacaaaggatcagtgtcagatccttcactttaccgtgccagaggtcgaggaagagttcatgtatagctgcgacggggatgaacgccccctgttggtgaaaggcacgctaattgccatcgacccttttgatgacagaagggaggcaggaggcgaatccaccgtagttaacccaaagtcagggagctggaatttctttgattggttctctggactgatgtcctggtttggtggcccgctcaaaacaatcctgcttatttgtctgtacgtggctttgagtataggactcttcttcctgttaatctatctgggacggactggcctaagcaagatgtggctcgccgctaccaaaaaggcctct

SEQ ID NO: 11397 - RNA, 1521 nt, synthetic construct
  misc_feature 1..1521: note = derived and/or modified CDS sequence (opt3) from RVFV(Beijing-01)__KX611606.1__Gc
  source 1..1521: mol_type = other RNA
tgcagcgagctgatccaggcctcctctagaattaccacatgttcaactgaaggcgtgaatacgaagtgcaggctcagtgggaccgctcttatacgggcaggaagcgtcggtgccgaggcgtgtctgatgttcgaaggcgttaaagaggaccaaacaaagtttttgaaaatcaagactgtgtcctctgaattatcgtgccgcgaggggcagtcatactggaccggcagcttcagtcccaaatgtctgtcctctcgacgttgccacctagtaggagagtgtcatgtgaatagatgcctcagctggagggataacgaaacatccgctgagttttcattcgtcggtgaaagtaccactatgcgggagaataagtgttttgagcagtgcgggggatggggctgtggctgcttcaacgtgaatcctagctgcctgtttgttcacacatatcttcagtctgtgcgcaaggaagccctgagagtcttcaactgtattgactgggtgcataaattgaccctcgagatcacggattttgacgggtccgtatcaactattgatctgggagcaagcagttctaggttcaccaattggggttccgttagcctgtcgctcgacgccgaaggcatctctgggtccaactcatttagtttcatagagagcccaggaaagggctacgctatcgtggatgaaccgttttccgagattccccggcaaggtttcttaggggagatccgctgcaattctgaaagctcagtcctgagtgcacacgagtcctgtcttcgagcccctaacttgattagctataaaccaatgatcgaccagctggaatgcacaactaatctaatagatcccttcgtggtgtttgagagaggatctctccctcagaccaggaacgacaagacattcgctgcctcaaaaggcaatcggggcgtccaggcgtttagtaaggggagcgttcaagcagatctgacccttatgttcgacaactttgaagtggatttcgtaggagccgctgtgtcctgtgacgccgcatttctgaatttgacgggttgctactcttgtaacgctggcgcccgtgtctgcctctcgattactagcacagggaccggaactctgtccgcgcataacaaggacggctcattacacatcgtgctgccaagtgagaatggtacaaaagatcagtgtcagattctccacttcaccgttcccgaggtggaagaggaatttatgtattcttgcgacggggatgagcgccctcttctggtcaagggcacgttgatcgccatcgacccattcgatgacagaagggaagcaggaggcgagagcaccgtggtaaacccgaaatccgggtcatggaactttttcgattggtttagcggactaatgtcttggttcggtggccccctgaagacaattctcctgatatgtctttacgttgctctgtccatcgggttgttctttctcctgatttatttaggacggactggcctgagtaaaatgtggctagccgctaccaagaaagccagc

SEQ ID NO: 11398 - RNA, 1521 nt, synthetic construct
  misc_feature 1..1521: note = derived and/or modified CDS sequence (opt3) from RVFV(ANK-6087)__DQ380216.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggaagaccaaacaaaattcttaaagatcaaaactgtgtcctctgagctgtcgtgccgcgaagggcagtcatactggaccgggagctttagtcccaagtgtctatcctctcgacgttgccacctcgtaggcgagtgtcatgtgaatagatgcctgagctggagggataacgagacatccgctgagttctcatttgtcggtgaaagtaccactatgcgggaaaataagtgtttcgagcagtgcgggggatggggctgtggctgctttaacgtgaatcctagctgccttttcgttcacacatatctgcagtctgtgcgcaaagaggccttgagagtctttaactgtattgactgggtgcataagctcaccctggaaatcacggatttcgacgggtccgtatcaactattgatctgggagcaagcagttctaggtttaccaattggggttccgttagcctctcgttagacgccgagggcatctctgggtccaactcattcagttttatagaaagcccaggaaaaggctacgctatcgtggatgagccgttctccgaaattccccggcaaggttttctgggggagatccgctgcaattctgagagctcagtccttagtgcacacgaatcctgtttgcgagcccctaacctgattagctataagccaatgatcgaccagctagagtgctctacaaatctcatagatcccttcgtggtgttcaaaagaggatcactgcctcagactaggaacgacaagacctttgctgccagtaagggcaatcggggcgtccaggcgttcagcaaagggtccgttcaagcagatcttacactgatgtttgacaacttcgaagtggattttgtaggagccgctgtgtcttgtgacgccgcattcttgaatctcaccggttgctactcgtgtaacgctggcgcccgtgtctgcctgagcattacgtccactgggacaggaaccttatcagcgcataacaaggacggcagtctgcacatcgtgctcccatctgagaatggtactaaagatcagtgtcagattcttcactttacagttcccgaagtggaggaggagttcatgtatagctgcgacggggatgaacgccctctgttggtcagaggcaccctaatcgccatcgacccatttgatgacaggcgggaagcaggaggcgagtccacggtggtaaacccgaagtcagggagctggaatttctttgattggttctctggactgatgtcctggtttggtggccccctcaaaaccattctgcttatatgtctgtacgttgctttgagtatcggactcttcttcctgttaatttatctgggacgaacaggcctaagcaagatgtggctcgccgctactaaaaaggcctct

SEQ ID NO: 11399 - RNA, 1521 nt, synthetic construct
  misc_feature 1..1521: note = derived and/or modified CDS sequence (opt3) from RVFV(MP12)__Z30318.1__Gc
  source 1..1521: mol_type = other RNA
tgcagcgagctgatccaggcctcctctagaattaccacatgttcaactgaaggcgtgaacacgaagtgcaggctcagtgggaccgctcttatacgggcaggaagcgtcggtgccgaggcgtgtctgatgttgaaaggcgttaaggaagaccaaacaaaattcttaaagctgaaaactgtgtcctctgagctatcgtgccgcgaagggcagtcatactggaccggcagctttagtcccaagtgtctctcctctcgacgttgccacctggtaggagagtgtcatgtgaatagatgccttagctggagggataacgagacatccgctgagttctcatttgtcggtgaaagtaccactatgcgggaaaataagtgtttcgagcagtgcgggggatggggctgtggctgctttaacgtgaatcctagctgcctgttcgttcacacatatttgcagtctgtgcgcaaagaggccctcagagtctttaactgtatcgactgggtgcataagctgaccctggaaattacggatttcgacgggtccgtatcaactatcgatctcggagcaagcagttctaggtttaccaattggggttccgttagcttatcgctggacgccgagggcatttctgggtccaactcattcagttttatcgaaagcccaggaaaaggctacgctatagtggatgagccgttctccgaaatcccccggcaaggttttcttggggagattcgctgcaattctgagagctcagtcttgagtgcacacgaatcctgtctgcgagcccctaacctaatcagctataagccaatgattgaccagctcgagtgcacaactaatctgatcgatcccttcgtggtgttcgaaagaggatctcttcctcagaccaggaacgacaaaacatttgctgcctcaaagggcaatcggggcgtccaggcgttcagtaaggggagcgttcaagcagatctgaccttgatgtttgacaacttcgaggtggattttgtaggagccgctgtgtcctgtgacgccgcattcctcaatctgacgggttgctactcttgtaacgctggcgcccgtgtctgcttatcgataactagcacagggaccggatccctgtcagcgcataacaaagacggcagtctccacattgtgcttccatctgaaaatggtactaaggatcagtgtcagatcctgcactttacagttcccgaggtggaggaagagttcatgtatagctgcgacggggatgaacgccctttgctagtcaaaggcaccctgattgccatcgacccatttgatgacagaagggaggcaggaggcgaatccacggtggtaaacccgaagtcagggagctggaatttctttgattggttctctggactcatgtcctggtttggtggccccctgaaaaccatccttctgatttgtttgtacgttgctctcagtatagggctgttcttcttactgatctatctaggaggcacaggtctcagcaagatgtggctggccgctactaaaaaggcctct

SEQ ID NO: 11400 - RNA, 1521 nt, synthetic construct
  misc_feature 1..1521: note = derived and/or modified CDS sequence (opt3) from RVFV(KEN/Bar-032/07)__HM586968.1__Gc
  source 1..1521: mol_type = other RNA
tgcagcgagctgatccaggcctcctctagaattaccacatgttcaactgaaggcgtgaacacgaagtgcaggctcagtcacaccgctcttatacgggcagggagcgtcggagccgaggcgtgtctgatgttgaaaggtgttaaggaagaccaaacaaaattcttaaagatcaaaactgtgtcctctgagctgtcgtgccgcgaaggccagtcatactggaccgggagctttagtcccaagtgtctatcctctcgacgttgccatctcgtaggagagtgtcacgtgaatagatgcctgagctggagggataacgagacatccgctgagttctcatttgtcggcgaaagtaccactatgcgggaaaataagtgtttcgagcagtgcggtgggtggggatgtggctgctttaacgtgaatcctagctgccttttcgttcatacatatctgcagtctgtgcgcaaagaggccttgagagtctttaactgtattgactgggtgcacaagctcaccctggaaatcacggatttcgacggctccgtatcaactattgatctgggggcaagcagttctaggtttaccaattggggatccgttagcctctcgttagacgccgagggtatctctggctccaactcattcagttttatagaaagcccagggaaaggatacgctatcgtggatgagccgttctccgaaattccccggcaaggctttctgggtgagatccgctgcaattctgagagctcagtccttagtgcacatgaatcctgtttgcgagcccctaacctggtgagctataagccaatgattgaccagctagagtgcacaactaatctcatcgatcccttcgtggtcttcgaaagagggtctctgcctcagaccaggaacgacaaaacatttgctgcctcaaagggaaatcggggcgttcaggcgttcagtaagggcagcgtgcaagcagatcttaccctgcgttttgacaacttcgaggtagattttgtgggggccgctgtctcctgtgacgccgcattcttgaatctcacgggatgctactcttgtaacgctggtgcccgcgtgtgcctgtcgataactagcacaggcaccgggactttatccgcgcacaacaaagacggatcactgcacattgttctcccaagtgaaaatggcacaaaggatcagtgtcagatccttcattttaccgtgcccgaggtcgaggaagagttcatgtattcttgcgacggtgatgaaagacctctgttggtgaaagggacgctaattgccatcgacccatttgatgacaggcgggaggcaggcggagaaagcaccgtagttaacccgaagtccggctcatggaatttctttgattggttcagcgggctgatgtcttggtttggaggtcccctcaaaacaatcctgcttatttgtctgtacgtggctttgtccataggcctcttcttcctgttaatctatctggggcgaactggactaagtaagatgtggctcgccgctaccaaaaaggccagc

SEQ ID NO: 11401 - RNA, 4020 nt, synthetic construct
  misc_feature 1..4020: note = derived and/or modified CDS sequence (opt3) from SFNV(Toscana)__NC_006320.1__GP
  source 1..4020: mol_type = other RNA
atgttcatcgccaagctgctccttattagctgcctggtgcagcaggcttacttgaaatataccataatctccgagattggcaacgggacaagaacttctttttgttactcaagtaggacgagcttaggatccctgctagaagcatgggacaatatcaccgagtctattggtctcacatcgggcacttgcaaggtcgggtcactggaaaaccgggattgtaaacgcgacatcatgagcaattatgttgccgaggtgcacagtaaccttcatggactgggcgcgatgatgcacaattacggtgatgacaagcgagtagaagtgttgaacgatgtcatacccgacgagctcaatcctgggcgtcataactgctccgatctggacagaaaaccattctggaccgagtttatcaatgtggctaagccggccaacaagattgcacccatctctgttattcctccacccatcgtgaaacctataccaattgccgaaagcacaatcaagaaaaccattcccttcgataagctgctctccgaggctgaaaaagagttaaatcaaactaagatcaggctggagacagaacggcgctcaaacgcagaggaagccgctagagagagggcccggatgcgcgaaatcgaggacaaacttcgaaagaattgggagttggaaagagagaggaaggatgcggtcgcagacgatctggccaaagaaattgctcggcgtcgcgagatagaaagaaaggcccacgagctagacaaaatgctcaagaaaaaggagagggaagaccaggtggcaatcgagcgggtaagtgaagatatgcgaaaccatgttcgcagacctaataccacgattgctccagccccgactatcataaccacactgcttatggcgagcgccgtgatggcaggacccctggagaacagggaaactaaccacttgctcaatcggcctggcaacggcgcttataccctgtctgactttgccgagtccacatgtaccttagcttacgggtcaaagtgcaaaagctgggagcaccagctggatgaactcagtttcccatttttccattctaatcttgacaagtattccatgctggaggccgcaacggaaactattcccatcttgaacaaaagctcggccgtctgtacaatctctccttccacccactcaagtaatgcttgcggacgcgaggcgagcctaattaagaaaaagtgtggtaacaatatgtccgcatttttctacgtgaacctggccggccaaatcactgtggtcaagtgcgatacaaatcatgttctctctaacgactgtgggaattgcattagcaaaaccctgtcaggacagaagatatacacgccagtgcaggatatgttttgccagagaggctggaccgagagtatcccctccacaaggtatagcaaagacctttgttctattggtctgcacactgtaaaggaatgcaaaaccgggacaactaacttcgagcgtgtgggatttatcgtcgtgaagtcacggaagatgtacatcgaacaaatgaaaatgcgaagtagacaggagttcagcgaagatcagttcttgtgttataagtccgagtcttcgagcggctcctcagttaaactcaagaaagtgaaggtcgagagttgcaagggcgtgaccacatctagcgcttccaaatgttcaggggacgaatacttttgcagcaggtatccgtgtgagaccgccaatgtagaagcacactgcattctgcgccggcattctgccgttatagaggtgaacgtcaatggagtgtgggtcgtgcctagatgtatcggttacgaagaggttttagtgaggcgcacttccctgaagatggaggatacgagtagccgagaatgcgacacatgtctatgggagtgcggcaaaaacaagctcattgtaaaaacccacgggcccaagatcgtctatgctactgcctgctctcatggatcctgtaaatcagtgatgcagaagccagcaaccttcgtttacctgccttaccccggcaacagtgaaattgtgggtggggacatcggcgtccacatgacagaggaaagctcgccatccaatatacatatggtggcgcactgccccgctaaggattcttgtgaggtaagctcatgcttgttttgtgtgcacggacttctgaactatcaatgccataccctcttcagtgccctgcttatctccactacagttatgtctattctgacgttgctcctgttactggtcaaaggcgcaaaggacctagtgaaaaagctcttttactggctgatcacccctctttgttggttgagcgtgttctgcgggtggatgattaaatcctggaagaagaaagtcggatcagccatcagccggactaatgatacaataggttggcgtgacaacagaaggtatggccgcgatgttgagcgggctcagtacaccgggggagccccaggcgcaaagtatagtttttacggtgtgatgattctggggctcctgggcaatgtgcactcttgttccgaaagcgtaatcgctgactcgaaagtcatgcagtgcacaacttcaggatctagtaccttatgtaaggcctccggcacggtgattatgaaactggggccgatcggaagcgagtcttgccttatattgaagggtctcaaggataacgaaaaacaattcatcagcattaagaccatctcctcagagctgacatgcagagagggcgaaagtttttggactaccctatatacacccgtttgtctgagctctaggcgatgccatctcatgggggagtgttgctccgaccgctgtctgaaatggaagactaatgaaacctcagcggagttcacgggaaaagcccacggcgaagtgatgcacgagaaccggtgctttgagcagagtggtgggattggctacggatgtttcaatgtcaaccctagctgcctttacgtgcattccatcttgaagtctgtttataagaatggctttaaaatattcagatgtgtggcttggaaccacaggattcgtctggaagtaacaacccattcgcgcaagttcccaatggtcttaatggcaatgagcactcagcccacagattgggggtcaatcggactcatcctggactccgagggcattaccggtactaatgcctacagttttatgaaacacgggtctggaagccttgctatcattgatgacccttattccccagaaccccggaagggcttcctgggtgaggtgagatgcccgaccgaagagacagccataagggcatcaccttcttgtaaaatggcgccaaacttgatcgagtaccagcccgaaatggatacggccgagtgcaccactaatatgattgaccctatggctatctttaaccgaggcagcctcccccaagtgcgggacgggatgacattcacccagagtattgaaaagaacacagtccaggccctgactaccggagaggttcgcgcatccatcagactaacgctggatgactatgatgtggtataccataatagccagtctgactgctcagctacatttaaaaacctcaccggctgttattcctgcgatgaagggagtaggatgtgttaccaagtgaaggccgagggagagactatattccactttgtcaatgaagacgagagcatcaacgtgattaataaggtttcgccagatgtgtctgactactgcaccgtcctgcacttctcccggcctgtgatcagcattgaaggccgatatgattgtggtctttcaaaaagtcccatggttatcaaggggacattgatagcaactgccccacatgacgatagaaaacacgagggaggttcttccctggtggtcaacccgaagggcggcaccgtagactttttcgggtgggtgagcggattaacatcatggctcggcgggcctctgaaaacgtttcttaccattctgggattcctagctctcggcctgttgctggttgtgatcatcattactatagcgcgcacaggtgtcgagcaggccttaaagaagaaaaataagtga

SEQ ID NO: 11402 - RNA, 3972 nt, synthetic construct
  misc_feature 1..3972: note = derived and/or modified CDS sequence (opt3) from SFNV__HM566171.1__GP
  source 1..3972: mol_type = other RNA
atgctgaacaccaagagcatcattctcataacatgccttgtgcagcaagtccacctgaaatacactatcatttccgaggttacgaagggcgccagagaagtgtcttgttattcaagtaccacaaggttggaccagttactggaggcttgggaaaataaaagcgcactaatggggctccggaagggaaactgcaaactgggtgccatggagcaggtagattgtaatcttgacctgatgtccaactacgtgtctaatgtctatgataacccccatggcttgggggcgatgatgtacaatgacaagcgcatcgaagtgctcaacgatcagattcctgactcgatgatcccaggaggccacaattgctcactgctggagcgaaagccgttctgggctgatctcatacccagcaaaaaggagaaccctcgtccaagtttaatctccctggttcccactcctagatctgactttaaaaggaagttcgaagaggccgaagaggagatgaaaaagattcggaaggaacttcaagatgagcgccaggcacagttgagcgtgatcgaagagggtagaaaaaggatgcgggacctggaagataagctaatgcgccagtggaatgaggagaaacaaaagaaagggctcctggaagagacccttgaaaagaaacgacagctgaagaacaaggccttgctcgacgctcataatctggataaacagttaaaggagaaagacagagaatttaagacagcaatggaggagcaccagaacgaaaggcatcggattaattccaacatgatccgtccacccataaccactcctgccgctgtcattctgacatcactccttagtgccagcgtggtactgggattcgagttggaaaaccgcaataccaaccacgcgctaaatagaccaggcaacggcgggtattctatctccgacaataacctgattgaggcaaaatgtatgatcacgtacggaaataagtgcccgtcatgggaaatgcaactcgatcccgttagctatccatttttcagttctaactttgagaagtactccctgcttgagagcatctcggaaacttctcctattataggtaaattctccgaggtgtgtgtcctgtcaaatttgcccggcgcccagaagacctgcgctaaagaagccagtctcatcaagaaacagtgtagcgacgatatgagggcatacttttatattaactccctggggaagttagctatcgtgacatgccctgagaataacgtgctgtctcaagactgtaatttctgcctacggaaggccaaaggagagcagtacgtctataagccaatacaggatggcttttgccagaacggtggggttagctcagtgcccagtattcgatactccaaagacatctgtagcatcggaccgactaaggtaaagaattgccacaagggcacctctcgctatgaaagaacagcgttcatttcaaccggcgataagaaagtgtacctcgaggaaatcaagattaggagtcggcaagagtatgaacctgaccagtttctgtgttacaaagtcaaggatagctcctcttcgccccttgcctacgagaaagtgcaggttagcaagtgcaaagggatagagacgaactccccaaagaagtgtactggagacgaatatttctgctcaaaatacccttgtgagagtacatctcccgaagcaaactgcttcttgcgcaagcatagcgctatcctggaggtgaatattggtggcatgtggatcaaaccaaagtgtatcgggtatgaaatggccctcgtcaaaagagtgggactgaggtccgaggatgtatcaagcaaggagtgcgctacctgtctttgggaatgcagctccggctacattagtataactacacacggtcccaagatcagctatgccaccgcatgctctcatgggtcctgtaaatcaattgttcagaaccctagtacgagcatccgtatttcgtacccaggcaattccgagatcgtgggaggcgacatagggatccacctgaccgaagactctagcccgattaacttgcacctcaagatccattgctcacccaaagatagttgtgaggtctccgactgcatcttttgtgtgcacggactgttaaattatcaatgccattctgtcgccagcgctctgctactctccacaattactgcgtcactgatagtgcttatgatttacatgttgagcaagaccaaattcgttatgaagaagctgatccctattatgctcacaccactgtgttggtgctttgtgttactggcatggcttactaaaagttggaagggtaaaatgcggaacgccatccagtctgctaattccaccataggctggacagaacgagaggagagaatcgtagccgaaaggccccgcagccggaacaccgtcagatactcgttctatggggtggttattttggcaatgctcgagtcagcctttggatgttctgaaagtctgatcgctgagtccaaggtgatgcagtgcaatattgccaacggcaaaactagctgtagggcatctggtacgatcataatgaagctagggcctattggcagcgaggcgtgcctgatcctcaagggactgcgcgattccgacaaacagtacatctcagtcaagacagaaagtagcgagcttatttgccgagaaggcgagtctttctggacctccttgtatactccagtgtgtctgtcaagtcggcgttgccacttaatgggggaatgtaccggagatctctgcctgaaatggaagtctaataaaacatcccttgagtttgctggtaagaccagatctgacgtaatcaacgagaataaatgtttcgaacaatcgggcgggctgggatacggctgctttaacgtgaatcccagctgtttgtatactcatgcctacctcaagtcagtttataggaacggtttccgcgtctttaagtgcgcatcctggacacaccgggtgaaactgacgattaccactcacagtagaacattcccgatgaccctagccgctatgtctacacagcctactgattgggggagcataggcctgatcctcgactccgagggaatttcaggcaccaactcttttagcttcatgaagcatgggctgggaagtttcgccatcattgatgaaccatactccatggagcccaggaaaggctttatcggtgaagtgcgatgtcctacggaggaggcagctataaaggccagcaccctttgcaaaacagcgccccagttgatcgaataccagccagagatggactctgccgaatgtactaccaatatgattgatcctatgtcagtcttcaaccgcgggtccctgccccaagttcgggagggaatgacatttactcagagtatggaaaagaataccgtgcaggctatgacgacaggcgaggtgcacgcaagcatcagaattgtattagacgattatgaggtcgaatacctctcgtctcaagtggactgcgacgccaccttcaagaacctgactggttgctattcctgtgatgagggcgctagggtttgcatgcagatcatagcccatggggacacaatttttcacttccgtaatccagatgtgagcatcaacatccttcagaaagtcaataccaacactctgatttactgttcagtggttcactttagtaagccggtgataaaagaagagggaacctatgactgcggcgcaggggagaagcctatgatcctaaaaggaacactcgtagcggtctctccccataatgatcgcctggaacagggcggttccagcattgtgatcaacccaaaagggggaggcgtggacttcttgggttggctgtcaggctttagtagctggttcgggggacccttaaaggccattctcatggtcatcggctttctgcttctggggttgatactcttcgttacgatcgctattggactgaaatttgccctacggcaaatgatcgtgaagagaatgaaatga

SEQ ID NO: 11403 - RNA, 3873 nt, synthetic construct; identical to SEQ ID NO: 11086
  misc_feature 1..3873: note = derived and/or modified CDS sequence (opt3) from SFNV(Namru)__HM566169.1__GP
  source 1..3873: mol_type = other RNA

SEQ ID NO: 11404 - RNA, 3990 nt, synthetic construct
  misc_feature 1..3990: note = derived and/or modified CDS sequence (opt3) from SFNV/SFNV-like(Poona)__HM566177.1__GP
  source 1..3990: mol_type = other RNA
atgctgaacgtcaagagcgtgatcctcattacctgccttgttcagcaagcccacctgaaatacacaataatctccgaggtggctaagggcgcaagagaagtatcttgttattcaagtactacgaggttggaccagttactggaggcctgggaaaataaaagcgcgctaattgggctcaagcggggaaactgcaaactgggtgctatggagcagatcaattgtaaccttgatctgatgtccaattacgtgtctaacgtctatgacaatccccatggcttgggggccatgatgtacaacaccgattcggacaagcgcattgaagtgctcaatgatcagatccctgactcaatgataccaggaggccacaactgcagcctgctggagcgaaagccgttctgggcagatctcataccccctaaaaaggagaaagaattagacccaaagcccagtctgatttcccttgttcctacaccacgtgatgactttaaaaagaagttcgaggaagccgaggaggaaatgaaaaagatcagaaaagagttgcaaaatgaaaggcaggctcagctgtctgtgatggaggatagccggaagaaaatgcgcgacctagaagatagactcatgaggcagtgggaggaggaaaagcaaaagaagggtctgcttgaggaaactctggagaaggaacggcagttgaaaaacaaggcactcctggacgcccatgacttagataaacagctgaaggagcgcgaccgagagtttaaaaccgctatggaggaacaccagaatgaaagaaggcggattaactccaatatgatccgtccctatgtcacaacccctgccgcgataattctcacttcacttctgagtgcaagcgtggtagttgggttcgagttggaaaaccgcaacacaaatcatgtgctaaacagaccaggaaatggcggctactctatctccgataacaatctgattgaggccaagtgtatgatcacctatgggacgaagtgcctctcatgggagatgcaactgaacccggtcagctacccctttttcagttctaattttgaaaaatactcccttctggagagcgtgtcggaaactacccctatcattggaaagttctctgaggtgtgtgtcttgtccaacctctcaggtgctcagaaaacatgcgccaaggaggcaagtctgatcaaaaagcagtgtccagacgatatcagggcttatttttacattaatagcttaggcaagctggccatcgttacttgccccgaaaacaatgtgctatcccaagactgtaacttctgcgtacctaaagcgaagggggagcggtatatatacaaaccaattcaggatggattttgccagaatggcggtgtgtctaccgtccccagcgtgcgatattcaaaggacatctgtagtatcgggccgctcaaagttaagaactgccacaagggaacatcccgctacgaaagaaccgccttcattagcacgggcgataaaaaggtgtatctggaggaagtcaaaatcaggtctcggcaggagtacgagcctgaccaatttctttgttacaaggtgaaagatggctcaagtagccccttggtatatgaaaaggttcaggtgtccaaatgcaaggggattgagactaattctccaaagaaatgtacaggagacgaatacttctgctcgaagtatccttgtgagagcacctcccccgaagcaaactgctacctgcgcaaacactcagctataatcgaggtcaacattggtggcatgtgggtgaagccaaaatgtgtcgggtatgagatggccctcgtgaagagagttggactgaggagtgaagacgtgtctcttaaggagtgcgctacttgtctgtgggaatgcagctcctcatacatcagcatcacaacccatggccccaaaatttcttatgccacggcatgctcccacggtagttgtaagagcgtagtccagtctccttccacctcaataaaaatcagttacccagggaatagcgagattgtgggcggagatatcggcattcatttgacagaagactcgtccccggttaacctccacctgaagatccactgtccccctaaagattcttgcgaggtgagcgactgcatattatgtgtccatgggctgctaaattaccagtgccactcagtggccagtgctctcctgctttccactatcattgcgtctttgatcgcactggtagtgtatatgctcagcaagacccgtttcgttatgcggaagattgtcccaatcatgtttatacccttctgttggtgctttgtgctgttagcctggctgacacgatcctggaaaggaaaggtgagaaacgctattcaatcagccaataacactatcggttggaccgagagggaggaacgcgtcattgcagaacggcctggcgggagaaatacaatcaggtacagcttctatggagttgtgatacttgccatcttggagagtgcttttggctgttctgagtccctcattgccgaaagcaaaatcatgcagtgcaacattgcaaatggtaagacctcgtgtcgcgcgtcagggactatcataatgaaactgggcccaattggatctgaggcttgcctaatcctgaagggcctccgagatagtgacaagcagtacatctccgtgaaaacggaaagctctgagctgatttgccgggaaggggagagcttctggacatccctttatacccccgtatgtttgtcaagtcgtagatgccatctgatgggagagtgtactggtgatttatgcctcaagtggaaaagcaacaagacctctctggaatttgccggcaaaacacactccgaggtcatgaatgaaaacaggtgtttcgagcagtcagggggacttggctacggttgctttaatatcaacccgagttgtctgtatacccatgcatacctcaagagcgtgtaccgcaatgggttccgggtttttaaatgcgcctcctggactcacagagtgaggttgacaattacgacccactctcgaactttccctatgacactggctgccatgtcgacccaaccaacagactggggcagcataggactaatcctggattcagaaggcatttccgggactaacagtttttctttcatgaagcatggactcggcagcttcgcaatcattgacgagccctattccatggagcctcgcaagggttttatcggggaagtccggtgtcccaccgaggaagctgccataaaagcgtcaacgctgtgcaagaccgccccacagcttatcgagtaccagcctgaaatggattctgtggagtgtacaactaacatgattgaccccatgagcatcttcaatagaggaagtttgccacaggttagggagggcatgacctttacacaatccatggagaaaaacactgtgcaggctatgaccacgggtgaagtacacgcaagcattcgtctggtcttagatgactatgaagtggagtacctctctaatcaggtggactgcgatgccacattcaagaacctgaccggctgctattcatgtgacgagggggctcgcgtctgcatgcaaatcaaagcccatggagatactatatttcacttcaaaaattccgacatgagtatgaacattcttcagaaggttagcacaaataccctgatctactgttcggtggtacacttttctaaaccggtgatcaaggaagagggcgtctatgattgcggggcaggagaaaaacctatgattctaaagggcactctcgtggcggttagcccccataacgaccggctggagcagggtgggtcctcaatagtgatcaatccaaaaggaagtggcgtcgatttcttgggttggctgtctggcttttccagctggttcgggggacccttaaaggccattctcaccgtgatcggctttctgcttctggggttcttgctctttatgctggttacaattggactaagatacgctctgtcacaggtggtcacgaagaaaatgaagtga

SEQ ID NO: 11405 - RNA, 4002 nt, synthetic construct
  misc_feature 1..4002: note = derived and/or modified CDS sequence (opt3) from Arrabida virus(PoSFPhlebV/126/2008)__KP863800.1__GP
  source 1..4002: mol_type = other RNA
atgttctacgccaagtttatcctgctcctttgcttcgtgcagggcgctctgttgaaatataccattataagcaaggtcgggtcctctacatacaaaagagtttgtttatcacacactacggacctggataccctactcgacatgacaagtagggagatgagcaacatcaagctgactggaggttcctgctctcttggcgatctgaccaaacccgactgttcgcctgactttttctcaaattatgtggcaaacattcaaagcagtaatacaaagatcaccgggaagtttcaggatattatcggagaacgggagatggaagtaactaacgatgtggtcccagactccttcggcccgggtccccatgattgcgtgtcttttgacaaaaagcctttctggagcgatttgctcccaacatccgtttcaaaagaggaacccaagcctataatcagtaccctgagcgtgctgccagccgcgccccctattaaagacttttctcacaaggtcgtggaggctgaggaaatggtaaaggagatcgaaggggagctcatgaaagagaaggaacgcaattccgccaaagaggaagaggcacgacagcgtatgagagaattagaggatgacctgaggaagcagtgggccgctgagcggatggcaaaacaaaacatgtcaagcgttcttgaacgcgagagacaggaaaagcagagtttggagaggcggatgcatgaagtggacaaaaagctgcgcgcctctgaggatcgagctcagaagtaccaagagagagccgaacaggcggagaaatcccacagcaagctactctcgaggtctggagcagccacgactatggctaccgtcgtgttcacatccctgcttgcctcaggcctggcagtggtcactgaattggagaaacgggacaccaatcatctcctgaaccgtccaggcaatggggtttatatggctaacgccgatagtttaattcagacagaatgtaccctgaattacggacagcgctgcctcgcgtgggagcttcaaatcacgccggtgagatatccctttttcactagcaacgtagacaagtactccctgttggagtctataacagaaacccctagcattctagagaaaaataacgaatcatgtcagctggccactacaagtggttccctcaagacctgcgcaaaggaggctagcacgatcaaaaagcactgtaccgatgacgtgagggcctttttcttcattaattctgtcggcaaactgacaatcgtgcggtgcgctgataaccacatcctttcagaggactgtaacttttgcattagtaaggcccgaaatagcaaccagaatatgttcatgccagttcaagatgcattttgccagcgccaggggtccgacactgcccccgctataagatactctaaagatatctgttcgattggagcgatcaagataaagcagtgccataaagcaaccagcaagttcgaaaggatgggctttatttccgtgggtcagaaaaagctgtatatcgaggaattgaaactccggtaccgccaagagtatgaccctgaccagttcatgtgttacaagatcaagtcaagttctccactgaaatatgaaaaggtcagctccaaaaagtgcaaagaggtggatacagggggaaaccagaagtgttcaggcgacgagcacttttgcaatagatacccctgtgatactgccaacccggaagctcattgcttaaccaggaaacacagcgccattgcagaggtaaatatcggcggggtttggattcgtcctaagtgtgtgggatatgaaatggtcctggtgaagcggtctggtctaaaatccgaggacctcagtatacgagattgccccagctgtctgtgggaatgcaagaaatctagaatcacaattaagacccacggcccaaaaatcgtctccgccactgcttgctcacatgggagttgtaagagcgtgatgcaaaagccttcgacgttcgttgagatcccctacccaggaaactccgagattataggcggtgacatcggggtgcacatgacagaaaggggctctcccagcaatattcatgtacgcacccactgccctccacgggattcatgtgacgtcagtgattgcatgttttgtgtgcatggaatccttaactaccagtgccacactttggcctccgcactgaccattgcgacaatcgtttctgctgtgctcgtcgtggtatatttcctgcttgccagaagcaaaagggcagtgaagtttataacctccctgttgatcgttccgttcaaatggctcactctgttatcaatttgggtcgtgaagaattggaaacgcaagatgagcaagctggcccgagctacaaacaatgccatcggctgggaccaggatgtggagcgggggcgtcccagagcagctgccggacaccagaaccaagtcgcgaggtacacgttttatggtgccaccattctaagtctcatgacttctggcctgtgttgcacagaatccgttatcgctgagagcaatataatgcagtgtaccacatcggactcaactaccacgtgcaaagcatctgggaccattatccttcgcttgggacctattggcagtgaatcctgtctgatcctcaagggtctgcgggatagcgagaaacagttcatatctatcagaacagtgagctccgagttaacttgcagggaaggggactcattctggaccagtctgtacacaccaatttgccttagctctcgacgctgtcatttgatgggcgagtgcactggagacaactgtctcaagtggcaggataacaaaacctcctcagaatttacgggccggacacacagtgaggtgctgcatgagaataagtgcttcgaacaaagcgggggaatcggttatggctgttttaacgtaaatccctcctgcctaatggtccactcttacctgaagcctatttataaaaacgccttcaaggtgtttagatgtgttgcttggaatcacagggtgaaactcgccatcaccactcataagaaatcgttcgacgtcacactgatggcaatgagcacccagccaactgattgggggtcaataggacttattttggactccgagggcatcaccggtacaaacagttactcttttatgaagtacggggtgggcagcttcgcgatcattgatgaacccttttccatcgagccgcgtaaaggattcctgggcgaagttcgctgccctacggaggagaccgccgtgaaggcttcaccatcttgtaaggccgcaccccagattatagaatatcaccctgagatggacactgtagaatgcatcacaaatatgatggatcccatggctatttttaaccgggggagcttaccacaagtcagagacggagtgaccttcgcccagagtatcgagaaaaattccgtgcaggcactcacaactggcgaaattaaggccagcgtcaggctggttcttgatgactacgaggtggagtataaagtatctgaaaacgattgtgactcaacctttatcaatataacgggttgctactcctgcgatgagggggctcgactgtgtgtgcggatccgcacattgggagacagtatttatcatttcaccgacagcgaagatatgatgaacgtcatgttcaaggttaattcgtctgtgactgagtactgcaccgtgctccacttttccaaacctgtcgtgaacttcgaaggcaagtatgactgtggtaagagcagaaaacccatgatcattaagggcacactgatcgcgatggccccacatgatgacagggttcactcagggggaagttctatagtggtcaatccgaaatccaagggcgtagattttctagggtggctgagcggactctcaagttggctgggcggtcctcttaaaactgtgttgaccgttctggggttcttaattctcggactggtgtttgtcatcgtggtaatcttccttgtgcgggtcggcattcgacaggcactgctaaagaagatgaaatga

SEQ ID NO: 11406 - RNA, 4005 nt, synthetic construct
  misc_feature 1..4005: note = derived and/or modified CDS sequence (opt3) from Massilia virus(127)__KT906100.1__GP
  source 1..4005: mol_type = other RNA
atgttctacgccaagtttgtgatcagcctgtgcctcgagcccggcttctcccttaaatataccattatatctaagtcagggagtggaacaatcagacagatttgtctgagccactccactgacatcgataaagtcttggaattatcttcgggtgagatgaacacgattggcatcctagggggactatgcacctttggcgaactcaagagggaggactgttcacctgatgttttcagcaattacgtggctaacatgtatggtacagcacatccaagttcctgcaaatttgtagacataactggggatcggtctatcgaagtgctgaatgacgccgtcccggatagcttcacccccggagcgcacaactgttcctcatttgagaagaagcctttctggacagaccttattccagctaaaaatagtagcggcgccatcccctctgtggtttccgtgctgccttcagtcgcagagcatgattttaacttgaaggtgaaagaagccaatgacaagctcgaggtaattcaacgcgaactggctgcagagaaagcccgaagcggccgtctggaggatgaagctagagccaagatgaaggcgctcgaggacgaattaaggaacgggtggctggcagagcgggaagccaaagagcttgctaagagtgccttggagaaagaacgcatcaataagctggaggttgaaagaaaactacacgatctcggaaagaaactgaggcagtctgaggacgacgtggaaaagatgcgggtccatcacaagaaaggtcgcaaggagtccgatgaggaaatgaaaatagcacgaaccactgctccaagcgtgtcgacaacccttgccacggtggtcttcacttctctgttggcgaccggcctcgccgcaattgagcccatcgaagacagaaacgttaatcacattctgaacaggcctgggtccggagtgtacatggcttcaccaacattaactcagaatgagtgcagtctggattatggcaaggaatgtaaagcctgggagctccaggtaagcccgcttcattacccctttttcacctccaacgtggacaagtatacatttctggagtctatcaccttgctacctccaatcctgctcattaataacgagttctgcgaactgacgactagctcaggtccccttaagcaatgtcagaaagaaagttccctgataaagaaatgctgtacagaggatgctcgggcctacttctttatcgacttggaggggaagctcagcattgtccactgctctaacaatcaggtgctgtcagaagattgcaacttctgtgttaccaaaagtggaggcgtgagccataagatctttatgcctatacaggacgcattctgccaaaagggcgggtccgagtctattccagtcgtgcgttactcgaaagatatctgtagcatcggattatccaaggtaaaatcatgccacaagagtacttctcgctatgaaagaatgggttttattgttgccggcaaaaagaagctgtacatcgaggacctaaaaatgaggtatcggcaggaatacgatgaggaccagttcttttgttataaggtgaataaaacaagccccctcgagtacgggaaggaatccccgtcaaaatgcaagggagtcggcagcaacgagcagaaatgtaatggtgacgaatatttctgcaaccgatacccttgtgagaccaattctcccgaagctcactgctccctgcgcagacatgcggcagtggtcgaggtgtacgttgggggcgcctggattaagccaaagtgtgtgggatatgagaaagtacttgtcaagaggggcgggttgaaaacggaagatctgagtgtgcgggagtgcaccagctgcctctgggaatgtgagaagaacaaaatagttatcaagacacacggacctaagattgtgtctgctactgcctgcggtggccgctcctggaaatcagtcatgcaaaagcccagtacctttctggaccttccataccccgggaatagcgaaatcatcggaggcgatagaggtaaccatctgtcggagagggggtccccttataatattcactctacaatacatagcccaccggaggactcacgtgatgcaagtgactgtatctactgccggcacggcttgctcaactatcagtcccactctgtggaaagcgccattctgttatccactgtagtggctaccatcctggccctaacaggagttgtcctctcacgaagcaaaagtgcagtgagattcctggcgtctgctgtggccgtcccctttaggtgggtttcccttttggtggtgtgggtaatgaagaaatggaaggcacgcgtcgccaccgctattcgggccactaataacgcaatcggctgggataatgggctggagcaggctagagtggaaaacgccgcgaggcgccaacagacggccggacgatggcggagcctcgacgcttcgacaatactgtcagttttatctaccggtctgtgttgcactgagagtcttatcgcagagtccagcattatgcagtgtaccacaggcgaagggtctaccacttgcaaggccacaggaacggtggtcttgaaactcggccctatcggtagcgagtcctgtctgattctaaaggggctgcgtgataacgaaagacagttcatctcaataaaaaccattagtagcgagctcacttgcagggaaggcgagtctttttggacaccactgtacacccccgtgtgtctttcctcacgccggtgccatttgatgggagagtgcacaggcgacatgtgtctgaagtggaaaagtaataagactagctccgagttcaccgggaagacgcactctgaagttatccatgaaaacaaatgcttcgagcaatcgggaggcattggttatatgtgttttaatgtgaaccctagctgcttaatggtacactcatacctcaagccaatctacaaaaatgctttcaaggtctttagatgtatagcctggaaccacagggtgcgactggggatcaccacacataaacgcaagttcgaagtgactcttatggcaatgtccacccagcaggcggattggggaagtattggcctgatcttggactctgagggtattagcggcacaaattcctattcatttatgaaacacgggctcggatcttacgccatcatagatgagccctatagcgtcgaaccgcggaagggctacctgggggaggttagatgccctactgaagagaccgctattaaggccagtccatcctgtaaagtggcacccggactggtagaatatcagcctgagatggacacgctggagtgcacaaccaacatgatggaccccatggctatcttcaataggggcagcctcccacaagtgcgtggtgggtggactttttctcagtcaatcgaaaagaactcccgccaggccctgaatacaggagcaattaacgccagtgtccggcatgtgcttgatgagtacgagttcgactataaagttaagaccaatgattgtgacagcacttttgtgaacatcaccggctgctactcgtgtgatgaaggtgctagattgtgcgtcaaagtgaggacatcttccgaggcgatttaccacttcacggacagcggctataatataaacgttctgtttaaggtggaatcaggggtccatgatcactgcaccatcttacacttcagtaagcctgtaatttctatcgagggaaaatacgactgtggcaagaacaaaaagcccatgctcattaaagggactctgatcgccatggcaccacatgatgaccgagtggtttccggaggcagctcaacagtggtcaatccgaagggtcagggggtggattttcttggatggctgagtcggctaagctcctggttcggcggtggccctctcaagaccttcctgatggtaacagggtttttgatgactggagtgataggcgggatcgtcaccattatcctgattcgcatcgttttacaacaggctctcgccaaaaaggtgaaatga

SEQ ID NO: 11407 - RNA, 4005 nt, synthetic construct
  misc_feature 1..4005: note = derived and/or modified CDS sequence (opt3) from Massilia virus(130)__KT906101.1__GP
  source 1..4005: mol_type = other RNA
atgttctacgccaagtttgtgatcagcctgtgcctcgagcccggcttctcccttaaatataccattatatctaagtcagggagtggaacaatcagacagatttgtctgagccactccactgacatcgataaagtcttggaattatctaggggtgagatggacacgatttcgatcctgggcgggctatgcacctttggagaactcaagcgggaggattgttcacctgacgttttcagcaactacgtggctaatatgtatggcacaactcatccaagttcctgcaaatttgtagatataatcggtgaccgctctattgaagtgctgaacgatgcagtcccggacagcttcacccccggggcccacaattgttcctcatttgagaagaagcctttctggacagatcttatcccagcgaaaaacagtagcggagctattccctctgtggtttccgtgctgccttcagtcgccgagcatgactttaatttgaaggtgaaagaagcaaacgagaagctcgaagtaatccaacgagagctggccgctgagaaagcacgtagcggcagactggaagatgaggccagggctaagatgaaggccctcgaagacgagttacggaatggctggctggcggaacgcgaggcaaaagagcttgccaagagtgctttggaaaaagagagaataaacaagctggaagttgagaggaaactacacgatctcgggaagaaactgcggcagtctgaagacgacgtggagaagatgcgcgtccatcacaagaaacgaagaaaggagtccgatgaagagatgaaaattgccaagaccactgcaccaagcgtgtcgacaacccttgctacggtggtcttcacttctctgttggccaccggactcgcggccatcgaacccattgaggacaggaatgttaaccacatcctgaatcggcctggttccggcgtgtacatggcatcaccaacattaactcagaacgaatgcagtctggattatgggaaagagtgtaaggcttgggagctccaggtaagcccgcttcattacccctttttcacctccaatgtggacaagtattctatcctggaaagcattacacaatcaagtcctatattgctgaaaaacaataactcctgcgagctaaccacgagcccaggaactcagaagcagtgtcagaaagaatcttcaacaatcaagaaatactgcaccgatgacgcccgtgcttactttttcattgatctcgagggcaagctgagtatcgtccactgtactaacaattatatacttagcgaggactgcaacttctgcgtgtccaagctgggtgaagttgggcataaaatttttatgcccatccaagatgccttctgtcagaagggaggctctgagtcgatccctattgtgcgctacagcaaagacatctgctccattggcttgtttaagatcaaaaattgtcacaagtcaacaagtagatatgaaaggatggggttcatagtcgcaggaaagaaaaagctctacattgaggaactgaaaatgcggtatcgacaggagtacgatgaggaccagtttttctgctataaggtgaaaaagacctctccattagaatacgccaaagtaagcccctccaagtgtaagggtgttggctcaaacgagcaaaaatgcaatggggacgaatacttttgtaaccgctatccgtgcgagacgaatagccctgaagctcactgttctctgagaaggcatgcggcagtggtcgaggtgtacgtcggaggcgcctggatcaagcccaaatgcgtgggttatgagaaggttctagtgaaacggggcgggctcaagaccgaagatctgtccgtacgcgagtgtacaagttgcctttgggaatgcgagaagaacaaaatcgtcattaagactcacggaccaaaaatagtgagcgctaccgcctgtggccatgggtcttgcaagtccgttatgcagaaaccttcaacattcttggacctgccctacccaggaaatagtgaaatcattggtggcgatagagggaaccacctcagcgagaggggatcgccctataatatccattccactattcactgtcctccagaggactctcgtgatgcaagcgactgcatctactgtcggcacggcctgcttaactatcagtcacatagtgtggcctccgctatactgttgtctaccgtcgtggccacaatcctcgcactgaccggtgtagtgttaagccgatccaagtcagcggttagatttctggctagcgccgtcgcagtgccgttcaggtgggtgagtctactcgtcgtttgggtgatgaagaaatggaaggcccgcgtgactacggctattcgggccacaaataacgcaatcgggtgggataatggcctggaacaagtaagagtcgagaacgctgccaggcgccagcagcccgcggtgcgatggcggtctcttgacgcctccaccattttgagcatcctgggaactggcctctgctgtaccgaatcgctgatagctgagtcatctattatgcagtgcacaaccgaggaagggagtactacatgtaaagcaacgggaaccgttgtgttaaagctgggtcctatcggctccgagagctgccttattttgaaagggctccgtgataacgaaaagcaatttatctctataaagactatcagctccgagctgacatgtagagaaggagagtcattctggaccagtctatacacaccagtctgcctgagctctaggcgctgccacctcatgggcgagtgtactggtgacatttgcctgaaatggaagtccaataaaacctcaagtgaatttacggggaagacccatagcgaggtgatccacgaaaacaaatgtttcgagcagtccggcggaattggctacatgtgcttcaatgttaacccctcttgtcttatggtgcactcgtatttgaagcctatctacaaaaatgcctttaaggtattccggtgcatagcttggaaccatagagtcaggctggggattacaactcacaagcgaaaatttgaaatcaccttaatggccatgagcacacagcagactgattggggatcaatcggcctcattctggactccgagggtgtggcagggaccaatgcgtatagtttcatgaagcatggacttggctcttttgccatcattgatgagccatacagcgtggaaccccgcaaaggttatctgggcgaggtcaaggggccgcgggaagagacggctataaaagcctccccttcatgtcaagttgcaccaggattggtggaataccagcccgtaatggacacagtggagtgcaccactaacatgatggaccctctcgctatcttcaatagaggctctctgccccaggtccgtgggggatggacatttagccagagtattgagaagaactccctacaagccctgaataccggcgcaatccacgccagcgtgaggcatgttctcgatgaatatgagttcgaatacaaggtgaaatctaacgactgtgattcaacttttgtcaatattaccggttgctactcctgtgacgagggggctcgcctgtgcgtgaaggttcggacaagtagcgaggcgatctatcacttcacggattcgggatacaacataaatgtgctttttaaagtcgactctggcgtacacgatcattgcaccatcttgcacttctccaagccagtgattagcatcgaaggtaaatatgactgtggcaagaacaagaaacctatgctgattaaggggactttaatcgccatggcaccccatgatgacagagttgtgtcaggaggcagttctacagtcgtgaacccaaaagggcagggagtagattttctcggctggctgtccggtcttagctcatggttcgggggaggcccgctgaagaccttcctaatggtgacaggttttctcatgactggcgtcataagtgggattgttaccatcatcctgattaggatagtgttgcagcaggctctggccaaaaaggtgaagtga

SEQ ID NO: 11408 - RNA, 3999 nt, synthetic construct
  misc_feature 1..3999: note = derived and/or modified CDS sequence (opt3) from Massilia virus(W)__EU725772.1__GP
  source 1..3999: mol_type = other RNA
atgttctacgccaagtttgtgatcattctgtgcctcgtccagggcttcagccttaaatataccataatctccaagtctgggtcaggaacaattagacaaatctgtctgagtcacagcactgacattgataaagttttggagttatcctctggtgaaatggacacgatcaacatacagggcgggctgtgcacctttggagagctaaagagggaagattgttcgcccgacgtgttctcaaattacatcgctaacatgtatggcacaactcatcctagcagttgccggtttctcgatattatcggtgaccgctccattgaggtaatgaatgatgcatctccagacagcttcaccccgggggcccacaactgttcctcatttgaaaaagcgcccttctggagtgatctgatccctgctaagaatggaagcggcccatctccctccgtggtctcagtgcttcctagcgccacagagagtgacttttctctgaaggttaaaaaggcaaacgagcgattggaagtgatacagcgtgagctcgccgctgaaaaagcaagatccggcaggctggaggatgaggcccggaccaagatgcgcgctctggaagacgagctcagaaatgggtggttagccgaaagggaggcgaaagaactggcaaagagcgatcttgagaaggagcgggtcaacaaattggaagtggagcgcaagctgcatgacctaaataaaaagctccgacagtcggaagacgaggccgaaagactgagggagtaccacaacaaacggcgtaaggagtctgatgaaaagatgaagatgactaagacagtagctccaaatgtttccaccacgcttgccactgtggtcctgacctcattgctcgcaacaggactggctgccattgagcccatcgaagaccgcaacactaatcatattttaaacagacctggtaccggcgtgtatatggcgagtccaacactgaccgagaatgattgcagcctcgactacgggaaagaatgtaaggcctgggagcttcaagtgtccccgctgcactatcccttctttacgtctaacgtcgataaatacagcttgctagagtcaatcactcaggcaagtcctatcctgattaagaacaataactcctgcgaactcacaaccagcccaggatctcagaaacagtgtcaaaaggagtcaagtactataaagaaatactgcacagacgatgctagggcctatttctttgttgacctggaaggcaatcttagcatcgtgcactgttccaacaataacattctgtctgaggattgcaatttctgcatctcgaaaagcggtgtaaccgggcagaaaatattcatgcccattcaggacgctttttgtcagcggggaggctccgagtcattgcctgtgatccgatacagtaaggatatctgctctattggcctcttcaaaatcaagagctgtcataagtccacgtcacgctatgaaagaatggggtttattgtcgtgggaaggaaaaagctgtacttagaggaactgaaaatgcggtatcgccaagagtacgacgaagaccagttctattgctacaaggccaaaaccacaagccagctacaataccagaaggtttctccatccaagtgtaaaggtgtgggcagtaaggatcagaaatgcaacggggacgagtatttttgtaatagattcccctgcgagactaacaatccggatgcacactgtagcctcaggcgtcatgccgctgtcgtggaagtaaacgttggaggcgcgtgggtgaagcctaaatgcgtcggttacgagaaggtgctggtcaaacgagggggccttaagaccgaagacttgtctgtgcgggagtgtacatcctgcctgtgggaatgcgagaagaataaaatagttatcaagactcacggacccaaaattgtgtcagcaaccgcctgtagtcacggcagctgcaagtcggtaatgcagaaaccatccacatttctcgatctgccttatcccgggaactctgagatcatcggaggtgacattggcatacatatgagcgaaagagggtcaccaagtaatatccacattaccatccattgtccccctaaggattcctgcgacgtctctgattgtattttctgcaggcacggaatccttaactaccaatgtcatagcgtggcttccgccatactgttgtcaactgttgtggcaacgatcctcgccctgacaggcgtcattatcagccgcagtaagtttgctgtgcggttcttagcctctgcagtagcgattccatttagatgggtgtccctgctagttgtctgggtgatgaaaaagtggaaaagcaggatcgctaccgccatacgcgcaactaacaatgccattggttgggacaacgggctcgaacaggtgcgagtcgaaaatgctgcccggcgtccgcagcccgcagttagatatgctttctacgccaccacaatcctgtcgattcttggctcaggattgtgctgtaccgagtctctgatcgcggaaagttccataatgcagtgcactacagaggatagctctacgacctgtaaggccactggcacagtggtgctcaaactggggcctatcggaagcgagtcctgcttaattctgaagggtcttagggacaacgaaaagcaatttatctcaattaaaaccatcagtagcgagttgacatgccgcgaaggcgagtctttctggacttccctctataccccagtatgtctgtcaagtcggagatgccacctaatgggggagtgtacgggagatatatgcctgaagtggaaaagcaataagacctcctctgagttcacaggcaaagctcactcggaggtcattcatgaaaacaagtgttttgagcagagcggtgggatcggctacggatgcttcaatgtgaacccctcatgtctcatggttcactcctacctgaagcctatctataaaaatgcatttagggtgttccgatgcattgcctggaaccatcgcgtccggcttggcgtgactacccacaagagaaaatttgaaatcacattgatggctatgagtactcagcagaccgactgggggtctattggactgatattagacagcgagggcatcgagggtacgaatgcctactccttcatgaagcacgggctcggatcatttgcaattgttgatgaaccatattctgtggagcccaggaaaggctacctgggtgaagtacgttgtccgacagaggaaaccgcgatcaaggccagccctagttgcaaagtcgctccaggccttattgagtatcaacccgagatggacactgtggaatgtacaaccaacatgatggatcctatggccatcttcaatcgcgggtccctgccccaggtgcgggagggaaagacttttacccagagcatagaaaagaactctgtccaggcattgacaacgggcgagatccatgcttcagttagactcgtgctggacgaatacgagattgagtataaagtaacctccaatgattgcgacagtactttcgtgaacatcacagggtgctacagctgtgatgaaggagccaggctatgcgtcaaggtgaaatcgtcttccgaggcaatttaccactttaccgacagctcattcagtgttaacgtgctgtttaaggtcacaccatctgtgcatgattattgtactatcctccacttctcccgacctgttataagcattgaaggcaaatacgactgcggtaagaataagaaacccatgctgatcaaggggacccttatcgccatggctccacatgatgaccgggtgattaacggaggctcaagtacggtcgtaaatccgaaaggtcacggcgtggatttcttggggtggctgagcggattatcctcttggtttggcgggcctctcaagacattcctgatggttatgggatttcttatgataggcgtgatcattgtcatcgtgaccattatcctgatacgcatcggtctacaacaggcgctcgccaaaaagttcaagtga

SEQ ID NO: 11409 - RNA, 3996 nt, synthetic construct
  misc_feature 1..3996: note = derived and/or modified CDS sequence (opt3) from Punique virus(PI-B4-2008)__JF920134.1__GP
  source 1..3996: mol_type = other RNA
atgttctacgccaagtttgtgatcattctgtgcctcgtccagggcttcagccttaaatataccataatctccaagctggggtctggaacaactagacaagtttgtttgtcacacagtacggacttagataaagtgctggagattagcaacatggaaatggacgctatcaatctactcggtggcttttgcaccctgggggagcttaggcgggaagattgttcccccaacgtattctctaattacgtggtcaacgtgcatggaacaattcactcgtcaaattgcaagtttgttgacatcgtgggcgatcgcagcatagaggtcctgaacgacgcaactcctgatagtttcaccccaggtgcccataattgttcctcttttgaaaaaccgcccttctggacagacttggtgcctaagaagaacgataccgacccaagcccctccctcctgtcagtactgcctgcggctgccgagctcgattttaatttaaaactgaaggaggcaaacgacaaagttgaagccatccagcgagagcttgtggctgaaaaggcacgtagtgggagaattgaggatgaggccaggactaaaatgcgggaattggaggacgaactgcgcagaggatggatcgctgagagggaagccaaggagctagcgcacaagaatctcgaggaggagcgggtcagcaaactggaaattgagcgccgaatgcatgaccttgataagaaactgagacagtctgaaaacgacgcagataggttgcgggagcagtataataagaaacgtaagtccgaggaagaggtgaaaacaccaaaggcctcaaccctcaacgctacgactaccctggccacagtggtcttaactagcctgctcgcaaccggccttgctgccatcgaacaaatagaggaacgcaatacaaaccacattctgaacagacccggcaccggggtttacatggcgagtcctacgttgactcagacagagtgctctctaggatatggtaaggagtgtaaatcctgggaactccaggtgagcccactgcactacccgttctttacctcgaatgtagacaagtattctatcctggagtccattactcaggaacccacacttctgatcaaaaacaataactcatgcgagttgaccacgagtcctggcagccaaaagcagtgtcagaaagagtcctctaccatcaagaagtactgcacagatgacgccagggcatacttctttattgatctcgggggaaatctgagcatagtgcattgttcaaacaatttcgtcttaagtgaagactgcaacttctgcatctccaaaagcggcggtgtggggcagaagatttttatgccaatccaagatgctttctgtcagcggggaggctctgagtcaccccctgttgtgcgatatagtaaagacctgtgcagcataggcctatttaagattaaatcctgtcacaagtctacttcgcgctacgaaagaatggggttcatcgtcgccggacagaagaaactctatctggaggaacttaagatgaggtaccggcaagagtatgatgaggaccagtttttctgctacaaagtaaagagcaattccccattgcagtatgaaaaagtgtcacccagtaagtgtaagggtgttggctctcaggaccaaaaatgcaacggggatgagtacttttgtaatcgctacccgtgcgacaccaacaatcctgatgctcattgtagcctgagaaggcacgccgcagtggtcgaagtgaacgtcggaggcgtgtggatcaagcccaaatgcgttggttatgagaaggtgctcgtaaaacgtgggggcctgaagacagaagacctttccgtccgggagtgtacttcatgcctgtgggagtgcgaacgaaataaagtggttgtgaagacccacggaccaaagattgtcagcgccacagcttgttctcatggctcctgcaaaagtgtgatgcagaagcctagcaccttcttggagatcccctacccagggaactctgaaattataggaggtgatatcggcattcacatgtccgagagagggtcacccagtaacatccatgtagtggttcactgtaaacctaaggacagctgcgatatctcggactgtattttctgcaaacatggaatactcaattatcagtgtcactccgtcgcgtctgcagtgctgttaagcactatgatcgccgcttgcctggccctagtgggcgtcattgtttcaaggagtaagcacgcagtgaagttcctcgcctccgtggtagctatcccatttaaatgggtctctctgcttacggtgtgggttgtgaagaactggaaattgcgcattacacgggtcatcagagccaccaatgatgcaataggttgggaaaacaatctggaacaggtgagggttgagaacgcggctcgccgaccgcaacccgccgtgcggtacgcattctatgggactaccatcctcagcattctgtccacaggcttatgttgctcagaaagcctgatcgccgagagttctattatgcagtgtaccactgaagactccagcacagtatgcaaggctacgggaaccgtcgtgcttaaattgggccctatcgggtcggagtcatgcctcatactgaagggactacgtgataatgagaagcagtttatttctatcaaaactattagttccgaactgacatgtagagagggtgagagcttctggacctctctctacacaccagtgtgcctgagctccaggcgctgtcatcttatgggcgaatgcactggggacatctgtttgaagtggaaaaccaacaagacgtcagccgaatttaccggaaaaacacacagtgaggtcatacatgagaataagtgctttgaacagagcggcggtatggggtatggctgtttcaacgttaatccctcttgcctgatggtgcactcctacttaaagcctatctacaaaaacgcatttaaggtattccggtgtgtggcttggaatcacagagtcaggctcggaattactacccataaacgaaactttgagatcacactgatggccatgtcaactcaacagaccgattggggcagtattgggcttatcctggacagcgaaggaataacgggcacaaattcctattctttcatgaagcacggtttggggtcgtttgcgattatcgacgagccatacgtgaccgaaccccgcaaaggatatctcggcgaggttcggtgcccgactgaggaaacagccgtgaaggctagcccttcatgtaaagtcgcaccaggtctgatcgagtaccagcccgaaatggatgtggttgagtgcaccactaacatgatggaccctatggccattttcaacagaggctccctaccccaggtgagggatgggaagacctttacacaaagtatcgaaaagtctagcgtccaggctctgacgaccggagagattcatgcctccgtacgtctcgtgctggacgagtatgaagttgagtacaaagtggtcaataacgattgcgactcaactttcgtgaatataacaggctgttattcttgcgatgaaggggcacgcctttgtgtaaaggtgaaagcgagcagtgacgtcatctaccactttaccgattccgacaacagcatgaatgttttgttcaaggtgtcttcaaacattcaggattactgcatcgtgctgcatttttccaaaccagtcgtgaatgttgagggaaagtatgactgtggccggagtaagaaacctatgttaattaagggtacactcatcgccatggctccccacgatgacagagtaactaacgggggaagctcgataatcattaatccaaaaggcggtggcgtggacttcctggggtggctttctggactgtccagctggttcggcgggccgctaaagacctttctcatcattgccggattcctgatcgtcggcataattatcgtgatcattataatcattttggcaaggctgggtatccaacaggctttagccaaaaagctcaagtga

SEQ ID NO: 11410 - RNA, 4020 nt, synthetic construct
  misc_feature 1..4020: note = derived and/or modified CDS sequence (opt3) from TOSV(9028)__KU904264.1__GP
  source 1..4020: mol_type = other RNA
atgttcatcgccaagctgctccttattagctgcctggtgcagcaggcttacttgaaatataccataatctccgagattggcaacgggacaagaacttctttttgttactcaagtaggacgagcttaggatccctgctagaagcatgggacaatgtcaccgagtctatcggtctcacatcgggcacttgcaaggttgggtcactggaaaaccgggattgtcgcaaagacattatgagcaattatgtggccgaggtacacagtgatcttcatggactgggcgcgatgatgcacaactacggtgacgataagcgagtggaaatcttgaatgacgtcatacccgatgagctcaaccctgggcatcacaattgctccgacctggatcgtaaaccattctggaccgagtttatcaacgtggctaagccgctgtctgaaattgttcccatgagcgtgatccctccacccgtcgtgaagctccaacctccagccgagccctcctcaaagaagcatgtacctttcgacgttttactgagtgaagcagagaaagagcttaatcagacaaagattagattggaagatgagaggaaaagcaacgccgaagagaccgctaaggaacgggcacgcatgaaggagatcgaggacgaactgagaagggagtgggaactagagcggaaacgcaaggatgccatggctgacgacctcgccaaagaaactgcgcgaagaagggagatagagcggaaggcacacgaactggataaaatgcttaagaaaaaggagcgtgaatctctgattgccaaggagaaagctgacgaagatatgcgctcccacgtgcataagccaaatacaaccagagccccggcacccacgatcattactaccttgctcatggcttcagccgcgctggccggacctttagagaacagggagacaaatcatctgctcaaccggccaggcaatggcgcatatactcttagcgactttgctgaaagtacctgtacactggcctacgggtctgagtgcaaatcctgggaacacttgctaaacgaggagctgttcccctttttccacagcaacctcgataagtattcgatgctggaagctgccaccgagacggtccctatccttaataaatcttccgcagtgtgtactatctcaccaagtacacacagctccaacgcctgcggacgagaggcttctgtgattcgcaagaagtgttacagcaatatgtcagcgtttttctacataaacctggcaggtcagatcaccgtcattaaatgcgaaactaatcatgttttgagttccgactgtggcaactgcatcagcaagtctctctcagggcaaaaagtgtatacacccgtacaggatgtgttttgccagaagggatggacccagagtataccgagcacgagatactccaaagacatttgttctatcggcctgcacaccgtcaaggaatgcaagatcggtacaacttcgttcgagagggtggggtttattgttgtgaaaggacggaagatgtatatcgagcaaatgaaaatgcgcagcagacaggaatactccgaggatcagttcttatgttataagtcagaaagtggctctggcagctccgtcaaactgaagaagttcaaagtggagtcatgcaagggggtaaccacaagctctgcctccaaatgtagtggagacgaatacttttgcagcaggtatccttgtgagactgctaatgttgaggcccattgcattctacgtcggcactctgcaatagtggaagtcaacgtgaatggtgtctgggtggttccccgatgtatcggctacgaggaagtgctcgtaaagagaacctccctgaaagtcgaggatacaaccgggagggaatgcgactcatgtctttgggagtgcggaaagaacaaattgattgtgaagactcatggcccaaaggttgtgtacgccacggcttgcagtcacggtagctgtaaatcggtcatgcagaagcctgccacattcgtgtatctgccctacccaggcaattccgagatcgtagggggagacatcggcattcacatgaccgaagagtctagcccctcaaacatacatctcgtggcacactgccctgcgcgcgatagttgtgacgtttccgattgcctgttttgtgtccatgggcttctgaattatcaatgccacactttgttctctgctctcctgatcagcaccacagtgatgtccattttaaccctgctactcctgcttgtgaaaggagccaaggacttggtcaaaaagctgtttcactggctcatcactccactgtgttggttatcagttttctgctgttgggtggtgaaaagctggaaacggagagtaggtagtgcaatttctaggacaaacgatacgatcggctggcgcgaaaatcgacggcatgcccaggacatagagcgtgctcagtacaccgggggagccccgggcgcaaagtattccttttacggtgtcatgatcctggggcttttgagctcggctcaatcatgctctgagagtgtgattgccgattccaaaatcatgcagtgtactacaagcggctctagcaccctctgcaaggcgtccggaacagttattatgagactgggccccatcgggtcagaaagttgcctaatactgaaaggactcaaggacagcgagaagcagttcatttctatcaaaactatttcctcagaactgacctgtagggagggtgaaagtttttggacgaccctttatacacctatctgcttgagctcccgccggtgtcacctgatgggcgagtgcgtgtctgatagatgtttaaagtggaaaactaaccagacctcggccgagctcacagggaaggctcatggagacgtcatgcacgaaaacaggtgcttcgagcaaagcggcggtatagggtacggctgttttaatgtgaacccatcatgcctgtacgttcattcctatcttaaaagtgtgtaccgaaatggattcaaggtatttcgctgtgtcgcatggaaccaccggatcagactggaagtgactacccactctaggaagttccccatggtgttgatggccatgagcacgcagcctacagattggggctccattgggctcatcctggactcagagggaattaccggcactaattcttatagcttcatgaaacatggtagtgggtcctttgctatcatagatgacccatacagccccgaaccgcgtaagggattcctaggcgaggtccgctgccctacagaggaaaccgccatgcgggcatctccatcatgtaaaatggcgcccaacctgattgagtatcagcctgaaatggacactgccgagtgcaccacaaatatgatcgatcccatggctatctttaacagaggttccctcccacaggttagggacggcatgacgttcacccaaagtattgaaaagaatactgtgcaggccctgacaaccggggaggtaaaagcaagcatccgacttattttggatgactacgatgtggtctatcagaactcgcagtctgactgctccgctacatttaagaatctgactggatgttacagctgcgatgagggctcacggttatgttaccaagtgaaagccgaaggggagaccatattccactttatcaacgaagaggagagtattaatgttatcaacaaggtgtctcctggagtctccgactattgcacggtgctccatttcagccgccccgttatttcaatcgaaggcacatacgattgtggtctgagtaagagaccaatggtgataaaagggacccttatcgcaactgccccgcacgacgataggaagcatgagggaggcagctccctggtcgtaaatcctaaaggtggctctgtggactttttcgggtggctaagcggactcacctcctggctgggcgggcccttgaagacatttctgactattttaggattcctcgctgttggcctgcttctggtggtcatcattatcataattatccggaccggtatgcagcaggcgttgaaaaagaagatcaaatga

SEQ ID NO: 11411 - RNA, 4020 nt, synthetic construct
  misc_feature 1..4020: note = derived and/or modified CDS sequence (opt3) from TOSV(A189)__KP694241.1__GP
  source 1..4020: mol_type = other RNA
atgttcatcgccaagctgctccttattagctgcctggtgcagcaggcttacttgaaatataccataatctccgagattggcaacgggacaagaacttcttcatgttacagtagcaggacgtccttaggatctctgctagaagcatgggataatatcaccgagtcgattggtctcacatcaggcacttgcaaggtcgggagcctggaaaaccgggattgtaaacgcgacatcatgagtaattatgttgccgaggtgcactccaaccttcatggactgggcgcgatgatgcacaattacggtgatgacaagcgagtagaagtgttgaacgatgtcatacccgacgagctcaatcctgggcgtcataactgctctgatctggacagaaaaccattttggaccgagttcatcaatgtggctaggccgacaaacaagatggcccccatgagcgttattcctccacccatcgtgaagcctattccagtcgcagaacccaccatcgagaaaactataccttttgataagctgctctccgaagccgagaaagagttaaatcaaacaaagattcggctggaagctgagcgcagatcaaacgcagaagaggccgctaaagaaagggcccggatgcgcgagatcgaggacaaacttcgaaaggattgggaattggagagagaaaggaaggacgcggtggcagatgacctggccaaggagattgctcggcgtcgcgaaatcgagagaaaagcccacgagctagacaagatgctcaaaaagaaagaaagggaggatctggtagcacgggaacgagttagtgaggacatgcgcaatcatgtgagaaggccaaacaccacgatcgctccggcccccactattataaccacacttctgatggcgagcgccgtcatggcaggacctttggaaaatcgggagactaaccacctcctgaaccgcccaggcaatggcgcttataccttatctgatttcgccgagtccacatgtaccctggcttacgggtcagaatgcaagagctgggagcaccagctcgacgaacttagttttcccttctttcattctaacctggataagtattccatgttggaggccgcaacggagactgtgcctatcctaaataaaagctcggccgtgtgtacaatttaccacccaagaatccataggatggcttgcggacgtgaagcgtctctgataaagaaaaagtgtggttccaacatgtcagcattcttttacgtcaatctcgccggccagattaccgttgtgaaatgcgacactaaccacgtactgagtaatgattgtgggaactgcatcagcaagacactttccggacaaaagatctatacccccgtgcaggacatgttctgccagaaaggctggacggagtctattccgaatacccggtacagcaaggatctgtgttcaatcggtttgcacacagtcaaagaatgcaagactgggaccacaaactttgagcgagtgggattcattgttgtgaaaggcagaaagatgtatatagaacagatgaagatgaggagtcgccaagagttttccgaggaccagttcctctgttacaaaagcgaatcttcaagtggcagctccgtcaagctgaaaaaggtgaaagtagagtcttgcaagggggttactacctcgagcgcttccaagtgttcaggagatgaatatttctgcagtcggtacccttgtgagacagccaatgtggaagcacattgcatcttaagaaggcactctgccgtcattgaggtgaacgtcaatggtgtgtgggttgtgccccgctgtatcggctatgaggaagtactggtccgacggaccagcctaaaagtggaggacacttcctcacgtgaatgcgacacgtgtctctgggagtgcgggaagaacaaactgatcgttaagacacatggaccaaaaattgtgtacgctaccgcctgcagccacggctcttgtaagtccgtcatgcagaaacctgcaacttttgtgtaccttccctatccaggtaatagtgaaatagtagggggcgatatcggagtgcatatgaccgaggagagctctccctccaacattcacatggttgcgcactgccctgctaaggactcatgtgaagtcagtagctgcttgttctgtgtgcatggcctgctcaactaccagtgccacacactgttttcggcccttctgatctccaccactgtgatgtctattttgacactcctgttactgctaatgagaggggcaaaggatctcgtcaaaaggctgttctattggcttatcacgccattgtgttggctgagcgtgttttgctcatggatgataaagagttggaaaaagcgcgttggatccgccatctctcggaccaatgacactattggttggagagataacaggcgatacggccaagacgtggagcgcgctcagtatacagggggagccccgggcgcaaaatacagcttctatggtgtaatgatcctcgggctgttaggcaatgtccattcctgttcagaaagcgtgctggctgatagtaagattatgcagtgcaccacatctggatccagcactctttgtaaggcctcgggcaccgttatcatgaaattggggcccataggatcagagtcttgcctcattctgaagggtctaaaagacagtgagaagcaatttatctccattaaaacgatcagctctgaactgacctgccgggagggcgagagcttctggacaactctctacacccctgtgtgtctgtcctcaagaaggtgccaccttatgggggaatgtgtcagtgatcgttgcttgaagtggaagacaaacgaaactagcgcggagtttaccggaaaagcccacggcgaggtgatgcatgaaaatcgctgtttcgagcagtctggtgggataggctacggatgctttaacgttaatccatcctgtctgtatgtgcactcatacttaaagagtgtatataaaaacggcttcaagatctttcggtgcgtcgcttggaatcatagaattaggctcgaagtgacgacacacagccgaaaattccccatggtgctgatggcaatgtccacccagcctactgactgggggtctatcggacttattctggattcggagggcatcacaggtaccaacgcctacagcttcatgaagcatgggtcaggatcctttgctataattgacgatccatatagtcccgaaccgcggaagggcttcttgggtgaggtccgctgtcctactgaggaaaccgccatcagagcatctccaagctgcaaaatggcgcccaatctcatcgagtaccagcctgaaatggacacagccgagtgtacgaccaacatgattgaccccatggctatctttaataggggctccctgccacaagttcgggatgggatgactttcacacagtcaattgaaaagaacaccgtgcaggccctaacaactggagaggtacgagcatctataagactgaccctcgacgattatgacgtggtctaccagaatagccaaagtgattgctccgctacgtttaaaaacctgacaggctgctacagctgtgacgaggggtctcgcatgtgctatcaggtgaaggccgaaggagagaccatcttccactttgttaacgaagatgagtcaattaatgtgatcaacaaagtctcccctgacgtgagtgattactgtactgttcttcacttcagcaggcccgtgatttcgatcgagggccgttatgactgcggtttgtctaagcggccaatggtcataaaagggaccctgatcgcaacagccccgcatgatgacagaaagcacgaaggaggctccagcttagtagtgaatcctaagggtggcactgttgactttttcgggtgggtgtcaggactcaccagttggctgggcgggccccttaaaacatttctgacgattctaggattcctcgctctgggcttgctgttagtcgtgatcattatcataattgcgaggaccggtgtacagcaggccctcaagaaaaagaacaaatga

SEQ ID NO: 11412 - RNA, 4020 nt, synthetic construct
  misc_feature 1..4020: note = derived and/or modified CDS sequence (opt3) from TOSV(AR)__EF656362.1__GP
  source 1..4020: mol_type = other RNA
atgttcatcgccaagctgctccttattagctgcctggtgcagcaggcttacttgaaatataccataatctccgagattggcaacgggacaagaacttctttttgttactcaagtaggacgagcttaggatccctgctagaagcatgggacaatgtcaccgagtctatcggtctcacatcgggcacttgcaaggttgggtcactggaaaaccgggattgtcgcaaagacattatgagcaattatgtggccgaggtacacagtaaccttcatggactgggcgcgatgatgcacaattacggtgatgacaagcgagtggaaatcttgaacgatgtcatacccgacgagctcaatcctgggcatcacaactgctccgatctggaccgtaaaccattctggaccgagtttatcaatgtggctaagccgtctagcgaaattgttcccatgtccgtgatccctccacccgtcgtgaagctgcaacctccagccgagccctcaagtaaaaagcatgtacctttcgatgttctcttaagcgaagcagagaaagagctgaaccagacaaagattagacttgaagacgagaggaaatctaatgccgaagagaccgctaaggaacgggcacgcatgaaggagatcgaggatgaattgagaagggagtgggaactggagcggaaacgcaaggacgccatggctgatgacctagccaaagaaactgcgcgaagaagggagatagagcggaaggcacacgaactcgaccgtatgctgaaaaagaaagagcgcgaatcccttattgccaaggagaaggctgatgaagacatgagatcacacgtgcataaaccaaacacaaccagggccccggcacccacgatcattactaccctgttgatggctagcgccgcgctcgccggacctctggagaatcgggagacaaaccacttactgaatcgaccaggcaacggcgcatatactctcagtgattttgctgaatctacctgtacacttgcctacgggtccgagtgcaagagctgggaacatctgttgaacgaggagctattcccctttttccactcgaatctggacaaatattctatgctcgaagctgccaccgagacggtccctatcctgaacaagtcctcagcagtgtgtactatcagtccaagcacacactcctctaatgcctgcggacgcgaagctagcgtgattagaaagaagtgttactcaaacatgagtgcgtttttctacataaatcttgcaggtcagatcaccgtcgttaagtgcgagactaaccatgtgctgtccagcgattgtggcaattgcatttctaaatcattgagtgggcaaaaggtatatacacccgtgcaggacgtcttttgccagaaaggatggacccagagcatcccgtccacgaggtactctaaggatatatgttcgattggcctccacaccgtgaaagaatgcaagatcggtacaactagcttcgagcgggttgggtttatcgtggtcaagggacgcaaaatgtatattgagcaaatgaagatgagatccaggcaggaatactcagaggaccagttcctgtgttataaaagtgaatctggcagcggctcctcagtgaagctgaaaaagttcaaggtagagagctgcaaaggggttaccacatcttccgccagtaagtgtagcggagatgaatacttttgcaaccgttatccttgtgagactgctaatgtggaggcccattgcatcttacggcgacactctgcaattgtcgaagtgaacgtcaatggtgtgtgggttgtgcccagatgtataggctacgaggaagtcctagtaaaaaggacctccctcaaggtggaggacacaaccgggcgcgaatgcgattcatgtctgtgggagtgcggaaaagacaaacttatcgttaaaactcatggcccaaaggtggtctacgccacggcttgcagtcacggtagctgtaagtcggtgatgcagaaacctgccacattcgtatatttgccctacccagggaactccgagattgtgggcggagacatcggcatccacatgaccgaagagtctagcccctcaaatattcatctggttgcacactgccctgcgaaggatagttgtgacgtctccgattgcctcttttgtgtgcatgggctgcttaactatcaatgccacactctgttctctgctttgctcataagcaccacagtgatgtccatcctgaccttactgctactcctggtcaaaggagccaaggaccttgttaaaaagttgttttactggctgattactccactctgttggctgtcagtgttctgctgttgggtggtaaagagctggaaacggagagtcggtagtgcaatctctaggacaaatgatacgattggctggcgcgaaaaccgacggcacgcccaggacatcgagcgtgctcagtataccgggggagccccgggcgcaaagtactccttttatggtgtgatgatattagggctgcttagctcggctcaatcatgctctgagagtgttatcgccgattccaaaattatgcagtgtactacaagcggctctagcaccttgtgcaaggcgtccggaacagtgatcatgagactcggccccattgggtcagaaagttgcctgatcctaaaaggactgaaggacagcgagaagcagttcatatctattaaaactatctcctcagaactcacctgtagggagggtgaaagtttttggacgaccctgtacacacctatttgccttagctcccgccggtgtcatttgatgggcgagtgcgtctctgatagatgtctgaagtggaaaactaaccagacctcggccgagttcacagggaaggctcacggagacgtgatgcatgaaaataggtgctttgagcaaagcggcggtatcgggtacggctgtttcaacgttaatccatcatgcttatatgtgcactcctacctcaaaagtgtatatcgaaacggatttaaggtcttccgctgtgtggcatggatacatcggatcagactggaagtgactacccactctaggaagttccccatggtccttatggccatgagcacgcagcctacagattggggctccattgggctgatcttggactcagagggaattaccggcactaattcttacagctttatgaaacacggtagtgggtccttcgctatcatagatgacccatatagccccgaaccgcgtaagggatttctcggcgaggttcgctgccctacagaggaaaccgccatgcgggcatctccatcatgtaaaatggcgcccaacctgattgagtaccagcctgaaatggacactgccgagtgcaccacaaatatgatcgatcccatggctatcttcaacagaggttccctaccacaggtgagggacggcatgacgtttacccaaagtattgaaaagaatactgtacaggccctgacaaccggggaggtgaaagcaagcatccgactcacactggatgactatgatgtcgtgtaccagaactcgcagtctgactgctccgctactttcaagaatcttaccggatgttacagctgcgatgagggctcacggttgtgttatcaagttaaagccgaaggggagacggtgtttcatttcattaacgaagaggagagtataaatgtcatcaacaaggtgtctcctggagtttccgactactgcacagtgctgcactttagccgccccgtcatttcaatcgaaggcacctatgattgtggtttaagtaagagaccaatggtaattaaagggactctcatcgcaaccgccccgcatgacgataggaagcacgagggaggcagctccctggtggttaatcctaaaggtggctctgtggacttctttgggtgggtcagcggacttacatcctggctgggcgggcccctaaagactttcctcaccatactgggatttttggctgtgggcctgttactcgtagtgatcattatcattatcatacggacaggtatgcagcaggcgctgaaaaagaagattaaatga

SEQ ID NO: 11413 - RNA, 4020 nt, synthetic construct
  misc_feature 1..4020: note = derived and/or modified CDS sequence (opt3) from TOSV(EsPhGR40)__FJ153283.1__GP
  source 1..4020: mol_type = other RNA
atgttcatcgccaagctgctccttattagctgcctggtgcagcaggcttacttgaaatataccataatctccgagattggcaacgggacaagaacttctttttgttactcaagtaggacgagcttaggatccctgctagaagcatgggataatgtcaccgagtctatcggtctcacatcgggcacttgcaaggttgggtcactggaaaaccgggattgtggaaaagacattatgagcaattatgtggccgaggtacacagtaaccttcatggcctgggtgcgatgatgcacaattacggggatgacaagcgcgtggaaatcttgaacgatgtcatacccgacgagctcaatcctggacatcacaactgctccgatctggaccgaaaaccattctggaccgagtttatcaatgtggctaagccgctgtctgaaattgcccccatgagcgttatccctccacccgtggtcaagctccagcctccagcagagccctccagtaaaaagcatgtgcctttcgatgtattactgtcagaagccgagaaagagcttaaccagacaaagattcgtttggaagacgagagaaaaagcaatgctgaagagaccgcaagggaacgggcccgcatgagagatatcgaggaggaactgaggaaggagtgggaactagagcggaagcgcaaagacgctatggccgatgacctcgcgaaggaaactgcaaaacgaagagagatagagaggaaggcccacgaactggaccggatgcttaaaaagaaagagcgtgaatctctgattgctaaggagaaggaagatgagaacatgcgctccagagttcacaaaccatcaacaaccagggccccggcacccacgatcattactaccttgctcatggctagcacagccctggcgggccctttagagaatcgggaaactaaccatctgctcaatcgaccaggcaacggggcctatacccttagtgactttgcagagtctacatgtaccctggcttacggatccgaatgcaagagctgggagcacttgctaaacgaggaactgttcccctttttccattcgaatctcgataaatattctatgctggaggccgctacggaaactgtgcctatccttaacaagtcctcagccgtctgtacaatcagtccaagcacccactcctctaatgcatgcggtcgcgaggccagcgtgattaggaaaaagtgttactcaaacatgagtgctctgttttacataaatttggcgggccagatcactgtggtcaagtgcgaaacaaaccacgttctctccagcgactgtgggaattgcatttctaaatcactgagtggacaaaaggtgtatacccccgtacaggatgtgttctgccagaaaggctggacggagagcatcccgtccaccagatactctaaggacatatgttcgattggtttacatacagtcaaagagtgcaagatcgggactaccagctttgaacgggtgggattcatcgttgtgaagggccgcaaaatgtatattgagcagatgaagatgagatccaggcaagaatactcagaggatcagtttctgtgttataaaagtgaatctggcagcgggtcctcagtcaagctcaaaaagttcaaggtggagagctgcaaaggagtaacaacttcttccgcaagtaagtgtagcggtgacgagtacttctgctctcgttatccttgtgaaaccgccaacgttgaggctcactgcatcctacggcgacattccgccattgtggaagtcaatgtgaacggcgtctgggtggttcccagatgtatagggtacgaggaagtgctggtaaaaaggacatcacttaaggtcgaggataccactgagcgcgaatgcgacagttgtttgtgggagtgcggcaaaaataagctgatcgtgaaaacgcacggaccaaaggttgtgtacgcaacagcctgcagccatggttcgtgtaagtccgtcatgcagaaacctaccacttttgtgtatctcccctacccagggaactctgaaattgtaggcggagatatcggcatccacatgaccgaggagagctcacccagtaatattcacctggtggctcattgccctgcccgggactcctgtgacgtttctgattgccttttctgtgtccacgggctgttgaactatcagtgccatacactctttagcgcactgttaatatccaccactgtgatgtcaatcctgacactactcctgcttttggtgaagggagcgaaagacctggtcaagaaactcttctactggctgattacgccattatgttggctgagcgtgttttgctgttgggttgtgaagagttggaagagaagggtaggttctgctatctcccgcaccaatgatactattggctggcgagaaaaccggcgttatgcccaagacatcgagagagcacagtacacagggggagccccgggcgctaaatatagcttctacggtgtcatgatacttgggttgctctcgtcagcccagtcttgcagtgaatccgtgatcgcagatagcaagattatgcaatgtaccacatctggcagctccactctgtgcaaggcttcaggaaccgttatcatgaggctaggccccattgggagtgagagctgcctgatcctcaaaggactgaaagactctgaaaagcagtttatatccattaagacgatctcaagtgagcttacctgtcgcgagggtgagagcttctggacaactttgtacacccctatttgcctgtcctctcggagatgtcacttaatgggcgagtgcgtgtcggataggtgtctcaaatggaagacaaacgaaactagcgccgagtttaccgggaaagcgcacggagacgtcatgcatgaaaataagtgcttcgagcagtcaggcggtatcgggtatggctgttttaacgtgaatccatcctgcctgtacgttcacagttatcttaaatctgtgtaccgaaacggattcaagatatttcgctgtgtagcctggaatcatcggatcagactggaggtcacgacacagagcaggaagttccccatggtgttgatggctatgtccacccaacctactgattggggctcaattgggctcatcctggactctgaaggaattacaggcaccaacagctatagtttcatgaaacacggttccgggagctttgcaatcatagatgacccatactctcccgagccgcgtaagggattcctaggcgaagtgcgctgccctactgaggaaaccgccatgcgggcttcaccatcctgtaaaatggcccccaatctgattgagtatcagcctgagatggatacagcagaatgcacgaccaacatgatcgaccccatggcgatctttaatagaggtagtctcccacaggtcagggacggcatgactttcacacagagcattgagaagaacaccgttcaagccctgacaactggggaagtgaaggcttcgatccgacttaccttggatgactacgatgtagtgtaccaaaattctcagtccgactgcagcgccacgtttaaaaacctgacaggatgttattcatgcgatgagggcagtcggttatgttaccaggtcaaagcagagggggaaaccgtgttccattttattaatgaggaagagtctataaacgttatcaataaggtgtcccctgacgtcagcgattattgcactgtgctccacttctcacgccccattatcagtattgaaggaacctacgactgtggcctgagcaagagaccaatggttatcaaaggtacacttatagctactgccccgcacgatgacaggaagcatgaagggggatcctctctggtggtcaaccctaaaggcggtagcgtagactttttcggctggctatccgggctcacctcatggctgggaggccccttgaagacatttctgacgatcttagggttcctcgcagtgggactgcttctggttgtgattatcattatcataattcggaccggcatgcaacaggccttgaaaaagaagatcaaatga

SEQ ID NO: 11414 - RNA, 4014 nt, synthetic construct
  misc_feature 1..4014: note = derived and/or modified CDS sequence (opt3) from TOSV(SI-121283)__JF330279.1__GP
  source 1..4014: mol_type = other RNA
atgttcatcgccaagctgctccttattagctgcctggtgcagcaggcttacttgaaatataccataatctccgagattggcaacgggacaagaacttctttttgttactcaagtaggacgagcttaggatccctgctagaagcatgggataatatcaccgagtctattggtctcacatcgggcacttgcaaggtcgggtcactggaaaaccgggagtgtaaacgcgatatcatgagcaattatgttgccgaagtgcacagtaaccttcatggactgggcgcgatgatgcacaattacggtgacgataagcgaatagaggtattgaacgacgtgatccccgatgagctcaatcctgggcgtcataactgctccgacctggatagaaaaccattctggaccgaatttattaatgtcgctaagccggccaacgagatggcacccatgtctgtgatccctccacccattgttaagcctatcccagtggccgaaagcacaaccaaaaagactatacccttcgacaaactgctctccgaggctgagaaggaattaaatcagacaaaaattaggctggagaccgaacggcgctcaaacgcagaggaagccgctaaggagagagccaggatgcgggagatcgaagataaacttcgcaaagactgggagttggaacgagagagaaaggatgcggtcgcagaagacctggccaaagagattgctaggcggcgtgagatcgaacgcaaggcccacgagctagataaaatgctcaagaaaaaggaaagagaggacctggtggcaagggaacgggtagacgaggatatgcgaaatcatgttcgcagacctaacacgactatcgctccaaccattataacaactcttctgatgggaagtgccgtgatggcgggcccgttggagaatagggaacccacccacctcctgaaccggcctggcaacggggcctatccattaagcgactttgcagagcccacatgtaccctggcttacggatctgaatgcaagtcctgggagcaccagctcgatgagctttcattccctttcttccatagcaatctggacaaatatagtatgttggaagccgctacggagactatcccaattctaaacaagtcttccgccgtctgtacaatcagcccctcgacccactcttccaatgcatgcggtcgcgaagcctcactgataaagaagaaatgtggcagtgatatgagcgcgtttttctacgtgaacctcgctgggcagattactgtggtcaagtgcgacacaaatcatgttctgtccaacgattgtggaaattgcatctctaagacccttagcggccaaaagatctacacgccggtgcaggacatgttttgccagaagggttggtcagagagtattccttccaccagatatagcaaagatctgtgttctatcgggttgcacacagtaaaggaatgcaaaattggaactaccaacttcgagagggtgggctttatagtcgtgaagggccgtaagatgtacatcgagcagatgaaaatgcggtcacgacaagaatttagtgaggaccagttcctctgttataagagcgaagggtcctctggatcgagcgttaaactgaagaaagtgaaggtcgagtcctgcaagggtgtgacaacttcaagtgcatctaaatgtagcggcgatgaatacttttgctccagatatccctgtgagaccgccaatgtagaggctcactgcattttaaggcgccattcagccgttatcgaagtgaacgtcaatggggtgtgggtcgtgccacggtgtatcggatacgaggaagttctggtgagaaggacaagcctaaaggtagaggacacctcttcccgcgaatgcgacacttgtctctgggagtgcggcaaaaacaagctgattgtcaaaacgcacggtcctaagatagtgtatgcaacagcctgcagtcatgggagctgtaaatctgttatgcagaagcccgctaccttcgtgtaccttccataccccggcaattccgagatcgtcggaggcgatattggggtgcacatgactgaagagtcaagtcctagcaacatccatatggtagcccactgcccagcaaaggactcgtgtgaagtgtcctcttgcttgttttgtgttcacggactgctcaattatcagtgccataccctgttcagcgcgcttctgatttcaacaaccgtcatgagtatcttgactctcctgttactgctagtgaaaggtgctaaggatctcgtgaaacgactgttttactggcttataacaccgttgtgttggctgtccgtcttctgcggctggatgatccggtcttggaagaaacgtgttgggagcgccatttccagaacgaacgacaccatcggatggagggataactcacgccggggccaagacattgagagagcacagtatactggtggggcccccggcgctaagtacagcttttatggagtgatgatcctcggcctgttagggaatgtgcacagttgttctgagtccataattgccgatagcaagatcatgcagtgcacaacctcgggatcatctacactgtgtaaagcaagtggtactgtaattatgaaacttggccctatcgggtccgaaagctgcttgatactcaaaggactgaaggactctgagaaacaattcatcagcattaagaccatctcctcagaactaacgtgcagggagggcgaaagtttttggaccacactgtacactccagtctgtctcagctctcgacgctgccatctgatgggtgagtgtgtgtccgatcggtgccttagatggaagaccaacgagacatcagctgagttcactgggaaagcccacggcgaagttatgcacgaaaataggtgttttgagcagagtggaggcattgggtatggatgcttcaacgtgaatcccagctgtttgtacgtccattcctacctgaagtctgtgtataaaaacggctttaagatcttccgttgcgttgcgtggaatcaccgcatacggttagaagtgaccacgcattcgagaaaattccctatggtactcatggccatgagcacacagccaaccgactggggttcaattgggctgatccttgattccgagggaatcactggcacaaacgcttacagttttatgaagcacggtctgggctctttcgcaattatcgacgatccctatagcccggagcctaggaaggggtttttgggagaagtccgatgtccaaccgaggaaactgccattcgggcttccccctcatgcaaaatggcccctaatctcatagagtaccagcccgaaatggacaccgcagagtgtacaacgaacatgatcgacccaatggcgattttcaatcgcggctctctgcctcaagtgagagatgggatgacctttactcagagcatcgagaagaacacagtgcaggccctaaccacaggagaagtcagggctagtattcggctgactctcgacgattatgacgttgtgtaccaaaattcccaattcgattgcagcgccacctttaaaaacctgacgggctgctattcttgtgacgagggttcacgaatgtgctaccaggtaaaggcagaaggggagacaatcttccattttgtgaatgaggatgaatccataaacgtcatcaacaaagtgagtcccgacgttagcgattactgtaccgtgcttcacttctcgagaccagtcatttctatcgagggacgctatgactgcggcttgtccaagaggccgatggtgattaaaggtactctgatcgctaccgcccctcacgatgaccgtaagcatgaaggcgggagctcattagttgtgaatcccaagggaggcacagtcgactttttcgggtgggtaagtggactcacttcttggctgggcggtccacttaaaacctttctgacaatactagggttcctcgcactgggattgctgttagtggttattatcatcattatagcccggacgggcgtggagcaggctctcaagaaaaagaacaaatga

SEQ ID NO: 11415 - RNA, 4014 nt, synthetic construct
  misc_feature 1..4014: note = derived and/or modified CDS sequence (opt3) from TOSV(SI-121487)__JF330280.1__GP
  source 1..4014: mol_type = other RNA
atgttcatcgccaagctgctccttattagctgcctggtgcagcaggcttacttgaaatataccataatctccgagattggcaacgggacaagaacttctttttgttactcaagtaggacgagcttaggatccctgctagaagcatgggataatatcaccgagtctattggtctcacatcgggcacttgcaaggtcgggtcactggaaaaccgggagtgtaaacgcgatatcatgagcaattatgttgccgaagtgcacagtaaccttcatggactgggcgcgatgatgcacaattacggtgacgataagcgaatagaggtattgaacgacgtgatccccgatgagctcaatcctgggcgtcataactgctccgacctggatagaaaaccattctggaccgaatttattaatgtcgctaagccggccaacgagatggcacccatgtctgtgatccctccacccattgttaagcctatcccagtggccgaaagcacaaccaaaaagactatacccttcgacaaactgctctccgaggctgagaaggaattaaatcaaacaaaaattatgctggagaccgaaaggcggtcaaacgcagaggaagccgctaaggagcgcgccagaatgagggagatcgaagataaacttcggaaagactgggagttggaacgcgagcgaaaggatgcggtcgcagaagacctggccaaagagattgctagaaggcgggagatcgaacgtaaggcccacgagctagataaaatgctcaagaaaaaggaacgcgaggacctggtggcaagagaaagggtagacgaggatatgcggaatcatgttcgacgccctaacacgactatcgctccaaccattataacaactcttctgatggccagtgcggtgatggccggaccgttggagaatagagaaatcaaccacctcctgaactggcccggcaatggcgcatataccttaagcgactttgctgagtctacatgtaccctggcctacgggtccgaatgcaagtcatgggagcaccagctcgatgagcttagcttcccatttttccatagtaacctggacaaatattctatgttggaagctgccacggagactattcctatcctaaataagtccagcgcagtctgtacaatatcgccctctacccactcctcaaacgcctgcggaagggaagctagtctgattaaaaagaaatgtggtagcgatatgtccgcgtttttctacgtgaatctcgcaggccagatcactgtggtcaagtgcgacacaaaccatgttctgtctaatgattgtgggaactgcatcagcaagaccctttcaggacaaaagatttacacgcctgtgcaggacatgttttgccagaagggctggagtgagtccatcccaagcacccggtattctaaagatctgtgttcaattggtttgcacacagtaaaggaatgcaaaatagggactaccaatttcgagcgcgtgggatttatcgtcgtgaagggcagaaagatgtacattgagcagatgaaaatgaggagtcgtcaagagttcagcgaagaccagttcctctgttataagtccgaaggatcttcggggagctccgttaaactgaagaaagtgaaggtcgagtcatgcaagggagtgacaaccagttctgccagcaaatgttccggtgatgaatacttttgctcacggtatccctgtgagactgctaacgtagaggcccactgcatcttacgaagacatagcgcagttatcgaagtgaatgtcaacggcgtgtgggtcgtgccgaggtgtattgggtacgaggaagttctggtgcgccggacatctctaaaggtagaggacacctccagtagagaatgcgacacttgtctctgggagtgcggcaaaaataagctgatagtcaaaacgcacggccctaagatcgtgtatgccacagcttgcagccatggttcttgtaaatccgttatgcagaagcccgccaccttcgtgtaccttccataccctgggaactcagagattgtcggcggagatatcggcgtgcacatgactgaagagagtagcccctcgaatattcatatggtagcacactgcccagcgaaggactcctgtgaagtgtctagctgcttgttttgtgttcacgggctgctcaactatcagtgccataccctgttctcagcccttctgatcagtacaaccgtcatgtccatattgactctcctgttactgctagtgaaaggagctaaggatctcgtgaaaaggctgttttactggcttatcacacccttgtgttggctgtctgtcttctgcggttggatgattcgcagctggaagaaacgagttggctccgcaatctcacggacgaacgacaccattgggtggcgtgataatagcagaaggggacaagacatcgagcgcgcccagtatactggcggtgctcctggggccaagtacagtttttatggcgtgatgatactcggactgttaggcaacgtgcactcttgttccgagagcattatcgcagattcgaagattatgcagtgcacaacctcagggtctagtacactgtgtaaggcttccggaactgtaatcatgaaacttggtccaataggcagcgaatcttgcttgatcctcaaagggctgaaggacagcgagaaacaattcatttccatcaagaccatttcaagtgaactaacgtgccgggagggagagagcttttggaccacactgtacactccggtctgtctctcttccagaaggtgccatctgatgggcgaatgtgtgtcagatcgatgccttcgctggaagaccaatgagacaagtgccgagttcactggtaaagcgcacggggaagttatgcacgaaaaccggtgttttgagcagagcggcggaatcggctatgggtgcttcaatgtgaacccctcctgtttgtacgtccattcttacctgaagtcggtgtataaaaatggatttaagatattcagatgcgttgcctggaaccacaggattcgtttagaagtgaccacgcatagccgcaaattccctatggtactcatggctatgtcaacacagccaaccgactggggctccatcggtctgatccttgatagtgaggggattactggaacaaatgcatactcttttatgaagcacggcagcggttccttcgccatcattgacgatccctattcacctgagccacggaagggctttctgggggaagtcagatgtcccaccgaggaaactgctataagggcctctccgagctgcaaaatggcacctaacttgatcgagtaccagccagaaatggacaccgcggagtgtacaacgaatatgattgaccccatggccatcttcaaccgaggaagtctccctcaagtgcgggatggcatgacctttactcagtccattgagaagaatacagtgcaggctctgaccacaggggaagtccgcgccagcatcagactaactctggacgattatgacgttgtgtaccagaactctcaattcgattgctcagcaacctttaaaaatctcacgggatgctattcctgtgacgagggcagtaggatgtgctaccaggtaaaggctgaaggtgagacaatattccattttgtgaacgaggatgaaagcatcaacgtcattaataaagtgtcgcccgacgtttctgattactgtaccgtgctgcacttctcccggccagtcatcagcattgaggggcgatatgactgcggactttcaaagagacctatggtgatcaaaagtactttgatagccaccgcaccccacgatgaccgcaagcatgaaggcggttcttccctggttgtgaacccaaagggcgggacagtcgactttttcggatgggtaagcggcttaacttcatggctcgggggaccgctgaaaacctttcttacaattctgggcttcctagccctcggtctgttgctggtggttatcatcattataatcgctaggacgggggtgcagcaggcgttaaagaaaaagaataaatga

SEQ ID NO: 11416 - RNA, 4014 nt, synthetic construct
  misc_feature 1..4014: note = derived and/or modified CDS sequence (opt3) from TOSV(SI-21137)__EU003173.1__GP
  source 1..4014: mol_type = other RNA
atgttcatcgccaagctgctccttattagctgcctggtgcagcaggcttacttgaaatataccataatctccgagattggcaacgggacaagaacttctttttgttactcaagtaggacgagcttaggatccctgctagaagcatgggacaatatcaccgagtctattggtctcacatcgggcacttgcaaggtcgggtcactggaaaaccgggagtgtaaacgcgatatcatgagcaattatgttgccgaagtgcacagtaaccttcatggactgggcgcgatgatgcacaattacggtgacgataagcgaatagaggtattgaacgacgtgatccccgatgagctcaatcctcgtagacataactgctccgacctggataggaaaccattctggaccgaatttattaatgtcgctaagccggccaacgagatcgcacccatgtctgtgattcctccacccatcgttaagcctataccagtggccgaaagcacaaccaaaaagactattcccttcgacaaactgctctccgaggctgagaaggaattaaatcaaacaaaaatccggctggagaccgaacgcagatcaaacgcagaggaagccgctaaggagagggcccggatgcgcgagattgaagataaacttcgaaaagactgggagttggaaagagagaggaaggatgcggtcgcagaagacctggccaaagagatcgctcggcgtcgcgagatcgaaagaaaggcccacgagctagataaaatgctcaagaaaaaggaaagggaggacctggtggcacgggaacgagtagacgaggatatgcgcaatcatgttagaaggcctaacacgactattgctccaaccataatcacaactcttctgatggccagtgcggtgatggccgggccgttggagaatcgggaaaccaaccacctcctgaaccgccccggaaatggcgcatatacattaagcgactttgctgagtctacctgtacgctggcctacggctccgaatgcaagtcatgggagcaccagctcgatgagcttagcttcccatttttccatagtaacctggacaaatattctatgttggaagctgccactgagacaattcctatcctaaataagtccagcgcagtctgtaccatatcgccctctactcactcctcaaacgcctgcgggagagaagctagtctgattaaaaagaaatgtggaagcaatatgtccgcgtttttctacgtgaacctcgcaggtcagatcacagtggtcaagtgcgataccaatcatgttctgtctaacgactgtggcaattgcatcagcaagacgctttcagggcaaaagatttacacccctgtgcaggatatgttttgccagaagggatggagtgagacaaacccatccactaggtatagcaaagacctgtgttctatcggcttgcacaccgtaaaggaatgcaaaattggtacaactaatttcgagcgtgaggggtttatagtggtcaagggacggaagatgtacatcgaacagatgaaaatgcgatcaagacaagagttcagtgaagatcagttcctctgttataagagcgagggctcctctggctcgagcgtgaaactgaagaaagttaaggtggaatcctgcaagggggtcaccacatcaagtgcctctaaatgtagcggagacgagtacttttgctccaggtatccctgtgagaccgctaacgtggaagcccactgcattttacgccggcattcagcagtaatcgaggttaatgtgaacggtgtctgggtggtcccgagatgtatcggctacgaagaggtgctggttaggcgcactagcctaaaggtggaagatacgtcttcccgagagtgcgacacatgtctctgggagtgcgggaaaaataagctgattgtaaaaacccacggacctaagatagtctatgccactgcttgcagtcatggcagctgtaaatctgtgatgcagaagcccgccaccttcgtttaccttccataccctggtaactccgaaatcgtcgggggcgacattggagtgcacatgacagaggaatcaagtcccagcaacatccatatggtggcacactgcccagcgaaggattcgtgtgaggtatcctcttgcttgttttgtgtgcacggcctgctcaattatcagtgccataccctgttcagcgcccttctgatttcaactacagttatgagtatcttgacgctcctgttactgctagtcaaaggggctaaggacctcgtgaaacggctgttttactggcttataacccccttgtgttggctgtccgtgttctgcggatggatgatccgttcttggaagaaaagagtcggtagcgcaatttccaggactaacgatacaatcggctggcgcgacaattcacggagagggcaagatattgagagggcccagtataccggaggcgctcctggtgccaagtacagcttttatggggttatgatcctcggcctgttaggaaacgtgcacagttgttctgaatccataattgcagacagcaagatcatgcagtgcacaacttcgggctcatctaccctgtgtaaagctagtgggacggtgattatgaaacttggaccaatcggttccgagagctgcttgatactcaagggcctgaaggattctgaaaaacaattcatcagcattaagaccatctcctcagagctaacatgccgagaaggggagagtttttggactaccctgtacacaccggtatgtctcagctctcgccggtgccatctgatgggagagtgtgtctccgacagatgccttaggtggaagactaatgaaacctcagccgagttcacgggcaaagcgcacggtgaagtgatgcacgagaaccgttgttttgaacagagtgggggcattggatatggctgcttcaatgttaaccccagctgtttgtacgtgcattcctacctgaagtctgtctataaaaatgggtttaagatcttccgctgcgtggcctggaaccaccggataagattagaggttacaacccattcgaggaaattccctatggtgctcatggctatgagcactcagccaacagattggggatcaattggcctgatccttgactccggtgggatcaccggaactaatgcatacagttttatgaagcacggcctgggttctttcgccattatcgatgacccctatagccctgagccacgaaagggctttttgggggaagtacggtgtcccaccgaggaaacagctattcgcgcctccccgtcatgcaaaatggcacctaacctcatagagtaccagccagaaatggatacggcggagtgtaccactaatatgatcgaccccatggccattttcaacagaggatctctgcctcaagtcagggacggcatgacatttacccagagcatcgagaagaatacagtgcaggctctaactaccggggaagtgcgggccagtattcgactgacgctcgatgactatgatgtcgtttaccagaactcccaattcgactgcagcgcaacatttaaaaacctgaccggatgctattcttgtgatgagggctcaagaatgtgctaccaggtgaaggctgaaggtgagactatcttccattttgtaaatgaggacgaatccataaacgtgatcaataaagtcagtcccgatgtgagcgactactgtaccgttcttcacttctcgcgcccagtgatttctatcgaggggaggtatgattgcggattgtccaagcgtcctatggtcattaaaggcacactgatcgccactgcaccccacgacgatcggaagcatgaaggtggcagctcattagtggttaacccaaaagggggaaccgtggactttttcggctgggtcagtgggctcacatcttggctgggaggcccgcttaagacgtttctgaccatactaggtttcctcgccctggggttgctgttagtagtgattatcatcattatagctagaactggagttgagcaggcgctcaagaaaaagaataaatga

SEQ ID NO: 11417 - RNA, 4014 nt, synthetic construct
  misc_feature 1..4014: note = derived and/or modified CDS sequence (opt3) from TOSV(SI-31051)__EU003174.1__GP
  source 1..4014: mol_type = other RNA
atgttcatcgccaagctgctccttattagctgcctggtgcagcaggcttacttgaaatataccataatctccgagattggcaacgggacaagaacttctttttgttactcaagtaggacgagcttaggatccctgctagaagcatgggacaatatcaccgagtctattggtctcacatcgggcacttgcaaggtcgggtcactggaaaaccgggagtgtaaacgcgatatcatgagcaattatgttgccgaagtgcacagtaaccttcatggactgggcgcgatgatgcacaattacggtgacgataagcgaatagaggtattgaacgacgtgatccccgatgagctcaatcctgggcgtcataactgctccgacctggatagaaaaccattctgtaccgaatttattaatgtcgctaagccggccaacgagatggcacccatgtctgtgatccctccacccattgttaagcctatcccagtggccgaacccacaaccaaaaagactatacctttcgacaaactgctcagcgaggctgagaaggaattaaatcaaacaaaaattaggctggagaccgaacggcgctccaacgcagaggaagccgctaaggagagagccaggatgcgggagatcgaagataaacttcgcaaagactgggagttggaacgagagagaaaggatgcggtcgcagaagacctggccaaagagattgctaggcggcgtgagatcgaacgcaaggcccacgagctagataaaatgctcaagaaaaaggaaagagaggacctggtggcaagggaacgggtagacgaggatatgcgaaatcatgttcgcagaccaaacacgactatcgctccgaccattataacaactcttctgatggcctcagcggtgatggccggacccttggagaatagggaaaccaaccacctcctgaaccggcctggcaatggcgcatatacattaagtgactttgctgagtcaacctgcacgctggcctacgggtctgaatgtaagtcctgggagcaccagctcgatgagctttcattcccatttttccatagcaacctggacaaatatagtatgttggaagctgccactgagacaatccccattctaaataagtcttccgcagtctgcaccatcagcccttcgactcactcttccaacgcctgtggacgcgaagctagcctgataaagaagaaatgcggtagtgatatgagcgcgtttttctacgtgaatctcgcaggccagattacagtggtcaagtgtgacaccaaccatgttctgtccaatgattgcgggaactgcatctctaagacgcttagcggacaaaagatctacaccccagtgcaggacatgttttgtcagaagggctggtcagagagtattccctccacaagatatagcaaagatctgtgctctatcggtttgcacactgtaaaggaatgtaaaattgggaccacaaatttcgagagggtgggatttatagtcgtgaagggccgtaagatgtacatcgagcagatgaaaatgcggtcacgacaagaatttagtgaggaccagttcctctgctataagagcgaaggctcctctgggtcgagcgttaaactgaagaaagtgaaggtcgagtcctgtaagggagtgactacctcaagtgcctctaaatgcagcggtgatgaatacttttgttccagatatccgtgcgagacagctaacgtagaggcccactgtattttaaggcgccattcagcagttatcgaagtgaatgtcaacggcgtgtgggtcgtgcctcggtgcatcgggtacgaggaagttctggtgagaaggaccagcctaaaggtagaggacacttcttcccgcgaatgtgacacgtgcctctgggagtgcggcaaaaataagctgattgtcaaaacacacggacccaagatagtgtatgccaccgcttgtagtcatggtagctgcaaatctgttatgcagaagccagccactttcgtgtaccttccttaccccgggaactccgagatcgtcggcggagatattggcgtgcacatgaccgaagagtcaagtccaagcaatatccatatggtagcacactgtcccgcgaaggactcgtgcgaagtgtcctcttgtttgttttgcgttcacgggctgctcaactatcagtgtcatacactgttcagcgcccttctgatttcaaccactgtcatgagtatcttgacactcctgttactgctagtgaaaggagctaaggatctcgtgaaacgactgttttactggcttataacgcctttgtgctggctgtccgtcttctgtggttggatgatccggtcttggaagaaacgtgttggcagcgcaatttccagaaccaacgacactatcgggtggagggataattcacgccggggacaagacattgagagagcccagtatacaggcggtgctccaggggccaagtacagcttttatggcgtgatgatcctcggactgttaggcaacgtgcacagttgctctgagtccataattgcagatagcaagatcatgcagtgtaccacatcggggtcatctactctgtgcaaagctagtggaaccgtaattatgaaacttggtccgatcggctccgaaagctgcttgatactcaaagggctgaaggactctgagaaacaattcatcagcattaagacgatctcctcagaactaacctgtagggagggagaaagtttttggacaactctgtacacccccgtctgcctcagctctcgacgctgtcatctgatgggcgagtgcgtgtccgatcggtgtcttagatggaagacaaatgagacttcagccgagttcaccggtaaagcgcacggggaagttatgcacgaaaacaggtgctttgagcagagtggcggaattggctatgggtgtttcaatgtgaaccctagctgcttgtacgtccattcctacctgaagtctgtgtataaaaatggatttaagatcttccgttgtgttgcctggaaccaccgcatacggttagaagtgacgacacattcgagaaaattcccaatggtactcatggctatgagcacccagcccactgactggggctcaattggtctgatccttgattccgggggaatcacaggcaccaatgcatacagttttatgaagcacggtctgggctctttcgccattatcgacgatccttatagcccagagcccaggaaggggtttttgggagaggtccgatgcccgactgaagagaccgctattcgggcctccccttcatgtaaaatggcaccaaacctcatagaataccagcccgagatggacacagcggaatgcacgaccaatatgatcgaccctatggccattttcaaccgcggctctctgccccaagtgagagatgggatgacttttacacagagcatcgagaagaataccgtgcaggctctaacaactggagaggtcagggccagtattcggctgaccctcgacgattatgacgttgtgtaccagaactcccaattcgattgcagcgcaacgtttaaaaatctgacaggctgttattcttgcgacgaaggttcacgaatgtgttaccaggtaaaggctgagggggaaaccatcttccattttgtgaacgaggatgagtccataaacgtcatcaataaagtgagtccagacgttagcgattactgcactgtgcttcacttctcgagacctgtcatttctatcgaaggacgctatgactgtggcttgtccaagaggcccatggtgattaaaggtaccctgatcgccacagcaccacacgatgaccgtaagcatgagggcgggagctcattagttgtgaacccgaagggaggcactgtcgatttcttcgggtgggtaagtggactcacctcttggctgggcggtcctcttaaaacatttctgacgatactagggttcctcgccctgggattgctgttagtggttattatcatcattatagctcggaccggcgtggaacaggcgctcaagaaaaagaataaatga

SEQ ID NO: 11418 - RNA, 4014 nt, synthetic construct
  misc_feature 1..4014: note = derived and/or modified CDS sequence (opt3) from TOSV(SI-39538)__EU003175.1__GP
  source 1..4014: mol_type = other RNA
atgttcatcgccaagctgctccttattagctgcctggtgcagcaggcttacttgaaatataccataatctccgagattggcaacgggacaagaacttctttttgttactcaagtaggacgagcttaggatccctgctagaagcatgggataatatcaccgagtctattggtctcacatcgggcacttgcaaggtcgggtcactggaaaaccgggagtgtaaacgcgatatcatgagcaattatgttgccgaagtgcacagtaaccttcatggactgggcgcgatgatgcacaattacggtgacgataagcgaatagaggtattgaacgacgtgatccccgatgagctcaatcctgggcgtcataactgctccgacctggatagaaaaccattctggaccgaatttattaatgtcgctaagccggccaacgagatggcacccatgtctgtgatccctccacccattgttaagcctatcccagtggccgaaagcacaaccaaaaagactatacccttcgacaaactgctctccgaggctgagaaggaattaaatcaaacaaaaattaggctggagaccgaacggcgctcaaacgcagaggaagccgctaaggagagagccaggatgcgggagatcgaagataaacttcgcaaagactgggagttggaacgagagagaaaggatgcggtcgcagaagacctggccaaagagattgctaggcggcgtgagatcgaacgcaaggcccacgagctagataaaatgctcaagaaaaaggaaagagaggacctggtggcaagggaacgggtagacgaggatatgcgaaatcatgttcgcagacctaacacgactatcgctccaaccattataacaactcttctgatggccagtgcggtgatggccggaccgttggagaatagggaaaccaaccacctcctgaaccggcccggcaatggcgcatatacattaagcgactttgctgagtctacctgtacgctggcctacgggtccgaatgcaagtcatgggagcaccagctcgatgagcttagcttcccatttttccatagtaacctggacaaatattctatgttggaagctgccactgagacaatccctattctaaataagtccagcgcagtctgtaccatctcgccctctactcactcctcaaacgcctgcggacgcgaagctagtctgataaagaagaaatgtggtagcgatatgtccgcgtttttctacgtgaatctcgcaggccagattacagtggtcaagtgcgacaccaaccatgttctgtctaatgattgtgggaactgcatcagcaagacgctttcaggacagaaaatctacacccctgtgcaagacatgttttgccagaagggctggagtgagtccattccaagcacaagatattctaaagatctgtgttcaatcggtttgcacactgtaaaggaatgcaaaattgggaccacaaatttcgagagggtgggatttatagtcgtgaagggccgtaagatgtacatcgagcagatgaaaatgcggagtcgacaagagttcagcgaagaccagttcctctgttataagtccgaaggatcttcggggagctccgttaaactgaagaaagtgaaggtcgagtcatgcaagggagtgactaccagttctgccagcaaatgttccggtgatgaatacttttgctcaagatatccctgtgagacagctaacgtagaggcccactgcattttaaggcgccatagcgcagttatcgaagtgaatgtcaacggcgtgtgggtcgtgccgcggtgtatcgggtacgaggaagttctggtgagaaggacctctctaaaggtagaggacacttccagtcgcgaatgcgacacgtgtctctgggagtgcggcaaaaataagctgattgtcaaaacacacggccctaagatagtgtatgccaccgcttgcagccatggttcttgtaaatccgttatgcagaagcccgccactttcgtgtaccttccataccctgggaactcagagatcgtcggcggagatattggcgtgcacatgaccgaagagagtagcccctcgaatatccatatggtagcacactgcccagcgaaggactcctgtgaagtgtctagctgcttgttttgtgttcacgggctgctcaactatcagtgccatacactgttctcagcccttctgattagtaccactgtcatgtccatcttgacactcctgttactgctagtgaaaggagctaaggatctcgtgaaacgactgttttactggcttataacgcccttgtgttggctgtctgtcttctgcggttggatgatccggagctggaagaaacgtgttggctccgcaatttcaagaaccaacgacactatcgggtggagggataatagccgccggggacaagacattgagagagcccagtatacaggcggtgctcctggggccaagtacagtttttatggcgtgatgatcctcggactgttaggcaacgtgcactcttgttccgagagcataattgcagattcgaagatcatgcagtgcaccacatcagggtctagtactctgtgtaaggcttccggaaccgtaattatgaaacttggtccaatcggcagcgaatcttgcttgatactcaaagggctgaaggacagcgagaaacaattcatctccattaagacgatctcaagtgaactaacctgcagggagggagagagcttttggacaactctgtacaccccggtctgtctctcttcccgacgctgccatctgatgggcgaatgtgtgtcagatcggtgccttagatggaagacaaatgagaccagtgccgagttcactggtaaagcgcacggggaagttatgcacgaaaacaggtgttttgagcagagcggcggaattggctatgggtgcttcaatgtgaacccctcctgtttgtacgtccattcttacctgaagtcggtgtataaaaatggatttaagatcttccgttgcgttgcctggaaccaccgcatacggcatgaagtgacgacacacagcagaaaattccctatggtattaatggctatgtcaacccagccaactgactggggctccattggtctcatcctggatagtgggggaatcacaggcaccaatgcatactcttttatgaagcatggtcttggcagcttcgccattatcgacgatccctattcccctgagccaaggaaggggtttctgggagaggtccgatgtcccactgaagagaccgctattcgggcctcaccgtcttgcaaaatggcacctaacttgatagaataccagccagagatggacacagcggaatgtacgaccaatatgatcgaccccatggccattttcaaccgcggcagcctccctcaagtgagagatgggatgacttttacacagagtatcgagaagaataccgtgcaggctctgacaactggagaggtcagggcctccattcggctaaccctggacgattatgacgttgtgtaccagaacagccaattcgattgctctgcaacgtttaaaaatctcacaggctgctattcatgtgacgaaggttcccgaatgtgctaccaggtaaaggctgagggggaaaccatcttccactttgtgaacgaggatgagagtataaacgtcatcaataaagtgagccccgacgtttcggattactgtactgtgctgcacttctctagaccagtcatttccatcgaaggacgctatgactgcggccttagcaagaggcctatggtgattaaaggtaccttgatcgccacagcaccccatgatgaccgtaagcacgagggcgggtcaagtctggttgtgaacccaaagggaggcactgtcgactttttcgggtgggtatctggattaacctcctggctcggcggtccgctgaaaacatttcttacgatactggggttcctagccctcggactgttgctggtggttattatcatcattatagctcggaccggcgtggaacaggcgttaaagaaaaagaataaatga

SEQ ID NO: 11419 - RNA, 4014 nt, synthetic construct
  misc_feature 1..4014: note = derived and/or modified CDS sequence (opt3) from TOSV(SI-40463)__EU003176.1__GP
  source 1..4014: mol_type = other RNA
atgttcatcgccaagctgctccttattagctgcctggtgcagcaggcttacttgaaatataccataatctccgagattggcaacgggacaagaacttctttttgttactcaagtaggacgagcttaggatccctgctagaagcatgggataatatcaccgagtctattggtctcacatcgggcacttgcaaggtcgggtcactggaaaaccgggagtgtaaacgcgatatcatgagcaattatgttgccgaagtgcacagtaaccttcatggactgggcgcgatgatgcacaattacggtgacgataagcgagtagaggtgttgaacgacgtcatacccgatgagctcaatcctgggcgtcataactgctccgacctggatagaaaaccattctggaccgaatttatcaatgtggctaagccggttaacgagatggcccccatgtctgtgattcctccacccatcgtcaagcctattccagtggcagaaagcacaaccaaaaagactatccccttcgacaaactgctctccgaggccgagaaggaattaaatcaaacaaaaataaggctggagaccgaacggcgctcaaacgctgaggaagcagccaaggagagagctaggatgcgggagattgaagataaacttcgcaaagactgggagttggaacgagagagaaaggatgccgtagcggaagacctggcaaaagagatcgccaggcggcgtgagattgaacgcaaggctcacgagctagataaaatgctcaagaaaaaggaaagagaggacctggttgccagggaacgggtggacgaggatatgcgaaatcatgtccgcagacctaacacgactatcgcaccaaccatcattacaactcttctgatggctagtgccgtgatggcgggaccgttggagaatagggaaaccaaccacctcctgaaccggcccggcaatggcgcctatacattaagcgactttgcagagtctacctgtacgctggcttacgggtccgaatgcaagtcatgggagcaccagctcgatgagcttagcttcccatttttccatagtaacctggacaaatattctatgttggaagccgctactgagacaatacctatcctaaataagtccagcgccgtgtgtaccatttcgccctctactcactcctcaaacgcatgcggacgcgaagccagtctgatcaaaaagaaatgtggtagcgatatgtccgcctttttctacgtcaatctcgcgggccagataacagttgtgaagtgcgacaccaaccatgtactgtctaatgattgtgggaactgcattagcaagacgctttcaggacaaaagatctacacccctgtgcaggacatgttttgccagaagggctggagtgagtccatcccaagcacaagatattctaaagatctgtgttcaattggtttgcacactgtcaaggaatgcaaaatcgggaccacaaatttcgagagggtgggatttattgttgtgaagggccgtaagatgtacatagagcagatgaaaatgcggagtcgacaagagttcagcgaagaccagttcctctgttataagtccgaaggatcttcggggagctccgtcaaactgaagaaagtgaaggtagagtcatgcaagggagttactaccagttctgcaagcaaatgttccggtgatgaatacttttgctcaagatatccctgtgagacagccaacgtggaggctcactgcatcttaaggcgccatagcgccgtcattgaagtgaatgtcaacggcgtgtgggttgtgccgcggtgtatcgggtacgaggaagtactggtcagaaggacctctctaaaggtggaggacacttccagtcgcgaatgcgacacgtgtctctgggagtgcggcaaaaataagctgatcgttaaaacacacggccctaagattgtgtatgcaaccgcctgcagccatggttcttgtaaatccgtcatgcagaagcccgctactttcgtgtaccttccataccctgggaactcagagatagtaggcggagatatcggcgtgcacatgaccgaagagagtagcccctcgaatattcatatggttgcccactgcccagcaaaggactcctgtgaagtctctagctgcttgttttgtgtgcacgggctgctcaactatcagtgccatacactgttctcagcgcttctgatcagtaccactgtgatgtccattttgacactcctgttactgctagtcaaaggagctaaggatctcgttaaacgactgttttactggcttatcacgcccttgtgttggctgtctgtgttctgcggttggatgatacggagctggaagaaacgtgtgggctccgccatctcaagaaccaacgacactattgggtggagggataatagccgccggggacaagacatcgagagagcacagtatacaggcggtgcccctggggctaagtacagtttttatggcgtaatgattctcggactgttaggcaacgtccactcttgttccgagagcatcatagccgattcgaagattatgcagtgcaccacatcagggtctagtactctgtgtaaagcatccggaaccgtgatcatgaaacttggtccaattggcagcgaatcttgcttgatcctcaaggggctgaaggacagcgagaaacaattcatatccatcaagacgatttcaagtgaactaacctgcagggagggagagagcttttggacaactctgtacaccccggtttgtctctcttcccgacgctgccatctgatgggcgaatgtgtgtcagatcggtgccttagatggaagacaaatgagaccagtgctgagttcactggtaaagcccacggggaagtcatgcacgaaaacaggtgttttgagcagagcggcggaatcggctatgggtgcttcaatgtgaacccctcctgtttgtacgttcattcttacctgaagtcggtgtataaaaatggatttaagattttccgttgcgtagcgtggaaccaccgcatccggttagaagtcacgacacatagcagaaaattccctatggtgctcatggccatgtcaacccagccaactgactggggctccataggtctgattcttgatagtgggggaatcacaggcaccaatgcttactcttttatgaagcacggtctgggcagcttcgcaatcattgacgatccctattcccctgagccaaggaaggggtttttgggagaggtgcgatgtcccactgaagagaccgccatccgggcttcaccgtcttgcaaaatggcccctaacctcattgaataccagccagagatggacacagcagaatgtacgaccaatatgatagaccccatggcgatcttcaaccgcggcagcctgcctcaagtcagagatgggatgacttttacacagagtattgagaagaataccgttcaggccctaacaactggagaggtgagggcttccatccggctgaccctcgacgattatgacgtagtgtaccagaacagccaattcgattgctctgccacgtttaaaaatctgacaggctgctattcatgtgacgaaggttcccgaatgtgctaccaggtcaaggcagagggggaaaccattttccattttgtgaacgaggatgagagtatcaacgttataaataaagtgagccccgacgtctcggattactgtactgtgcttcacttctctagaccagttatctccattgaaggacgctatgactgcggcttgagcaagaggcctatggtgatcaaaggtaccctgattgctacagctccccacgatgaccgtaagcatgagggcgggtcaagtttagtcgtaaacccaaagggaggcactgtggactttttcgggtgggtttctggactcacctcctggctgggcggtccgcttaaaacatttctgacgatcctagggttcctcgcactgggattgctgttagtggtcataattatcatcattgcccggaccggcgtggaacaggctctcaagaaaaagaataaatga

SEQ ID NO: 11420 - RNA, 4020 nt, synthetic construct
  misc_feature 1..4020: note = derived and/or modified CDS sequence (opt3) from TOSV(SI-40614)__EU003177.1__GP
  source 1..4020: mol_type = other RNA
atgttcatcgccaagctgctccttattagctgcctggtgcagcaggcttacttgaaatataccataatctccgagattggcaacgggacaagaacttctttttgttactcaagtaggacgagcttaggatccctgctagaagcatgggacaatatcaccgagtctattggtctcacatcgggcacttgcaaggtcgggtcactggaaaaccgggattgtaaacgcgacatcatgagcaattatgttgccgaggtgcacagtaaccttcatggactgggcgcgatgatgcacaattacggtgatgacaagcgagtagaagtgttgaacgatgtcatacccgacgagctcaatcctgggcgtcataactgctccgatctggacagaaaaccattctggaccgagtttatcaatgtggctaagccggccaacaagattgcacccatctctgttattcctccacccatcgtgaaacctataccaattgccgaaagcacaatcaagaaaaccattcccttcgataagctgctctccgaggctgaaaaagagttaaatcaaactaagatcaggctggagacagaacggcgctcaaacgcaggagaggccgctagagaaagggcccggatgcgcgagatcgaagacaaacttcgaaagaattgggagttggagagagaaaggaaggatgcggtcgcagacgatctggccaaagagattgctcggcgtcgcgaaatagagagaaaggcccacgaactagacaaaatgctcaagaaaaaggagagggaggaccaggtggcaatcgaacgggtaagtgaggatatgcgaaaccatgttcgcagacctaataccacgattgctccagccccgactatcataaccacactgcttatggcgagcgccgtgatggcaggccccctggaaaacagggagactaaccacttgctcaatcggcctggcaacggggcttataccctgtctgactttgccgaatccacatgtaccttagcttacggatcagagtgcaagagctgggagcaccagctggatgaactcagtttcccatttttccattctaatcttgacaaatattccatgctggaggccgcaacggaaactattcccatcttgaacaagagctcggccgtctgtacaatctctccttccacccactcaagtaatgcttgcggtcgcgaggcgagcctaattaaaaagaaatgtggcaacaatatgtccgcatttttctacgtgaacctggccgggcaaatcactgtggtcaagtgcgatacaaatcatgttctctctaacgactgtggaaattgcattagcaagaccctgtcaggccagaaaatatacacgccagtgcaggatatgttttgccagagaggttggaccgagagtatcccctccacaaggtatagcaaggacctttgttctattgggctgcacactgtaaaagaatgcaagaccggagctacaaacttcgagcgtgtgggctttatcgtcgtgaaatcacggaagatgtacatcgaacaaatgaagatgcgaagtagacaggagttcagcgaagatcagttcttgtgttataaatccgagtcttcgagcggctcctcagttaagctcaaaaaggtgaaagtcgagagttgcaagggggtgactacctctagcgcctccaagtgttcaggagacgaatacttttgcagcaggtatccgtgtgagacagcaaatgtagaagcccactgcattctgcgccggcattctgctgttatagaggtgaacgtcaatggtgtgtgggtcgtgcctagatgtatcggctacgaagaggttttagtgaggcgcacctccctgaaaatggaggatacgagtagccgagaatgcgacacttgtctatgggagtgcgggaagaacaaactcattgtaaagacacacggacccaaaatcgtctatgccaccgcatgctctcatggctcctgtaagtcagtgatgcagaaaccagcgactttcgtttacctgccttaccccggtaacagtgaaattgtcgggggcgacatcggagtgcacatgaccgaggaaagctcgccatccaatatacatatggtggctcactgccccgccaaggattcttgtgaggtaagctcatgcttgttttgtgtgcacggccttctgaactatcaatgccatacactcttcagtgcactgcttatctccaccactgttatgtctattctgacattgctcctgttactggtcaagggggccaaagacctagtgaagaaactcttttactggctgatcacgcctctttgttggttgagcgtgttctgcggatggatgattaagtcctggaaaaagcgggtcggttcagctatcagccgtaccaatgatactataggctggagagacaacaggcgctatgggcgggatgttgagagagcccagtacacaggaggcgtgccaggtgcaatttatagtttttacggggtgatgatcctgggcctcctgggaaatgtacactcttgttccgaaagcgtcattgctgactcgaaggtgatgcagtgcaccacatcaggctctagtactttatgtaaagcctccgggaccgttatcatgaagctgggaccgataggtagcgagtcttgccttatcttgaaaggcctcaaggataacgaaaaacaattcattagcatcaagacgatttcctcagagctgacctgcagggagggggaaagtttttggacaactctatatacccccgtgtgtctgagctctcgacgctgccatctcatgggagagtgtgtctccgaccggtgcctgaagtggaaaacaaatgaaacttcacctgagttcaccggcaaggcgcacggtgaagtgatgcacgagaacagatgttttgagcagagtgggggcatcggatacggctgcttcaatgttaacccaagctgtctttacgtgcattccatattgaaatctgtatataagaatgggtttaaaattttcaggtgcgtcgcctggaaccaccgtatccgcctggaagtgacgacacattcgcggaagttccccatggtgttaatggctatgagcacccagcctactgattggggatcaatcggcctcattctggactccgagggtatcacagggaccaatgcatacagttttatgaagcacggatctggcagcttcgccattatagatgacccatattcccccgaaccgagaaaaggttttcttggcgaggtcaggtgtcctactgaagagaccgctatccgagcctcaccatcttgcaagatggcacccaacctgattgagtaccagcctgaaatggatacagcggagtgtacgaccaatatgatcgaccccatggccattttcaaccgggggagcttgccacaagttcgcgacggaatgacttttacacagagtatcgagaaaaacaccgtgcaggctctcacaactggcgaagtaagagcctccataaggctgaccctagatgactatgatgtggtctaccagaatagccaatctgactgctcagcaacgttcaagaacctgacagggtgctattcctgtgatgaaggaagtcggatgtgctaccaggtgaaagctgagggcgagaccatctttcatttcgttaatgaagacgagagcattaacgtgatcaataaggtctcgcctgatgtgtctgactactgtactgttctccacttttcccgacccgtgattagcatcgaaggtagatatgattgcgggctgtcaaaacgcccaatggtcataaagggaacccttattgccacagcaccgcacgacgataggaagcatgagggcggtagttctttggtagtgaaccctaaaggcgggactgttgacttctttggatgggtgtccggcctgaccagctggttagggggacccctcaagacattcctgacgatccttggctttctggccctaggtctcctgttggtcgtgatcattataatcattgctcgtaccggggtagagcaggcgctgaaaaagaaaaataagtga

SEQ ID NO: 11421 - RNA, 4014 nt, synthetic construct
  misc_feature 1..4014: note = derived and/or modified CDS sequence (opt3) from TOSV(SI-51903)__EU003178.1__GP
  source 1..4014: mol_type = other RNA
atgttcatcgccaagctgctccttattagctgcctggtgcagcaggcttacttgaaatataccataatctccgagattggcaacgggacaagaacttctttttgttactcaagtaggacgagcttaggatccctgctagaagcatgggacaatatcaccgagtctattggtctcacatcgggcacttgcaaggtcgggtcactggaaaaccgggagtgtaaacgcgatatcatgagcaattatgttgccgaagtgcacagtaaccttcatggactgggcgcgatgatgcacaattacggtgacgataagcgaatagaggtattgaacgacgtgatccccgatgagctcaatcctgggcgtcataactgctccgacctggatagaaaaccattctggaccgaatttattaatgtcgctaagccggccaacgagatcgcacccatgtctgtgattcctccacccatcgttaagcctataccagtggccgaaagcacaaccaaaaagactattcccttcgacaaactgctctccgaggctgagaaggaattaaatcaaacaaaaatcaggctggagaccgaacggcgctcaaacgcagaggaagccgctaaggagagagccaggatgcgggagattgaagataaacttcgcaaggactgggagttggaacgagagaagaaagatgcggtcgcagaagacctggccaaggagatcgctagaaggcgggagatcgaacgtaaagcccacgagctagataagatgctcaaaaagaaggaacgcgaggacctggtggcaagagaaagggtagacgaggatatgcggaatcatgttcgacgccctaacgctacgattgccccaactataatcaccacacttctgatggcgagtgccgtgatggcaggaccgttggagaatagagaaactaaccacctcctgaacaggcccggcaatggcgcttataccttaagcgactttgccgagtctacatgtaccctggcttacgggtccgaatgcaaatcatgggagcaccagctcgatgagcttagcttccctttcttccatagtaacctggacaagtattctatgttggaagccgcaacggagactattccaatcctaaataaatccagcgccgtctgtacaatatcgccctctacccactcctcaaacgcttgcggacgggaagcgagtctgattaagaaaaagtgtggtagcgatatgtccgcatttttctacgtgaatctcgccggccagatcactgtggtcaagtgcgacacaaaccatgttctgtctaatgattgtgggaactgcatcagcaaaaccctttcaggacaaaagatttacacgcctgtgcaggacatgttttgccagaaaggctggagtgagtccatcccaagcacccgctattctaaggatctgtgttcaattggtttgcacacagtaaaagaatgcaagatagggactaccaatttcgagagagtgggatttatcgtcgtgaagggcaggaaaatgtacattgagcagatgaagatgcgtagtcggcaagaatttagcgaggacgaatttctctgttataaatccgagggcagttcggggagctccgttaagctgaaaaaggtgaaggtcgaatcatgcaaaggagtgacaacttcttctgctagcaagtgttccggtgatgagtacttttgctcacgatatccctgtgagaccgccaacgtagaagcacactgcatcttaagaaggcatagcgccgttatcgaggtgaatgtcaacggcgtgtgggtcgtgccgcgctgtattgggtacgaagaggttctggtgcggagaacatctctaaaagtagaagacacctccagtagggagtgcgacacttgtctctgggagtgcggaaagaataaactgatagtcaagacgcacggccctaaaatcgtgtatgctacagcctgcagccatggttcttgtaagtccgttatgcagaagcccgcaaccttcgtgtaccttccataccctgggaactcagaaattgtcggcggagatatcggcgtgcacatgactgaggaaagtagcccctcgaatattcatatggtagcgcactgcccagctaaagactcctgtgaggtgtctagctgcttgttttgtgttcacgggctgctcaactatcagtgccataccctgttctcagcccttctgatcagtacaaccgtcatgtccatattgactctcctgttactgctagtgaagggagcaaaagatctcgtgaagcgcctgttttactggcttatcacacccttgtgttggctgtctgtcttctgcggttggatgattcgaagctggaaaaagcgggttggctccgccatctcacgtacgaacgacaccattgggtggagagataatagcaggcgcggacaggacgtggagcgggctcaatatactggcggtgcccctggggcaaagtacagtttttatggcgtgatgatcctcggactgttaggcaacgtacactcttgttccgaaagcataattgctgattcgaaaatcatgcagtgcacaacctcagggtctagtacactgtgtaaggcctccggaactgtcattatgaaacttggtccaatcggcagcgagtcttgcttgatactcaaggggctgaaagacagcgaaaagcagttcatctccattaagaccatctcaagtgagctaacgtgcagagaaggagagagcttttggaccacactgtacactccggtgtgtctctcttccaggcgatgccatctgatgggcgagtgtgtttcagatcgctgccttcggtggaaaaccaatgaaacaagtgcggagttcactggtaaggcccacggggaagtgatgcacgagaacagatgttttgaacaaagcggcggaattggctatgggtgcttcaatgtcaacccctcctgtttgtacgtgcattcttacctgaaatcggtttataagaatggatttaaaatcttcaggtgcgtggcttggaaccaccgtatacgcttagaggtaaccacgcatagccggaagttccctatggtcctcatggcaatgtcaacacagccaaccgactggggctccattggtctgatccttgatagtgggggaatcactggcacaaatgcctactcttttatgaagcacggtctgggcagcttcgctattatcgacgatccctattcccctgagccaagaaaagggtttttgggagaagtgaggtgtcccaccgaggaaactgccattcgagcatcaccgtcttgcaagatggcgcctaacctcatagagtaccagccagaaatggacaccgccgagtgtacaacgaatatgatcgaccccatggctattttcaaccggggcagcctgcctcaggtgcgcgatgggatgacctttactcaaagtatcgagaaaaatacagtccaggccctaaccacaggagaagttagagcatccattaggctgactctcgacgattatgacgtggtataccagaacagccagttcgattgctctgctacctttaagaatctgacgggctgctattcatgtgacgagggtccccggatgtgctaccaagtgaaagccgaaggggagacaatcttccattttgtcaacgaggatgaatccataaacgtgatcaataaggttagtccagacgtgagcgattactgtaccgtccttcacttctcgcgacctgtgatttctatcgagggaagatatgactgcggcttgtccaaacgccccatggttattaagggtactctgatcgcaaccgccccacacgatgacaggaagcatgaaggcgggagctcattagtggtcaacccgaaaggaggcacagtagatttcttcgggtgggtgagtggactcacttcttggctgggcggtcctcttaagacctttctgacaatactagggttcctcgctctgggattgctgttagttgtgattatcatcattatagcgcgtacgggcgtcgagcaggccctcaaaaagaaaaataagtga

SEQ ID NO: 11422 - RNA, 4014 nt, synthetic construct
  misc_feature 1..4014: note = derived and/or modified CDS sequence (opt3) from TOSV(SI-68809)__EU003179.1__GP
  source 1..4014: mol_type = other RNA
atgttcatcgccaagctgctccttattagctgcctggtgcagcaggcttacttgaaatataccataatctccgagattggcaacgggacaagaacttctttttgttactcaagtaggacgagcttaggatccctgctagaagcatgggacaatatcaccgagtctattggtctcacatcgggcacttgcaaggtcgggtcactggaaaaccgggagtgtaaacgcgatatcatgagcaattatgttgccgaagtgcacagtaaccttcatggactgggcgcgatgatgcacaattacggtgacgataagcgaatagaggtattgaacgacgtgatccccgatgagctcaatcctgggcgtcataactgctccgacctggatagaaaaccattctggaccgaatttattgacgtcgctaagccggccaatgagatcgcacccatgtctgtgattcctccacccatcgttaagcctataccagtggccgaaagcacaattaaaaagaccatccccttcgataaactgctctccgaggctgaggaagagttaaaccaaactaagattaggctggaaacagagcggcgctcaaatgcagaagaggccgctaaagagagagccaggatgcgggaaatcgaggacaaacttcgcaaggattgggaattggagcgagaaagaaaagacgcggtcgcagaggatctggccaaggagatcgctaggcggcgtgaaattgagcgcaaagcccacgaactagacaagatgctcaaaaagaaagagagagaagacctggtggcaagggagcgggtaaacgaggatatgcgaaatcatgttcgcagacctaacaccacgatagctccaactatcattaccacacttctgatggccagtgcggtgatggccggaccgttggaaaatagggagactaaccacctcctgaaccggcccggcaatggcgcatataccttaagcgactttgctgaatctacatgtaccctggcctacgggtccgagtgcaagtcatgggagcaccagctcgatgaacttagcttcccatttttccatagtaacctggacaagtattctatgttggaggctgccacggaaactatccctatactaaataaatccagcgcagtctgtacaatttcgccctctacccactcctcaaacgcctgcggacgcgaggctagtctgatcaagaaaaagtgtggtagcaatatgtccgcgtttttctacgtgaacctcgcaggccagatcactgtggtcaaatgcgatacaaatcatgttctgtctaacgactgtgggaattgcattagcaagaccctttcaggacaaaagatctacacgcctgtgcaggatatgttttgccagaaaggctggagtgaatccattccaagcaccagatattctaaggacctgtgttcaataggtttgcacacagtaaaagagtgcaagactgggaccacaaacttcgagagggtgggatttatcgtcgtgaaaggccgtaagatgtacattgaacagatgaagatgcggagtcgacaagagttcagcgaagatcagttcctctgttataaatccgaggggtcttcggggagctccgttaagctgaaaaaggtgaaagtcgaatcatgcaagggagtgactaccagttctgccagcaagtgttccggtgacgagtacttttgctcaagatatccctgtgagacagctaatgtagaagcccactgcatcttaaggcgccatagcgcagttatcgaggtgaacgtcaatggcgtgtgggtcgtgccgcggtgtattgggtacgaagaggttctggtgagaaggacctctctaaaagtagaagatacttccagtcgcgagtgcgacacgtgtctctgggagtgcggaaagaacaaactgatagtcaagacacacggccctaaaatcgtgtatgccaccgcttgcagccatggttcttgtaagtccgttatgcagaaacccgccactttcgtgtaccttccataccctggcaattcagaaattgtcggcggagacatcggcgtgcacatgaccgaggaaagtagcccctcgaacattcatatggtagcacactgcccagcgaaggattcctgtgaggtgtctagctgcttgttttgtgttcacgggctgctcaactatcagtgccatacactgttctcagcccttctgatcagtaccactgtcatgtccatattgacactcctgttactgctagtgaagggagctaaagacctcgtgaagcgactgttttactggcttatcacgcccttgtgttggctgtctgtcttctgcggttggatgattcggagctggaaacgtagagttggctccgcaatctcaaggaccaatgatactattgggtggcgcgacaacagccggagaggacaagatgtggagagggcccagtatacaggcggtgctcctggggccaagtacagtttttatggcgtgatgatcctcggactgttaggcgaagtacactcttgttccgagagcataattgcagactcgaaaatcatgcagtgcaccacatcagggtctagtactctgtgtaaggcttccggaaccgtcattatgaaacttggtccaatcggcagcgaatcttgcttgatactcaaggggctgaaggatagcgagaaacaattcatctccattaagacgatctcaagtgaactaacctgccgagagggagagagcttttggacaactctgtacaccccggtgtgtctctcttcccgccggtgccatctgatgggcgaatgtgtttcagacagatgccttaaatggaagacaaatgagaccagtgccgagttcactggtaaggcgcacggggaagtgatgcacgaaaacaggtgttttgagcagagcggcggaattggctatgggtgcttcaatgtcaacccctcctgtttgtacgtgcattcttacctgaaatcggtttataagaatggatttaaaatcttccgttgcgtggcctggaaccaccgcatacggttagaggtaacgacacatagcagaaagttccctatggtcctcatggctatgtcaacccagccaactgattggggctccattggtctgatccttgacagtgggggaatcacaggcaccaatgcatactcttttatgaaacacggtctgggcagcttcgccattatcgatgacccctattcccctgaaccaaggaaggggtttttgggagaggtgcgatgtcccactgaagagaccgctattcgggcctcaccgtcttgcaagatggcacctaacctcatagaataccagccagagatggatacagcggagtgtacgaccaatatgatcgaccccatggccattttcaaccgcggcagcctgcctcaagtgagagacgggatgacttttacacagagtatcgaaaagaataccgtccaggctctaacaactggagaggttagggcctccattcggctgaccctcgatgactatgatgtggtataccagaacagccaattcgactgctctgcaacgtttaagaatctgacaggctgctattcatgtgatgaaggttcccgaatgtgctaccaggtgaaagctgagggggagaccatcttccattttgtcaacgaagacgagagtataaacgtgatcaataaggttagccccgatgtgtcggactactgtactgtccttcacttctctagaccagtgatttccatcgaaggacgctatgattgcggcttgagcaaaaggcctatggttattaagggtaccctgatcgccacagcaccccacgacgatcgtaaacatgagggcgggtcaagtttagtggtcaacccaaagggaggcactgtagactttttcgggtgggtgtctggactcacctcctggctgggcggtccgcttaagacatttctgacgatactagggttcctcgccctgggattgctgttagttgtgattatcatcattatagctcggaccggcgtcgaacaggcgctcaaaaagaaaaataagtga

SEQ ID NO: 11423 - RNA, 4014 nt, synthetic construct
  misc_feature 1..4014: note = derived and/or modified CDS sequence (opt3) from TOSV(SI-76082)__EU003180.1__GP
  source 1..4014: mol_type = other RNA
atgttcatcgccaagctgctccttattagctgcctggtgcagcaggcttacttgaaatataccataatctccgagattggcaacgggacaagaacttctttttgttactcaagtaggacgagcttaggatccctgctagaagcatgggataatatcaccgagtctattggtctcacatcgggcacttgcaaggtcgggtcactggaaaaccgggagtgtaaacgcgatatcatgagcaattatgttgccgaagtgcacagtaaccttcatggactgggcgcgatgatgcacaattacggtgacgataagcgaatagaggtattgaacgacgtgatccccgatgagctcaatcctgggcgtcataactgctccgacctggatagaaaaccattctggaccgaatttattaatgtcgctaagccggccaacgagatggcacccatgtctgtgatccctccacccattgttaagcctatcccagtggccgaaagcacaaccaaaaagactatacccttcgacgagctgctctccgaggctgaaaaagagttaaatcaaacaaagattaggctggaaaccgagcggcgctcaaacgcagaagaggccgctaaagagagagccaggatgcgggaaatcgaggataaacttcgcaaggactgggaattggagcgagaaagaaaggatgcggtcgcagaggacctggccaaggagattgctaggcggcgtgaaatcgagcgcaaagcccacgaactagataagatgctcaaaaagaaagagagagaagacctggtggcaagggagcgggtagacgaggatatgcgaaatcatgttcgcagacctaacacgactatcgctccaaccattataacaactcttctgatggccagtgcggtgatggccggaccgttggaaaatagggagaccaaccacctcctgaaccggcccggcaatggcgcatatacattaagcgactttgctgaatctacctgtacgctggcctacgggtccgagtgcaagtcatgggagcaccagctcgatgaacttagcttcccatttttccatagtaacctggacaagtattctatgttggaggctgccactgaaacaatccctattctaaataaatccagcgcagtctgtaccatctcgccctctactcactcctcaaacgcctgcggacgcgaggctagtctgataaagaaaaagtgtggtagcgatatgtccgcgtttttctacgtgaatctcgcaggccagattacagtggtcaaatgcgacaccaaccatgttctgtctaatgattgtgggaactgcatcagcaagacgctttcaggacaaaagatctacacccctgtgcaggacatgttttgccagaaaggctggagtgaatccattccaagcacaagatattctaaggatctgtgttcaatcggtttgcacactgtaaaagagtgcaagattgggaccacaaatttcgagagggtgggatttatagtcgtgaaaggccgtaagatgtacatcgaacagatgaagatgcggagtcgacaagagttcagcgaagaccagttcctctgttataaatccgagggcagttcggggagctccgttaagctgaaaaaggtgaaagtcgaatcatgcaagggagtgactaccagttctgccagcaagtgttccggtgatgagtacttttgctcaagatatccctgtgagacagctaacgtagaagcccactgcattttaaggcgccatagcgcagttatcgaggtgaatgtcaacggcgtgtgggtcgtgccgcggtgtatcgggtacgaagaggttctggtgagaaggacctctctaaaagtagaagacacttccagtcgcgagtgcgacacgtgtctctgggagtgcggaaagaataaactgattgtcaagacacacggccctaaaatagtgtatgccaccgcttgcagccatggttcttgtaagtccgttatgcagaaacccgccactttcgtgtaccttccataccctgggaactcagaaatcgtcggcggagatattggcgtgcacatgaccgaggaaagtagcccctcgaatatccatatggtagcacactgcccagcgaaggactcctgtgaggtgtctagctgcttgttttgtgttcacgggctgctcaactatcagtgccatacactgttctcagcccttctgattagtaccactgtcatgtccatcttgacactcctgttactgctagtgaagggagctaaagatctcgtgaagcgactgttttactggcttatgacgcccttgtgttggctgtctgtcttctgcggttggatgatacggagctggaaaaagcgtgttggctccgcaatctcaagaaccaacgacactattgggtggagggataatagccgccggggacaagacgtggagagagcccagtatacaggcggtgctcctggggccaaatacagtttttatggcgtgatgatcctcggactgttaggcaacgtacactcttgttccgaaagcattatcgcagattcgaagataatgcagtgcaccacatcagggtctagtactctgtgtaaggcttccggaaccgtcattatgaaacttggtccaatcggcagcgagtcttgcttgattctcaaggggctgaaagacagcgaaaagcaattcatctccataaaaacgatctcaagtgagctaacctgcagggaaggagagagcttttggacaactctgtacaccccggtgtgtctctcttcccgacgctgccatctgatgggcgagtgtgtttcagatcggtgccttagatggaagacaaatgaaacttctgccgagttcaccggtaaggcgcacggggaagtgatgcacgagaacaggtgttttgaacagagcggcggaattggctatgggtgcttcaatgtcaacccctcctgtttgtacgtgcattcttacctgaaatcggtttataagaatggatttaaaatcttccgttgcgtggcctggaaccaccgcattcggttagaggtaacgacacatagcagaaagttccctatggtcctcatggctatgtcaacccagccaactgactggggctccatcggtctgatacttgatagtgggggaattacaggcaccaatgcatactcttttatgaaacacggtctgggcagcttcgccatcatcgacgatccctattcccctgagccaaggaaggggtttttgggagaagtgcgatgtcccactgaggaaaccgctattcgggcctcaccgtcttgcaagatggcacctaacctcatcgagtaccagccagaaatggacacagcggagtgtacgaccaatatgattgaccccatggccatattcaaccgcggcagcctgcctcaagtgagagatgggatgacttttacacagagtatcgagaaaaataccgtccaggctctaacaactggagaagttagggcctccattcggctgaccctcgacgattatgacgtggtataccagaacagccaattcgattgctctgcaacgtttaagaatctgacaggctgctattcatgtgacgagggttcccgaatgtgctaccaggtgaaagctgaaggggagaccatcttccattttgtcaacgaggatgaaagtattaacgtgatcaataaggttagccccgacgtgtcggattactgtactgtccttcacttctctagaccagtgatatccatcgagggacgctatgactgcggcttgagcaaaaggcctatggttattaagggtaccctgatcgccacagcaccccacgatgaccgtaaacatgaaggcgggtcaagtttagtggtcaacccaaagggaggcactgtagactttttcgggtgggtgtctggactcacctcctggctgggcggtccgcttaagacatttctgacgattctagggttcctcgccctgggattgctgttagttgtgatcataattatcatcgctcggaccggcgtcgagcaggcgctcaaaaagaaaaataagtga

SEQ ID NO: 11424 - RNA, 4020 nt, synthetic construct
  misc_feature 1..4020: note = derived and/or modified CDS sequence (opt3) from TOSV(TOSV/Mantova.ITA/2013)__KM507329.1__GP
  source 1..4020: mol_type = other RNA
atgttcatcgccaagctgctccttattagctgcctggtgcagcaggcttacttgaaatataccataatctccgagattggcaacgggacaagaacttctttttgttactcaagtaggacgagcttaggatccctgctagaagcatgggacaatatcaccgagtctattggtctcacatcgggcacttgcaaggtcgggtcactggaaaaccgggattgtaaacgcgacatcatgagcaattatgttgccgaggtgcacagtaaccttcatggactgggcgcgatgatgcacaattacggtgatgacaagcgagtagaagtgttgaacgatgtcatacccgacgagctcaatcctgggcgtcataactgctccgatctggacagaaaaccattctggaccgagtttatcaatgtggctaagccggccaacaagattgcacccatctctgttattcctccacccatcgtgaaacctataccaattgccgaaagcacaatcaaggagaccattcccttcgaaaaactgctctccgaggctgagaaggaattaaatcaaactaaaatcaggctggagacagaacggcgctcaaacgcagaggaagccgctagagagagggcccgggtccgcgagatcgaagataaacttcgaaagaattgggagttggaaagagagaggaaggacgcggtggcagatgacctggccaaggaaattgctcggcgtcgcgagatagagagaaaagcccacgaactagataagatgctcaaaaagaaagagagggaagaccaggtagcaatcgagcgggttagtgaagacatgcgaaaccatgtgcgcagacctaataccacgattgctccagccccgactatcataaccacactgcttatggcgagcgccgtcatggcaggacccctggagaacagggagactaaccacttgctcaatcggcctggcaacggcgcttataccctgtctgattttgccgaatccacatgtaccttagcttacgggtcagagtgcaagagctgggaacaccagctggacgagctcagtttcccatttttccattctaatcttgataagtattccatgctggaggccgcaacggaaactattcccatcttgaacaaaagctcggccgtgtgtacaatctctccttccacccactcaagtaatgcttgcggacgcgaggcgagcctaattaagaaaaagtgtggtaacaatatgtccgcatttttctacgtgaacctggccggccaaatcactgtcgttaaatgcgacacaaatcatgtgctctctaacgattgtgggaattgctttagcaagaccctgtcaggacagaagatttacacgccagtacaggacatgttctgccagagaggctggaccgaaagtataccctccacaaggtatagcaaagatctttgttctatcggtctgcacactgtgaaggagtgcaaaaccgggacaactaactttgaacgtgtcggattcattgtggttaagtcacggaaaatgtacatcgagcaaatgaagatgcgaagtagacaggagttcagcgaagaccagtttttgtgttataagtccgagtcttcgagcggctcctcagtgaaactcaagaaagtcaaggtggaaagttgcaaaggcgtaaccacatctagcgcttccaagtgttcaggggatgagtacttctgcagcaggtatccgtgtgaaaccgccaatgttgaggcacactgcatcctgcgccggcattctgccgtgattgaggtcaacgtgaatggagtctgggtggttcctagatgtataggttacgaagaggtgttagtaaggcgcacttccctgaagatggaagacacgagtagccgagagtgcgatacatgtctatgggaatgcggcaaaaacaagctcatcgtcaaaacccacgggcccaagattgtgtatgctactgcctgctctcatggatcctgtaaatcagttatgcagaagccagcaacctttgtgtacctgccttaccccggcaacagtgagatcgtcggtggggacattggcgtgcacatgacagaggaaagctcgccatccaatatccatatggtagcgcactgccccgctaaagactcttgtgaggtgagctcatgccttttctgtgttcacggattgctgaactatcaatgccataccctctttagtgccctgcttatatccactacagtcatgtctatcctgacgttgctcctgttactggtgaagggcgcaaaggatctagtgaaaaagctcttttactggctgattacccctctttgttggttgagcgtcttttgcgggtggatgatcaaatcctggaagaaacgggttggatcagccattagccgtactaatgacacaatcggttggagagataacaggcgctatggccgggacgtggaaagagctcagtacaccgggggagccccaggcgcaaagtatagtttctacggtgtgatgatactggggctcctgggcaatgtacactcttgttccgagagcgtcattgctgattcgaaggtgatgcagtgcacaacttcaggatctagtaccttatgtaaagcctccggcacggttatcatgaagctggggccgattggaagcgagtcttgccttatcttgaaaggtctcaaggacaacgaaaaacaatttataagcatcaagaccatttcctcagagctgacatgcagggaaggcgagagtttctggactaccctatatacacccgtgtgtctgagctctcgacgctgccatctcatgggggaatgtgtctccgatcggtgcctgaagtggaaaactaatgagacctcagcggagtttacgggaaaggcccacggcgaagtgatgcacgagaacagatgtttcgaacagagtggtgggatcggctacggatgctttaatgttaaccctagctgtctttacgtgcattcctatttgaaatctgtatacaagaatggcttcaaaattttcaggtgcgtcgcttggaaccaccgtatccgcctggaggtgacaacccattcgcggaagtttccaatggtgttaatggcaatgagcactcagcccacagactgggggtcaataggactcattctggattccgaaggcatcaccggtactaatgcctatagtttcatgaagcacgggtctggcagctttgctatcattgacgatccttactccccagagcccagaaaaggattccttggtgaggtcaggtgtccgaccgaagagacagccatccgagcatcaccttcttgcaagatggcgccaaacctgattgaatatcagcccgagatggacacggccgaatgtaccactaatatgatagatcctatggctatctttaaccggggcagcttgccccaagttcgcgacgggatgacattcacccagagtattgagaaaaacacagtgcaggccctcactaccggagaggtaagagcatccatcaggctgacgctagacgattacgacgtggtctatcagaatagccaatctgattgctcagctacatttaagaacctgaccggctgctactcctgtgacgaagggagtcggatgtgctaccaggtgaaagccgagggagaaactattttccattttgttaatgaggatgagagcatcaacgtgataaataaggtctcgccagacgtgtctgattattgtaccgttctccacttctcccgacctgtgatcagcattgaaggcagatacgactgcggtctgtcaaaacgccccatggtcatcaaggggacacttattgcaactgccccacacgatgacaggaagcatgagggaggcagttctttggtagtgaacccgaaaggtggcaccgttgatttcttcgggtgggtgtccggactgacaagctggttaggcgggcctctcaagacgtttctgaccatccttggattcctggctctaggcctcctgttggtcgtgataattatcatcattgcgcgtactggtgtacagcaggccctgaaaaagaaaaataagtga

SEQ ID NO: 11425 - RNA, 4020 nt, synthetic construct
  misc_feature 1..4020: note = derived and/or modified CDS sequence (opt3) from TOSV(TOSV/Phl.233/FR/2009)__HQ184337.1__GP
  source 1..4020: mol_type = other RNA
atgttcatcgccaagctgctccttattagctgcctggtgcagcaggcttacttgaaatataccataatctccgagacaggcaacgggactagaacgtctttttgttactcaagtaggaccagcttaggatccctgctagaagcatgggacaatgtcacagagtctattggtctcacttcggggacctgcaaggttggctcactggaaaaccgggattgtcgcaaagacatcatgagcaattatgtggccgaggtacacagtaaccttcatggactgggcgcgatgatgcacaattacggtgatgacaagcgagtggaaattttgaacgatgtcatccccgacgagctcaatcctgggcatcacaactgctccgatctggaccgtaaaccattctggacagagtttataaatgtggctaagccgctgtctgaaatcgttcccatgagcgtgattcctccacccgtcgtgaagcctcagccacccgccgagccttcctcaaagaagcatgtaccattcgatgttctcttaagtgaagcagagaaagagctgaaccagaccaagatcagacttgaagacgagaggaaaagcaatgccgaagagactgctaaggaacgggcacgcatgaaggagattgaggatgaattgagaagggagtgggaactggagcggaaacgcaaggacgccatggctgatgacctagccaaagaaacagcgcgaagaagggagatcgagcggaaggcacacgaactcgacaaaatgctgaagaaaaaggagcgtgaatctcttatagccaaggagaaagctgatgaagacatgcgctcccacgtgcataagccgaacaccacgagagcccccgcacctactattatcaccacactgttgatggcttcagccgcgctcgccggaccactggagaatagggagactaaccacttactgaatcggcccggcaacggcgcatataccctcagcgattttgctgaaagtacatgtacccttgcctacgggtctgagtgcaaatcctgggaacatctgttgaacgaggagctattcccatttttccacagcaatctggacaagtattcgatgctcgaagctgccacggagactgtccctattctgaacaaatcttccgcagtgtgtacaatctcacccagtacccacagctccaatgcctgcggacgagaggcttctgtgatccgcaagaagtgttacagcaacatgtcagcgtttttctacattaatcttgcaggtcagataactgtcatcaaatgcgaaacaaaccatgttctgagttccgattgtggcaattgcattagcaagtctttgtcagggcaaaaagtgtataccccggtacaggacgtgttttgccagaagggatggacgcagagtatccctagcaccagatactccaaagatatatgttctattggcctccacacagtcaaggaatgcaagatcggtactacctcgttcgagagggtggggtttatcgttgtgaaaggacggaagatgtatattgagcaaatgaaaatgcgcagcagacaggaatactccgaggaccagttcctgtgttataagtcagaaagtggctctggcagctccgtcaaattaaagaagttcaaagtgcagtcatgcaagggggtaacaactagctctgcctccaaatgtagtggagatgagtacttttgcagcaggtatccctgtgaaaccgctaacgttgaggcccattgcatcctgcgtcggcactctgcaattgtggaggtcaatgtgaacggtgtctgggtggttccacgatgtataggctacgaagaggtgctagtaaagagaacatccctcaaagtcgaagacaccactgggagggagtgcgattcatgtctgtgggaatgcggaaagaataaacttatcgtgaagacgcatggccctaaggttgtgtacgccacagcttgcagtcacggtagctgtaaatcggtcatgcaaaagcccgccaccttcgtgtatttgccataccccgggaactccgagattgtaggcggagacatcggcatccacatgactgaggaatctagcccttcaaatattcatctggtggcacactgcccagcgcgcgacagttgtgatgtttccgactgcctcttttgtgtccatgggctgcttaactatcagtgccacaccctgttctctgctttgctcataagcacaaccgtgatgtccatcctgactttactgctactcctggtgaaaggagccaaggatcttgtcaaaaagttgtttcactggctgattacaccgctctgttggctgtcagttttctgctgttgggtggtgaaaagctggaaacggagagtaggtagtgcaatctctaggacgaatgacaccattggctggcgcgagaaccgacggcatgcccaggatatcgaacgtgctcaatacactgggggagcccccggcgcaaagtattccttttacggtgtcatgatattagggctgcttagctcggctcagtcatgctctgagagtgtgatcgccgactccaaaattatgcagtgtacaaccagcggctctagcacattgtgcaaggcgtccggaactgttatcatgagactcggccctattgggtcagagagttgcctgatcctaaaaggactgaaggatagcgaaaagcagttcatatctattaaaaccatctcctcagagctcacgtgtagggaaggtgagagtttttggaccacactgtatactccaatttgccttagctcccgccggtgtcacttgatgggcgaatgcgtgtctgacagatgtctgaagtggaaaaccaaccaaacatcggccgagttcactgggaaggctcatggagatgtcatgcacgagaataggtgctttgaacagagcggcggtatcgggtacggctgtttcaacgtgaatccctcatgcttatacgttcattcctatctcaaaagtgtgtaccgaaacggatttaaggtattccgctgtgtcgcatggaatcaccggataagactggaggtgaccacgcactctaggaagttccctatggtgcttatggccatgagcacacagccaaccgactggggctccatcgggctgattttggattcagaaggaatcactggcacaaactcttatagctttatgaaacatggtagtgggtccttcgctattatcgacgatccctacagcccggagcctcgtaagggatttctcggcgaagtccgctgcccaaccgaggagactgccatgcgggcatctccctcatgtaaaatggcgcctaatctgatagaatatcagcccgagatggacaccgccgaatgcacaacgaacatgattgacccaatggctatcttcaatagaggttccctacctcaagttagggatggcatgacctttactcagagtatcgagaagaacacagtgcaggccctgaccacaggggaagtaaaagcaagcattcgactcactctggacgattacgacgtggtctatcaaaattcgcaatctgattgctccgctaccttcaagaaccttacgggatgttacagctgcgacgagggctcacggttgtgttaccaggtgaaagccgagggggaaacaatctttcacttcattaatgaggaagagagtataaacgttatcaataaggtgtctcccggagtctccgattattgcaccgtgctgcattttagccgcccagttatttcaatcgagggcacttacgactgtggtttaagtaagagaccgatggtgattaaagggaccctcatcgcaacagcccctcacgatgacaggaagcatgaaggaggcagctccctggtcgtaaaccccaaaggtggctctgtggatttctttgggtggcttagcggactgacttcctggctaggcgggccactcaagaccttcctgacaatattgggatttctggctgttggcttactcctggtggtcatcattatcattatcatacggacgggtatgcagcaggcgcttaaaaagaagattaaatga

SEQ ID NO: 11426 - RNA, 4020 nt, synthetic construct
  misc_feature 1..4020: note = derived and/or modified CDS sequence (opt3) from TOSV(TOSV/Phl.51/FR/2009)__HQ184336.1__GP
  source 1..4020: mol_type = other RNA
atgttcatcgccaagctgctccttattagctgcctggtgcagcaggcttacttgaaatataccataatctccgagattggcaacgggacaagaacttctttttgttactcaagtaggacgagcttaggatccctgctagaagcatgggacaatgtcaccgagtctatcggtctcacatcgggcacttgcaaggttgggtcactggaaaaccgggattgtcgcaaagacattatgagcaattatgtggccgaggtacacagtaaccttcatggactgggcgcgatgatgcacaattacggtgatgacaagcgagtggaaatcttgaacgatgtcatacccgacgagctcaatcctgggcatcacaactgctccgatctggaccgtaaaccattctggaccgagtttatcaatgtggctaagccgctgtctgaaattgttcccatgagcgtgatccctccacccgtcgtgaagctccaacctccagccgagccctccagtaaaaagcatgtacctttcgatgttttactgtcagaagcagagaaagagcttaaccagacaaagattagattggaagacgagaggaaaagcaatgccgaagagaccgctaaggaacgggcacgcatgaaggagatcgaggatgaactgagaagggagtgggaactagagcggaaacgcaaggacgccatggctgatgacctcgccaaagaaactgcgcgaagaagggagatagaccggaaggcacacgagctggatcgtatgcttaaaaagaaagaacgcgagtctctgattgccaaggaaaaggctgacgagaacatgagatcccacgtgcatgaaccaaatacaaccagggccccggcacccacgatcattactaccttgctcatggcttcagccgcgctggccggacctttagagaaccgggagacaaatcatctgctcaaccgaccaggcaacggcgcatatactcttagcgattttgctgaaagtacctgtacactggcctacgggtctgagtgcaaatcctgggaacacttgctaaatgaggagctgttcccctttttccacagcaacctcgacaagtattcgatgctggaagctgccaccgagacggtccctatccttaataaatcttccgcagtgtgtactatctcaccaagtacacacagctccaacgcctgcggacgcgaggcttctgtgattagaaagaaatgttacagcaatatgtcagcgtttttctacataaacctggcaggtcagatcaccgtcgttaagtgcgaaactaatcatgtgttgagttccgattgtggcaactgcattagcaagtctctctcagggcaaaaagtatatacacccgtgcaggacgtcttttgccagaagggatggacccagagtatcccgagcacgaggtactccaaagatatatgttctattggcctgcacaccgtgaaggaatgcaaaatcggtacaacttcgttcgagcgggttgggtttatcgtggtcaagggacgcaagatgtatattgagcaaatgaaaatgagaagcaggcaggaatactccgaggaccagttcttatgttataagtcagaaagtggctctggcagctccgtgaaactgaagaaattcaaggtagagtcatgcaagggggttaccacaagctctgcctccaaatgtagtggagatgaatacttttgcagccgtttcccttgtgagactgctaatgtggaggcccattgcatcctacggcgacactctgcaattgtcgaagtgaacgtcaatggtgtgtgggttgtgcccagatgtataggctatgaggaagtactcgtcaagaggacctccctgaaagtggaggacacaaccgaacgcgagtgcgattcatgtctttgggagtgcgggaagaacaaattgatcgttaagactcatggaccaaaagtggtctacgccacggcttgcagtcacggcagctgtaagtcggtgatgcagaagcctgccacatttgtatacctgccctatccaggtaattccgaaattgttgggggcgacatcggaatccacatgaccgaggaatctagcccctcaaacattcatctcgtggcacactgccctgcgcgggacagttgtgatgtctccgactgcctgttctgtgtgcatggccttctgaattaccaatgccacactttgttttctgctctcctgataagcaccacagtgatgtccatcttaaccctgctactcctgcttgtcaaaggggccaaggatttggttaaaaagctgttccactggctcattactccactgtgttggttatcagtgttttgctgttgggtggtaaaaagctggaagagaagggtcggaagtgcaatctctcgcacaaacgacacgattggttggcgagagaaccggcgtcatgcccaggatatcgagagagctcagtataccggcggggccccgggagcaaagtactccttctttggcgtgatgatactgggtcttttgagctcggctcaatcatgctctgaaagtgttatcgccgactccaaaattatgcagtgtactacaagcgggtctagcaccctctgcaaggcgtccggcacagtgatcatgaggctgggacccattggctcagagagttgcctaatcctgaaagggctcaaggatagcgaaaaacagttcatatctattaagactatctcctcagagctgacctgtcgcgaaggagagagtttttggacgaccctttatacacctatttgcttgagctcccggagatgtcacctgatgggtgagtgcgtctctgacaggtgtttaaagtggaaaactaatcagacctcggccgagttcacaggcaaggctcatggggatgtgatgcacgaaaaccgatgctttgaacaaagcggaggcatcggttacgggtgtttcaatgttaacccatcatgcctctatgtgcattcctacctgaaaagtgtataccgcaatggcttcaaggtctttcggtgtgtggcatggaaccacagaataaggcttgaggtgactacccactctcgtaaattccccatggtcctgatggccatgagcacgcagcctacagactggggatccatcggcttgattctcgattcagaagggatcaccggaactaattcttatagctttatgaagcatggcagtggttccttcgctattatcgacgatccatacagccccgagccgcgcaaggggtttctgggagaggttcggtgccctacagaagagaccgccatgagagcatctccatcatgtaaaatggcgcccaacctagtggaatatcagcctgagatggacactgccgaatgcaccacaaatatgatagaccccatggctattttcaacaggggctccctgccacaggtacgagatggtatgacgtttacccaaagtatcgagaagaatactgtgcaggccctcacaaccggcgaggtcaaagcaagcatccggctgacacttgacgattacgacgtggtttatcagaactcgcagtctgattgctccgctactttcaagaatttgaccgggtgttacagctgcgacgaaggatcacgcctgtgttatcaagtgaaagccgagggcgaaacgatttttcacttcatcaacgaggaggaaagtattaatgtcataaacaaggtgtctcctagagtttccgattactgcacagtgttacattttagcaggcccgtcatctcaattgaggggacctacgactgtggactcagtaaacggccaatggtaatcaagggcactctgattgcaaccgccccgcacgatgaccgaaagcatgaaggtgggagctcccttgtggttaaccctaaaggaggctctgtggatttctttggttggctgagcggcctaacatcctggctcgggggacccctgaagactttcttgaccatcctgggcttcttagctgtcgggctcctgcttgtggtaataatcattatcattatcagaacaggaatgcagcaggcgctgaaaaagaaaataaagtga

SEQ ID NO: 11427 - RNA, 4020 nt, synthetic construct
  misc_feature 1..4020: note = derived and/or modified CDS sequence (opt3) from TOSV(11368)__KU925897.1__GP
  source 1..4020: mol_type = other RNA
atgttcatcgccaagctgctccttattagctgcctggtgcagcaggcttacttgaaatataccataatctccgagacaggcaacgggactagaacgtctttttgttactcaagtaggaccagcttaggatccctgctagaagcatgggacaatgtcacagagtctattggtctcacttcggggacctgcaaggttggctcactggaaaaccgggattgtcgcaaagacatcatgagcaattatgtggccgaggtacacagtaaccttcatggactgggcgcgatgatgcacaattacggtgatgacaagcgagtggaaattttgaacgatgtcatccccgacgagctcaatcctgggcatcacaactgctccgatctggaccgtaaaccattctggacagagtttataaatgtggctaagccgctgtctgaaatggttcccatgagcgtgatccctccacccgtcgtgaagctccagcctccagccgagccctcctcaaagaagcatgtacctttcgatgttttactgagtgaagcagagaaagagcttaaccagaccaagattagattggaagacgagaggaaaagcaatactgaagagacagccaaggaacgggctcgcatgaaggagatcgaggatgaactgagaagggagtgggaactagagcggaaacgcaaggacgcaatggccgatgacctcgctaaagaaaccgcccgaagaagggagattgagcggaaggcgcacgaactggacaaaatgcttaagaaaaaggagcgtgaatctctgatcgcaaaggagaaagccgatgaagacatgcgctcccacgtgcataagccaaacacgactagagctttggccccgaccataattacaactctcctgatggcatcagctgccttagcgggacccctggagaatagggagaccaaccacctccttaatcggcctggcaacggcgcctatacactgagcgattttgcagaaagtacctgtacgttggcttacgggtctgagtgcaaatcctgggaacatctactgaacgaggagcttttcccatttttccacagcaatctggacaagtattcgatgcttgaagccgctactgagacagtccccatcctgaacaaatcttccgccgtgtgtaccatttcacctagtactcacagctccaatgcatgcggacgagaagcctctgtgatccgcaagaagtgttacagcaacatgtcagcgtttttctacatcaatttggctggtcagattacagtcataaaatgcgagaccaaccatgttctcagttccgattgtggcaattgcatcagcaagtctctgtcagggcaaaaagtgtatacgccagtacaggacgtgttttgccagaagggatggacccagagtattcccagcacaagatactccaaagatatctgttctataggcttacacactgtcaaggaatgcaagattggtaccacatcgttcgagagggtggggtttatcgttgtgaaaggacggaagatgtatatcgagcaaatgaaaatgcgcagcagacaggaatactccgaggaccagttcctgtgttataagtcagaaagtggctctggcagctccgtcaaactaaagaagttcaaagtgcagtcatgcaagggggtaactaccagctctgcatccaaatgtagtggagatgagtacttttgcagcaggtatccgtgtgaaacagccaacgttgaggctcattgcattctccgtcggcactctgccatcgtggaggtcaatgtgaacggtgtctgggtggttcctcgatgtattggctacgaagaggtgctggtaaagagaacctcccttaaagtcgaagacactacggggagggagtgcgattcatgtttgtgggaatgcggaaagaataaactgatagtgaagacacatggccccaaggttgtgtacgcaaccgcctgcagtcacggtagctgtaaatcggtcatgcaaaagccagctactttcgtgtatctcccttaccccgggaactccgagatcgtaggcggagacattggcatccacatgaccgaggaatctagcccatcaaatatccatctggtggcccactgccccgcacgcgacagttgtgatgtttccgactgcctcttttgtgtccatgggctgttgaactatcagtgccacacactcttctctgcgctgttaattagcaccactgtgatgtccatactgacactactcctgcttttggtgaaaggagctaaggatctggtcaaaaagctctttcactggctgatcacgcctttatgttggctgtcagttttctgctgttgggtggtgaaaagctggaaacggagagtaggtagtgccatttctaggaccaatgacactatcggctggcgcgagaaccgacggcatgcacaggatattgaacgtgcccaatacacagggggagctccaggcgccaagtattccttttacggtgtcatgatccttgggttgctcagctcggcacagtcatgctctgagagtgtgatagctgactccaaaatcatgcagtgtaccacaagcggctctagcactctgtgcaaggcctccggaaccgttattatgagactaggcccgatcgggtcagagagttgcctgattctcaaaggactgaaggatagcgaaaagcagttcatctctataaaaacgatttcctcagagcttacctgtagggaaggtgagagtttttggacaactttgtatacccccatctgcctgagctcccgccggtgtcacttaatgggcgaatgcgtgtctgacagatgtctcaagtggaaaacaaaccaaacttcggcggagttcaccgggaaggcccatggagatgtcatgcacgagaataggtgctttgaacagagcggcggtattgggtacggctgtttcaacgtgaatccttcatgcctgtacgttcattcctatcttaaaagtgtgtaccgaaacggatttaaggtattccgctgtgtcgcttggaatcaccggatcagactggaggtgacgacacactctaggaagttcccaatggtgttgatggcaatgagcacccagcccactgactggggctccatagggctcatcctggattcagaaggaattacaggcaccaactcttatagctttatgaaacatggtagtgggtccttcgccatcattgacgatccttacagcccagagccccgtaagggatttctaggcgaagtccgctgcccgactgaggagaccgctatgcgggcctctccttcatgtaaaatggcaccaaatctgatcgaatatcagcccgagatggacacagcggaatgcacgaccaacatgatagaccctatggccattttcaatagaggttccctcccccaagttagggatggcatgacttttacacagagtatcgagaagaacaccgtgcaggctctgacaactggggaagtaaaagccagcatccgacttattttggacgattacgacgtggtctatcaaaattcgcaatctgattgctccgcaaccttcaagaacctgacgggatgttacagctgcgacgagggctcacggttatgttaccaggtgaaagctgagggggaaacaatctttcacttcattaatgaggaagagagtataaacgttatcaataaggtgtctccaggagtctccgattattgcaccgtgctccattttagccgccctgttatttcaatcgagggcacttacgactgtggtctgagtaagagacccatggtgattaaagggacccttatcgccacagcaccacacgatgacaggaagcatgaaggaggcagctccctggtcgtaaacccgaaaggtggctctgtggatttctttgggtggctaagcggactcacttcctggctgggcgggcctttgaagaccttcctgacaatattaggatttctcgccgttggcctgcttctggtggtcatcattatcattatcatacggacgggtatgcagcaggctttgaaaaagaagattaaatga

SEQ ID NO: 11428 - RNA, 4020 nt, synthetic construct
  misc_feature 1..4020: note = derived and/or modified CDS sequence (opt3) from TOSV(5904242804)__KU935737.1__GP
  source 1..4020: mol_type = other RNA
atgttcatcgccaagttactccttattagctgcctggtgcagcaggcttacttgaaatataccataatctccgagattggcaacgggacaagaacttctttttgttactcaagtaggacgagcttaggatccctgctagaagcatgggacaatatcaccgagtctattggtctcacatcgggcacttgcaaggtcgggtcactggaaaaccgggattgtaaacgcgacatcatgagcaattatgttgccgaggtgcacagtaaccttcatggactgggcgcgatgatgcacaattacggtgatgacaagcgagtagaagtgttgaacgatgtcatacccgacgagctcaatcctgggcgtcataactgctccgatctggacagaaaaccattctggaccgagtttatcgatgtggctaagccgacaaataagattgcccccatgtctgttatccctccacccattgtgaaacctatcccagtcgcagaaagcaccataaagaaatccattcccttcgacaagctgctctcagaggccgaaaaagagttaaaccagactaagatcaggctggagacagaacggcgcagtaatgctgaggaagcagccaaggagagagctaggatgcgggaaattgaggataaacttcgcaaggactgggagttggaacgagagagaaaagatgccgtggcggacgacctggcaaaggaaatcgccaggcggcgtgagatcgaacgcaaagctcacgagctagataagatgctcaaaaagaaggagagagaagacctggtagccagggagcgggttagcgaagatatgcgaaaccatgtgcgcaaacctaataccacgattgcaccagctccgactataatcaccacacttctgatggcctctgcggtcatggccggacccttggagaacagagaaactaatcacctcctgaacaggcctggcaacggcgcatataccttatccgactttgctgagtcaacatgtaccctggcctacgggagcgagtgcaagagttgggaacaccagctcgatgagctttctttcccatttttccattccaatctggacaaatatagcatgttggaagctgccacggagactattcccatcctaaacaagtcgtctgcagtgtgtacaatatccccttcaacccacagtagcaatgcctgcggacgggaggcttccctgattaaaaagaagtgtggttctaacatgagcgcgtttttctacgtgaatctcgcaggccagatcactgtcgttaaatgcgatacaaaccatgtgctgtcaaatgactgtgggaactgcatcagtaagaccctttccggacaaaagatttacacgccagtacaggatatgttttgccagaagggctggaccgaaagcatccccaatacacgctattctaaagacctgtgttcaattggtttgcacactgtgaaggagtgcaagaccgggacaactaacttcgaaagagtcggatttatagtggttgagggcaggaaaatgtacatcgaacagatgaagatgcgtagtcggcaagagttcagcgaggatcagttcctctgttataaatccgaatcttcgagcggctcctcagtgaagctgaaaaaggtcaaggtggagagttgcaaaggggtaaccacatctagcgcctccaagtgttcaggagacgaatacttttgcagccgatatccgtgtgagaccgctaatgttgaagcccactgcattttaagaaggcattctgcagtgatcgaggtcaacgtgaatggtgtctggatcgtgcctcgctgtattggctacgaggaagttctggtgcggagaacttccctaaaagtagaggacacgagtagcagggaatgcgatacatgtctctgggagtgcgggaagaacaaactgatagtcaagacccacggacccaaaatcgtgtatgccactgcttgctctcatggctcctgtaagtcagttatgcagaagccagccaccttcgtgtaccttccttaccccggtaatagtgaaattgtcgggggcgacatcggagtgcacatgacagaggagagctcgccatccaacattcatatggtagcacactgccccgcgaaagattcttgtgaagtgagctcatgcttgttttgtgttcacggcctgctcaactatcagtgccataccctgttcagtgcccttctgatctccactacagtcatgtctatattgacgctcctgttactgctagtgaagggggctaaagacctcgtgaagcgcctgttttactggcttatcacccctttgtgttggctgagcgtcttctgcggatgggttattaaatcctggaagaagcgagtgggttcagcaatcagccggactaatgatacaattggctggcgtgacaacagaaggtatcgccaagatgtggagcgggcccagtacaccgggggagctccaggcgccaaatatagtttttacggtgtaatggtcctcgggctgttaggcaatgtgcactcttgttccgaaagcatcatagcagactcgaagattatgcagtgcacaacttcaggatctagtaccctgtgtaaagctagcggcacggttatcatgaaacttgggccgattggaagcgagtcttgcttgatcctcaaaggtctgaaggatagcgagaagcaattcatatccatcaaaaccatttcaagtgaactaacatgcagagagggcgaatccttttggactaccctgtatacacccgtgtgtctctcttccaggcgatgccatctgatgggggagtgtgtctcagaccgctgccttaagtggaaaactaacgaaaccagtgccgagttcacgggaaaggcgcacggcgaggtggttcacgaaaatcggtgttttgagcagagcggtgggatcggctacggatgcttcaacgtgaatccttcctgtttgtacgtacattcttatctgaaatcggtctacaagaacggctttaagattttcagatgcgtggcctggaatcacaggatccgtttagaagtgacaacccatagccgcaaattcccaatggtcctcatggctatgtcaactcagcccacagattgggggtccataggactgattcttgacagtgagggcatcaccggtactaacgcatattcttttatgaagcacgggagcggatccttcgccatcattgatgacccttactcaccagaaccccggaaaggctttctgggtgaggttagatgtccgaccgaggaaacagctatcagggcctctcctagctgcaagatggcaccaaatttgattgagtatcagcccgaaatggacacggcggagtgtaccactaacatgatagatcctatggccatcttcaatcgaggcagtctcccccaagtgcgggacgggatgacatttacccagtccattgagaaaaacacagtacaggctctgactaccggagaagtgcgcgccagcatcagactaacgctggatgactacgatgtcgtgtatcaaaattctcaatcagactgctccgcaacattcaagaacctcaccggctgctacagttgtgatgaggggagcaggatgtgctaccaggttaaagctgaaggagagactatttttcatttcatcaacgaagacgagtcgataaatgtgatcaacaaggtcaatccagatgtgtctgactattgtaccgttctgcacttttcccggcctgtgattagcatcgagggccgatacgattgcggtctttcaaagagacccatggtcattaaagggacattgatcgccactgcaccacacgacgatcgcaagcatgaaggaggcagttctctgatagtaaacccgaaaggtggcaccgtggacttctttgggtgggtttccggattaacaagctggctcggcgggcctctgaagacgttccttaccattctgggatttctagccctcggcctgttgctggtggtcatcatcattataatcgctaggactggtgtgcagcaggcgctgaaaaagaagaataaatga

SEQ ID NO: 11429 - RNA, 4020 nt, synthetic construct
  misc_feature 1..4020: note = derived and/or modified CDS sequence (opt3) from TOSV(5963930705)__KU935734.1__GP
  source 1..4020: mol_type = other RNA
atgttcatcgccaagctgctccttattagctgcctggtgcagcaggcttacttgaaatataccataatctccgagattggcaacgggacaagaacttctttttgttactcaagtaggacgagcttaggatccctgctagaagcatgggacaatgtcaccgagtctatcggtctcacatcgggcacttgcaaggttgggtcactggaaaaccgggattgtcgcaaagacattatgagcaattatgtggccgaggtacacagtaaccttcatggactgggcgcgatgatgcacaattacggtgatgacaagcgagtggaaatcttgaacgatgtcatacccgacgagctcaatcctgggcatcacaactgctccgatctggaccgtaaaccattctggaccgagtttatcaatgtggctaagccgctgggagaaattgttcccatgtctgtgatccctccacccgtcgtgaagctccaacctccagccgagcccagctccaaaaagcatgtacctttcgatgttttactgtcagaagcagagaaagagcttaaccagacaaagattagattggaagacgagaggaaaagtaatgccgaagagaccgctaaggaacgggcacgcatgaaggagatcgaggaggaactgagaagggaatgggagctagaacggaaacgcaaggatgccatggctgacgatctcgccaaagagactgcgcgaagaagggagatagaacggaaggcacacgagctggaccgtatgcttaaaaagaaagaacgcgagagcctgattgccaaggaaaaggctgacgaggatatgagatctcacgtgcataaaccaaacacaaccagggccccggcacccacgatcattactaccttgctcatggcttccgccgcgctggccggccctttagagaatcgggaaacaaaccatctgctcaatcgaccaggcaacggggcatatactctttcagactttgctgagagcacctgtacactggcctacggaagtgaatgcaagtcttgggagcacttgctaaacgaggaactgttcccctttttccactccaatctcgataaatatagcatgctggaggctgccaccgaaacggtccctatccttaacaagtcgtctgcagtgtgtactatctccccatcaacacacagtagcaatgcctgcggtcgcgaggcttccgtgattaggaaaaagtgttactctaacatgagcgcgtttttctacataaatctggcaggccagatcaccgtcgttaagtgcgaaactaaccatgtgttgtcaagtgactgtgggaattgcatttccaaaagcctctctggacaaaaggtatatacacccgtgcaggatgtcttttgccagaaaggctggacccagtcaatcccgagtacgagatacagcaaggacatatgttccattggtctgcacaccgtgaaagagtgcaagatcgggacaacttctttcgagcgggttggatttatcgtggtcaagggccgcaaaatgtatattgaacaaatgaagatgagatcgaggcaggagtacagcgaagatcagttcttatgttataaatccgagtcaggcagtgggtctagcgtgaagctgaaaaagttcaaggtagaatcctgcaaaggagttaccacatcaagcgcctctaagtgttccggtgacgagtacttttgcagtcgttatccttgtgaggctgccaacgtggaagcacattgcatcctacggcgacacagcgccattgtcgaggtgaatgtcaacggcgtgtgggttgtgcccagatgtatagggtacgaagaggtactcgtcaaaaggacttctctgaaggtggaagataccacagagcgcgagtgcgactcctgtctttgggaatgcgggaaaaataagttgatcgttaaaacccatggcccaaaggtggtctacgctactgcctgctcacacggtagttgtaagagcgtgatgcagaaacctgcaacgttcgtatatctgccctacccagggaactcggagattgtgggcggagatatcggcatccacatgacagaagagtcctctcccagcaatattcatctcgttgcgcactgccctgctcgggactcatgtgacgtcagtgattgcctgttttgtgtgcatgggcttctgaactatcaatgccacaccttgttctccgccctcctgatatctactaccgtgatgagcatcttaacactgctactcctgcttgtcaagggagcaaaagacttggttaagaaactgtttcactggctcattaccccactgtgttggttatccgtgttctgctgttggatggtgaagtcatggaagagaagggtaggtagcgccatcagtcgcactaatgatacaattggctggcgagagaaccggcgtcatgctcaggacatcgaaagagcccagcacacgggaggagcaccgggcgctaaatactctttttatggtgtcatgatactggggcttttgtccagcgcccaatcgtgctcagagtctgtgatcgcggatagtaagattatgcagtgtaccacttccggcagctctacactctgcaaagccagcggaaccgttatcatgaggctgggccccattgggtccgaatcatgcctaatcctgaagggactcaaagacagtgagaagcagttcataagcattaagacaatctcttccgaactgacttgtcgcgagggtgagtcattttggaccacgctttacacccctatttgcttgagtagccggagatgtcatctgatgggcgaatgcgtgtccgataggtgtttaaaatggaagacaaaccagacttctgctgagttcaccgggaaagcacacggagacgtcatgcatgaaaatcgatgctttgagcaatcgggcggtatcgggtatggctgtttcaacgtgaatccaagctgcctctacgttcactcatacctgaagtccgtgtatcgcaacggatttaaagtattccggtgtgtcgcctggaatcacagaataaggcttgaagtgacaactcatagtcgtaagttccccatggtgctgatggctatgtctacccagcctacggattggggcagcatcgggttgattctcgactccgagggaatcacaggcaccaactcatactcttttatgaagcacggtagcgggagtttcgccattatcgatgacccatattcccccgagccgcgcaaaggatttctgggcgaagtccggtgccctactgaggaaacagcaatgagagcgagcccatcttgtaagatggcccccaatctaatagagtaccagcctgaaatggataccgctgagtgcactaccaacatgattgaccccatggccatcttcaataggggttcactgccacaggttcgagacggcatgacatttacgcaatccatcgagaaaaacaccgtgcaggcactcactacaggggaagtaaaggctagtattcggctgacccttgatgactatgatgtggtctaccagaatagccagtcggactgctctgccacattcaaaaacttgactggatgttattcctgcgatgagggcagccgcctgtgttaccaagtgaaggcagaaggggagaccatctttcatttcattaatgaggaagagtcaataaacgttatcaataaagtgagtcctggagtctctgactactgcacggtgttacacttttccagccccgttatttcaatcgaaggcacatatgattgtggtctcagtaagagaccaatggtgattaaggggaccctgatcgccactgctccgcatgacgataggaaacacgagggaggcagctcccttgtcgtaaaccctaagggtggctctgtggacttctttgggtggctgagcggactaacctcctggctcggcgggcccctgaaaacattcttgactatactgggatttttagcggttggcctcctgcttgtggtcatcattatcattatcatacggaccggtatgcagcaggccctgaagaaaaagattaagtga

SEQ ID NO: 11430 - RNA, 4020 nt, synthetic construct
  misc_feature 1..4020: note = derived and/or modified CDS sequence (opt3) from TOSV(H4906)__KU922125.1__GP
  source 1..4020: mol_type = other RNA
atgttcatcgccaagctgctccttattagctgcctggtgcagcaggcttacttgaaatataccataatctccgagattggcaacgggacaagaacttctttttgttactcaagtaggacgagcttaggatccctgctagaagcatgggataatgtcaccgagtctatcggtctcacatcgggcacttgcaaggttgggtcactggaaaaccgggattgtcgcaaagacattatgagcaattatgtggccgaggtacacagtaaccttcatggactgggcgcgatgatgcacaattacggtgatgacaagcgagtggaaatcttgaacgatgtcatacccgacgagctcaatcctgggcatcacaactgctccgatctggaccgtaaaccattctggaccgagtttatcaatgtggctaagccgctgtctgaaattgttcccatgagcgtgatccctccacccgtcgtgaagcctcagccacccgccgagccttcctcaaagaagcatgtaccattcgatgttctcttaagtgaagcagagaaagagctgaaccagacaaagattagacttgaagacgagaggaaaagcaatgccgaagagaccgctaaggaacgggcacgcatgaaggagatcgaggatgaattgagaagggagtgggaactggagcggaaacgcaaggacgccatggctgatgacctagccaaagaaactgcgcgaagaagggagatagagcggaaggcacacgaactcgaccgtatgctgaaaaagaaagagcgcgaatctcttattgccaaggagaaggctgatgaagacatgagatcccacgtgcataaaccgaacacaaccagggcccccgcacctacgatcattactaccctgttgatggcttcagccgcgctcgccggaccactggagaatcgggagacaaaccacttactgaatcgacccggcaacggcgcatatactctcagcgattttgctgaaagtacctgtacacttgcctacgggtctgagtgcaagtcctgggaacatctgttgaacgaggagctattcccatttttccacagcaatctggacaaatattcgatgctcgaagctgccaccgagacggtccctatcctgaacaagtcttccgcagtgtgtactatctcacccagtacacacagctccaatgcctgcggacgcgaggcttctgtgattaggaaaaagtgttacagcaacatgtcagcgtttttctacataaatcttgcaggtcagatcaccgtcgttaagtgcgaaactaaccatgtgctgagttccgattgtggcaattgcattagcaaatctttgtcagggcaaaaggtatatacaccggtgcaggacgtcttttgccagaaaggatggacccagagtatccctagcacgagatactccaaggatatatgttctattggcctccacaccgtgaaagaatgcaagatcggtacaacttcgttcgagcgggttgggtttatcgtggtcaagggacgcaaaatgtatattgagcaaatgaagatgagaagcaggcaggaatactccgaggaccagttcctgtgttataaatcagaaagtggctctggcagctccgtgaagctgaaaaagttcaaggtagagtcatgcaaaggggttaccacaagctctgcctccaagtgtagtggagatgaatacttttgcagccgtttcccctgtgagactgctaacgtggaggcccattgcatcttacggcgacactctgcaattgtcgaagtgaatgtcaacggtgtgtgggttgtgccaagatgtataggctatgaggaagtgctagtcaaaaggacctccctcaaggtggaggacacaaccgaacgcgagtgcgattcatgtctgtgggagtgcgggaaaaataaacttatcgttaaaactcatggacctaaggtggtctacgccacggcttgcagtcacggcagctgtaagtcggtgatgcagaaacccgccacatttgtatacttgccatatcccggtaactccgaaattgtagggggcgacatcggaatccacatgaccgaggaatctagcccttcaaatattcatctggttgcacactgcccagcgcgggacagttgtgatgtctccgactgcctcttctgtgtgcatggcctgcttaactaccaatgccacactctgttttctgctttgctcataagcaccacagtgatgtccatcctgaccttactgctactcctggtcaagggggccaaagatcttgttaagaaattgttccactggctgattactccgctctgttggctgtcagtgttttgctgttgggtggtaaagagctggaagagaagggtcggaagtgcaatctctcgcacaaatgacacgattggttggcgagagaaccggcgtcatgcccaggatatcgagagagctcagtataccggcggggcccccggagcaaaatactccttctatggcgtgatgatattaggtctgcttagctcggctcaatcatgctctgaaagtgttatcgccgactccaagattatgcagtgtactacaagcgggtctagcaccttgtgcaaagcgtccggcacagtgatcatgaggctcggacctattggctcagagagttgcctgatcctaaaggggctgaaagatagcgaaaagcagtttatatctattaagactatctcctcagagctcacctgtcgcgaaggagagagtttctggacgaccctgtacacaccaatttgccttagctcccggagatgtcacttgatgggtgagtgcgtctctgacaggtgtctgaaatggaagactaaccagacctcggccgaatttacaggcaaagctcatggggatgtgatgcacgagaatcgatgcttcgaacaaagcggaggcatcggttatgggtgttttaacgttaatccctcatgcttatacgtgcattcctacctcaagagtgtatatcgcaacggcttcaaagtcttccggtgtgtggcatggaatcacagaataaggctggagatgactacccactctcgtaagtttcctatggtgcttatggccatgagcacgcagccaacagactggggatccatcggcctgattttggattcagaagggatcaccggaactaactcttacagcttcatgaagcatggcagtggttcctttgctattatcgacgatccctatagcccggagcctcgcaaagggttcctcggagaggtccggtgcccaacagaagagaccgccatgagagcatctccctcatgtaagatggcgcctaatctgatagaataccagcccgagatggacactgccgaatgcaccacaaacatgattgacccaatggctatctttaataggggctccctacctcaggttcgagatggtatgacgttcacccaaagtatcgagaaaaacactgtgcaggccctgacaaccggcgaggtaaaggcaagcattcggctcacactggacgattatgacgtggtctaccaaaattcgcagtctgattgctccgctacttttaaaaaccttaccgggtgttatagctgcgacgaaggatcacgcttgtgttaccaagtgaaggccgagggcgaaacgatcttccactttattaatgaggaggaaagtataaacgttatcaataaagtgaaccccggggtctctgattactgcacagtgctgcatttctccagaccagttattagcatcgagggaacctatgactgtggcttatcaaagaggccgatggtgattaagggtactctcatcgcaaccgcccctcacgatgaccggaaacatgaagggggaagtagcctggtcgtaaaccccaagggcggttccgtggactttttcggctggctttctgggctgacaagctggctaggaggcccactcaaaacttttctgaccatattggggttcctggctgttggattactcctggtggtcatcattatcattatcatacgaacaggcatgcagcaggcgcttaagaaaaagattaagtga

SEQ ID NO: 11431 - RNA, 4020 nt, synthetic construct
  misc_feature 1..4020: note = derived and/or modified CDS sequence (opt3) from TOSV(MRS2010-4319501)__KC776215.1__GP
  source 1..4020: mol_type = other RNA
atgttcatcgccaagctgctccttattagctgcctggtgcagcaggcttacttgaaatataccataatctccgagattggcaacgggacaagaacttctttttgttactcaagtaggacgagcttaggatccctgctagaagcatgggacaatgtcaccgagtctatcggtctcatttcgggcacatgcaaggttgggtcactggaaaaccgggattgtcgcaaagacatcatgagcaattatgtggccgaggtacacagtaaccttcatggactgggcgcgatgatgcacaattacgctgatgacaagcgagtggaaatattgaacgatgtcatccccgacgagctcaatcctggtcatcacaactgctccgatctggaccgtaaaccattctggactgagtttattaatgtggccaagccgctgtctgaaatcgttcccatgagcgtgattcctccacccgtcgtgaagctccagcctccagcagagccctccagcaaaaagcatgtacctttcgatgttttactgagtgaagccgagaaagagcttaaccagaccaagatcagattggaagacgagaggaaaagcaatgctgaagagacagcaaaggaacgggcccgcatgaaggagatagaggatgaactgagaagggagtgggaactagagcggaaacgcaaggacgctatggccgatgacctcgcgaaagaaaccgcacgaagaagggagattgagcggaaggcccacgaactggaccgtatgcttaaaaagaaagagcgcgaatctctgatcgctaaggagaaggccgatgaagacatgagatcccacgtgtataaaccaaacactacaagggcaccggctcccaccattatcacgactttgctcatggcctcagcggccctggcagggcctttagagaatcgggagaccaaccatctgctcaatcgaccaggaaacggcgcttacacacttagcgattttgccgaaagtacttgtaccctggcttatggctctgagtgcaagtcctgggaacacttgctaaacgaggagctgttcccctttttccatagcaatctcgacaaatactcgatgctggaagccgcaacagagaccgtccctatccttaacaagtcttccgccgtgtgtacgatttcaccaagtactcacagctccaatgcttgcgggcgcgaagcgtctgtgataaggaaaaagtgttacagcaacatgtcagcatttttctatatcaatctggccggacagattacagtcgttaagtgcgagaccaaccacgtgttgagttccgattgtggtaattgcatcagcaaatctctctcaggccaaaaggtatacactcccgtgcaggacgtcttttgccagaaagggtggacacagagtataccgagcaccaagtattccaaagatatttgttctatcggactgcatacggtgaaggaatgcaagatcggcattacctcgttcgagagagttggttttatcgtggtcaaagggcggaagatgtacattgagcaaatgaaaatgcgcagcagacaggaatattccgaggaccagttcttatgttacaagtcagaaagttctagcggatcctcagtgaaactgaagaagttcaaagtagagagctgcaagggcgttacaacttcttccgctagtaaatgtagcggcgatgaatatttttgctctaggtacccttgtgagaccgccaacgtggaggcacactgcatactacgtcggcattccgccatcgtcgaagtgaatgtcaacggggtgtgggttgtgccccgatgtattggatacgaggaagtactcgtcaagagaacatcactgaaagtggaggacactaccggtagggaatgcgatagttgtctttgggagtgcggcaagaataaattgatcgttaagacacacgggccaaaggtggtctatgctaccgcctgcagccatggatcgtgtaaatccgtgatgcagaagcctgcaactttcgtatacctgccctatccaggcaactctgagatcgtgggtggggacattggcatacacatgacggaagagagctcacccagtaatatccacctcgttgcgcattgccctgctcgcgactcctgtgatgtctctgactgcctgttttgtgtgcacggacttctgaactaccaatgccatacattgttcagcgccctcctgatttccaccactgtgatgtcaatcttaaccctgctactcctgcttgtcaaaggcgcaaaggatttggttaaaaagctgtttcactggctcattacaccactgtgttggttaagcgtgttctgctgttgggtggtaaagagttggaaacggagagtcgggtctgccatctccaggaccaatgacactataggatggcgcgaaaaccgacggcacgctcaggatatcgagcgtgcccagtatacaggtggcgcaccgggggctaagtacagcttttatggagtgatgattctgggccttttgtcgtcagcccaatcttgcagtgagtccgttatcgcggacagcaaaattatgcagtgtacgacctctggtagctccactctctgcaaggcctcagggacagtgatcatgagagtcggccccataggaagtgaaagctgcctgattctaaaaggcctgaaggattctgagaagcagttcatctccattaaaaccatctcaagtgaactcacatgtagggagggggaatcattttggactaccctgtacacgcctatatgcctttcctctcgccggtgtcatttgatgggagagtgcgtgtcggacagatgtctgaagtggaaaaccaaccagacaagcgctgagttcactggtaaggcacacggcgatgttatgcatgaaaataggtgctttgagcaatcagggggaatcggctacggttgtttcaacgtgaatccatcctgcttatatgtacacagttacctcaaatctgtctatcgaaacgggtttaaggtgttccgctgtgtggcctggaatcatcggattagactggaagtcaccacacacagcaggaagttccccatggttcttatggctatgtccactcagcctaccgactggggctcaatcggactgattttggattctgagggcgtgacggggacaaacagctacagttttatgaaacacggatccggcagcttcgccatcatagacgatccatattctcccgaaccgcgtaagggttttctcggggaggtacgctgccctaccgaggaaactgcaatgcgggcgtcaccatcctgtaaaatggcccccaatctgattgagtaccagcctgaaatggacacagctgagtgcaccactaacatgatcgaccccatggccatcttcaatagaggaagtctaccacaggtgagggatggcatgacctttacacaaagcattgaaaagaacacggtccaggcactgaccactggtgaggtgaaggcttcgatccgactcacactggacgattatgacgttgtgtaccaaaattctcagtccgattgcagcgccaccttcaaaaaccttacaggctgttactcatgcgacgaggggagtcggttgtgttatcaagtcaaagcagaaggagagactatttttcatttcataaatgaagaggagtctatcaacgtgattaataaggtttcccctggcgtgagcgattactgcaccgtcctgcacttttcacgccccgtaatcagtattgaagggacgtatgactgtggattaagcaagagaccaatggtgatcaaaggcacactcatagccaccgctccgcatgatgacaggaagcacgagggtgggtcctctctggttgtgaaccctaaaggaggcagcgtcgatttctttggttggctttccggcctgacttcatggctagggggacccctcaagaccttcctgacaatcttgggctttctggcggtggggttactcctggtagtgattatcattatcataattcggactggaatgcagcaggcccttaaaaagaagatcaaatga

SEQ ID NO: 11432 - RNA, 4020 nt, synthetic construct
  misc_feature 1..4020: note = derived and/or modified CDS sequence (opt3) from TOSV(Nice/113)__KU204982.1__GP
  source 1..4020: mol_type = other RNA
atgttcatcgccaagctgctccttattagctgcctggtgcagcaggcttacttgaaatataccataatctccgagattggcaacgggacaagaacttctttttgttactcaagtaggacgagcttaggatccctgctagaagcatgggacaatgtcaccgagtctatcggtctcacatcgggcacttgcaaggttgggtcactggaaaaccgggattgtggaaaagacattatgagcaattatgtggccgaggtacacagtaaccttcatggcctgggtgcgatgatgcacaattacggggatgacaagcgcgtggaaatcttgaacgatgtcatacccgacgagctcaatcctggacatcacaactgctccgatctggaccgaaaaccattctggaccgagtttatcaatgtggctcgtccgctgtctgaaattgcccccatgagcgttatccctccacccgtggtcaagctccagcctccagcagagccctcctcaaagaaacatgtgcctttcgatgtattactgagtgaagccgagaaggagcttaaccagacaaaaattagattggaagacgagaggaaaagcaatgctgaagagaccgcaaaggaacgggcccgcatgaaggagatcgaggatgaactgagaagggagtgggaactagagcggaagcgcaaagacgctatggccgatgacctcgcgaaggaaactgcacgaagaagggagatagagcggaaagcccacgaactggaccgtatgcttaagaaaaaggagcgcgaatctctgattgctaaagagaaggccgatgaagacatgagatcccacgttcataagccaaacacaaccagggcaccggctcccacgatcattactaccttgctcatggcctcagcggccctggcaggccctttagagaatcgggagacaaaccatctgctcaatcgaccaggcaacggggcttatactcttagcgattttgccgaaagtacctgtacactggcttacggatctgagtgcaaatcctgggaacacttgctaaacgaggagctgttcccctttttccacagcaatctcgacaagtattcgatgctggaagccgcaaccgagacggtgcctatccttaacaaatcttccgccgtctgtactatctcaccaagtacacacagctccaatgcttgcggtcgcgaagcgtctgtgattagaaagaaatgttacagcaacatgtcagcatttttctacataaatctggccggccagatcaccgtggtcaagtgcgagactaaccatgttttgagttccgattgtgggaattgcattagcaagtctctctcaggacaaaaagtgtatacacccgtacaggacgtgttttgccagaagggctggacccagagtatcccgagcacgaggtactccaaagatatatgttctattggtctgcacaccgtcaaggaatgcaaaatcgggacaacttcgttcgagcgggtgggatttatcgttgtgggcggccgcaagatgtatattgagcaaatgaagatgagaagcaggcaggaatactccgaggaccagttcttatgttataaatcagaaagtgggtctggaagctccgtcaagctgaaaaagttcaaagtggagtcatgcaagggtgtaaccacaagctctgcttccaagtgtagtggcgatgaatacttttgcagccgttatccttgtgagactgccaacgttgaggcacattgcatcctacggcgacactctgccattgtggaagtcaatgtgaacggggtctgggtggttcccagatgtataggatacgaggaagtgctcgtaaaaaggacctccctgaaggtcgaggacacaaccgaacgcgagtgcgattcatgtctttgggagtgcggcaaaaataagttgatcgtgaaaactcatggtccaaaggttgtgtacgctacggcctgcagtcacgggagctgtaaatcggtcatgcagaagcctgcaacattcgtgtatctgccctacccaggcaactccgaaattgtaggaggcgacatcgggatccacatgaccgaggaatctagcccctcaaatattcatctcgtggcgcactgccctgctcgggacagttgtgatgtttccgactgcctgttttgtgtccatggacttctgaactatcaatgccacactttgttctctgccctcctgataagcaccacagtgatgtccatcttaaccctgctactcctgcttgtgaagggtgcaaaagatttggtcaagaaactgttttactggctcattactccactgtgttggttatcagttttctgctgttgggtgatcaagagctggaaaagaagggtgggcagtgccatttctcgcacaaatgacacgatcgggtggcgagagaaccggcgtcacgctcaggatatagagagagcccagtataccggaggcgcaccgggtgctaagtactccttttatggggtaatgatcctgggccttttgagctcggcccaatcatgctctgaaagtgtcattgcggactccaagatcatgcagtgtactacaagcggatctagcaccctctgcaaagcctccggcacagtgattatgaggctggggcccatcggatcagagagttgcctaatactgaagggtctcaaagatagcgaaaagcagttcatttctatcaaaactatttcctcagagctgacctgtcgcgaaggcgagagtttttggacgaccctttacacacctatctgcttgagctcccggagatgtcatctgatgggggagtgcgtttctgacaggtgtttaaagtggaagactaaccagacctcggctgagttcacaggaaaagcacacggcgatgtgatgcatgaaaatcgatgctttgaacaaagcggtgggataggctacggatgtttcaacgtcaatccatcatgcctctatgtgcactcctacctgaagagtgtttatcgcaacggctttaaagtgttccggtgtgtagcctggaatcatagaatcaggcttgaggtcactacccactctcgtaagttccccatggtgctgatggctatgagcacgcagcctacagactgggggtccattggattgatcctcgattcagaaggcattaccggtactaactcttacagctttatgaaacacgggagtggatccttcgccatcatagacgatccatatagccccgagccgcgcaagggctttctgggtgaggtgcggtgccctacagaagagaccgcaatgagagcgtctccatcatgtaagatggcccccaatctaattgaataccagcctgagatggacactgctgaatgcaccacaaacatgatcgaccccatggccatcttcaataggggctccctgccacaggtccgagatgggatgacgtttacccaaagtattgagaaaaacactgttcaggcactcacaaccggagaggtgaaggctagcatccggctgacacttgacgattatgacgtagtgtaccaaaattcgcagtctgattgctccgccactttcaaaaacttgaccggctgttacagctgcgacgaagggtcacgcctgtgttatcaagtcaaggcagagggagaaacgatttttcatttcataaatgaggaggaaagtatcaacgtgattaataaagtttctcctgaggtgtccaactactgcacagtcttacactttagcagacccgtgatctcaattgaaggcacctatgattgtggtctcagtaagaggccaatggttatcaaagggactctgatagccaccgctccgcatgacgatcggaagcacgagggaggcagctcccttgtggtcaaccctaagggtggctctgtagacttctttgggtggctgagcggactaacatcctggctcggcgggcccctgaaaactttcttgaccatcctgggatttttagcggtgggcctcctgcttgttgtgattatcattatcataattcgaacaggtatgcagcaggccctgaagaaaaagatcaaatga

SEQ ID NO: 11433 - RNA, 4020 nt, synthetic construct
  misc_feature 1..4020: note = derived and/or modified CDS sequence (opt3) from TOSV(P233)__KU204976.1__GP
  source 1..4020: mol_type = other RNA
atgttcatcgccaagctgctccttattagctgcctggtgcagcaggcttacttgaaatataccataatctccgagattggcaacgggacaagaacttctttttgttactcaagtaggacgagcttaggatccctgctagaagcatgggacaatgtcaccgagtctatcggtctcacatcgggcacttgcaaggttgggtcactggaaaaccgggattgtcgcaaagacattatgagcaattatgtggccgaggtacacagtaaccttcatggactgggcgcgatgatgcacaattacggtgatgacaagcgagtggaaatcttgaacgatgtcatacccgacgagctcaatcctgggcatcacaactgctccgatctggaccgtaaaccattctggaccgagtttatcaatgtggctaagccgctgtctgaaattgttcccatgagcgtgatccctccacccgtcgtgaagcctcagccacccgccgagccttcctcaaagaagcatgtaccattcgatgttctcttaagtgaagcagagaaagagctgaaccagacaaagattagacttgaagacgagaggaaaagcaatgccgaagagaccgctaaggaacgggcacgcatgaaggagatcgaggatgaattgagaagggagtgggaactggagcggaaacgcaaggacgccatggctgatgacctagccaaagaaactgcgcgaagaagggagatagagcggaaggcacacgaactcgacaaaatgctgaagaaaaaggagcgtgaatctcttattgccaaggagaaagctgatgaagacatgcgctcccacgtgcataagccgaacacaaccagagcccccgcacctacgatcattactaccctgttgatggcttcagccgcgctcgccggaccactggagaatagggagacaaaccacttactgaatcggcccggcaacggcgcatatactctcagcgattttgctgaaagtacctgtacacttgcctacgggtctgagtgcaaatcctgggaacatctgttgaacgaggagctattcccatttttccacagcaatctggacaagtattcgatgctcgaagctgccaccgagacggtccctatcctgaacaaatcttccgcagtgtgtactatctcacccagtacacacagctccaatgcctgcggacgagaggcttctgtgattcgcaagaagtgttacagcaacatgtcagcgtttttctacataaatcttgcaggtcagatcaccgtcattaaatgcgaaactaaccatgttctgagttccgattgtggcaattgcatcagcaagtctttgtcagggcaaaaagtgtatacaccggtacaggacgtgttttgccagaagggatggacccagagtatacctagcacgagatactccaaagatatttgttctatcggcctccacaccgtcaaggaatgcaagatcggtacaacttcgttcgagagggtggggtttattgttgtgaaaggacggaagatgtatatcgagcaaatgaaaatgcgcagcagacaggaatactccgaggaccagttcctgtgttataagtcagaaagtggctctggcagctccgtcaaattaaagaagttcaaagtgaagtcatgcaaaggggtaaccacaagctctgcctccaagtgtagtggagatgagtacttttgcagcaggtatccctgtgaaactgctaacgttgaggcccattgcattctgcgtcggcactctgcaatagtggaggtcaatgtgaacggtgtctgggtggttccacgatgtatcggctacgaagaggtgctagtaaaaagaacctccctcaaggtcgaagacacaaccgggagggagtgcgattcatgtctgtgggaatgcggcaaaaataaacttattgtgaagactcatggacctaaagttgtgtacgccacggcttgcagtcacggtagctgtaagtcggtcatgcagaaacccgccacattcgtgtatttgccataccccgggaactccgagatcgtaggcggagacatcggcattcacatgaccgaggaatctagcccttcaaatatacatctggtggcacactgcccagcgcgcgacagttgtgatgtttccgactgcctcttttgtgtccatgggctgcttaactatcaatgccacactctgttctctgctttgctcatcagcaccacagtgatgtccattctgaccttactgctactcctggtgaagggagccaaagatcttgtcaagaagttgtttcactggctgatcactccgctctgttggctgtcagttttctgctgttgggtggtgaaaagctggaagcggagagtaggtagtgcaatttctaggacaaatgacacgatcggctggcgcgagaaccgacggcatgcccaggatatagaacgtgctcagtacaccgggggagcccccggcgcaaaatattccttttacggtgtcatgatcttagggctgcttagctcggctcaatcatgctctgagagtgtgattgccgactccaagatcatgcagtgtactacaagcggctctagcaccttgtgcaaagcgtccggaacagttattatgagactcggccctatcgggtcagagagttgcctgatactaaagggactgaaggatagcgaaaaacagttcatttctatcaagactatttcctcagagctcacctgtagggaaggtgagagtttttggacgaccctgtatacaccaatctgccttagctcccgccggtgtcacttgatgggcgaatgcgtgtctgacagatgtctgaaatggaagactaaccagacctcggccgagttcacagggaaagctcatggagatgtcatgcacgagaataggtgctttgaacaaagcggcggtatagggtacggctgtttcaacgtgaatccctcatgcttatacgttcattcctatctcaagagtgtgtaccgaaacggatttaaggtattccgctgtgtcgcatggaatcaccggatcagactggaggtgactacccactctaggaaattccctatggtgcttatggccatgagcacgcagccaacagactggggctccattgggctgatcttggattcagaaggaattaccggcactaactcttatagctttatgaagcatggtagtgggtccttcgctatcatagacgatccctacagcccggagcctcgtaaaggatttctcggcgaagtccgctgcccaacagaggagaccgccatgcgggcatctccctcatgtaagatggcgcctaatctgattgaatatcagcccgagatggacactgccgaatgcaccacaaacatgatcgacccaatggctatcttcaatagaggttccctacctcaggttagggatggcatgacgtttacccaaagtattgagaaaaacactgtgcaggccctgacaaccggggaagtaaaggcaagcatccgactcacactggacgattacgacgtggtctatcaaaattcgcagtctgattgctccgctactttcaaaaaccttaccggatgttacagctgcgacgagggctcacggttgtgttaccaagtgaaggccgagggggaaacgatttttcacttcataaatgaggaagagagtatcaacgttattaataaggtgtctcccggagtctccgattattgcacagtgctgcattttagccgcccagttatctcaattgagggcacctacgactgtggtttaagtaaaagaccgatggtgatcaaggggactctcatagcaaccgcccctcacgatgacaggaaacatgaaggaggcagctccctggtcgtaaaccccaagggtggctctgtggatttctttgggtggcttagcggactgacatcctggctaggcgggccactcaaaactttcctgaccatcttgggatttctggctgttggcttactcctggtggtcattatcattatcataattcggacaggtatgcagcaggcgcttaagaagaaaatcaagtga

SEQ ID NO: 11434 - RNA, 4020 nt, synthetic construct
  misc_feature 1..4020: note = derived and/or modified CDS sequence (opt3) from TOSV(T152)__JX867535.1__GP
  source 1..4020: mol_type = other RNA
atgttcatcgccaagctgctccttattagctgcctggtgcagcaggcttacttgaaatataccataatctccgagattggcaacgggacaagaacttcttcatgttacagtagcaggacgtccttaggatctctgctagaagcatgggacaatatcaccgagtcgattggtctcacatcaggcacttgcaaggtcgggagcctggaaaaccgggattgtaaacgcgacatcatgagtaattatgttgccgaggtgcactccaaccttcatggactgggcgcgatgatgcacaattacggtgatgacaagcgagtagaagtgttgaacgatgtcatacccgacgagctcaatcctgggcgtcataactgctctgatctggacagaaaaccattttggaccgagttcatcaatgtggctaagccgacaaacaagattgcccccatcagcgttattcctccacccatcgtgaaacctataccaattgcagaacccaccactaagaaaaatatcccttttgataagctgctctccgaggccgaaaaagagttaaaccaaacaaagattaggctggagaccgaacggcgctcaaatgctgaggaagcagccaaggagagagctaggatgcgggaaatcgaggacaaacttcgcaaggattgggagttggaacgagagagaaaagacgccgtcgcggatgacctggcaaaggaaatcgccaggcggcgtgagattgaacgcaaagctcacgagctagacaagatgctcaaaaagaaggagagagaagatctggtggccatagagaaagtaagtgaagacatgaggaaccatgttcggcgaccaaatacgactatcgcaccggctcccaccattatcacaactcttctgttggccagcgcggtgatggccggacctctcgagaaccgcgaaaccaaccacctgttaaatagaccaggcaacggcgcatatacactgtctgatttcgctgagtccacctgtacgctcgcctacgggtcagagtgcaagagctgggaacaccagcttgacgagctgagttttcccttctttcattctaatttggataaatattccatgctagaagctgccactgagacaatacctattctgaacaagagctcggcagtctgtaccatctctccatccactcactcaagtaatgcctgcggaagggaggctagcctcatcaaaaagaagtgtggttccaacatgtctgcgttcttttacgtgaatctggcaggccagattacagtggtcaaatgcgacaccaaccatgttcttagcaatgattgtgggaactgcatctcaaagacgctgagtggacagaaaatttacacccccgtgcaagacatgttctgccagaagggctggacagaatccataccgagcactcggtattctaaagatttgtgttcaatcggtctccacaccgtaaaggagtgcaagacagggactaccaattttgaacgcgtgggattcattgtcgtggagagtagaaaaatgtacatcgaacagatgaagatgaggagccgtcaagagttttccgaggaccagttcctgtgttataaatctgaatcgagctccggctcaagtgttaagttaaagaaagtgaaggtcgagtcttgcaaaggcgtgacaaccagctccgcctcaaagtgtagcggggatgaatacttctgctctcggtatccttgtgagactgctaacgtagaagcccactgcatcctgcgaagacattccgcagttattgaggtgaatgtcaacggagtgtgggtcgtgcccaggtgtataggttacgaggaagttctagtgcgccggacgagtctcaaagtagaggacacaagctctagagaatgcgacacctgtctgtgggagtgcggcaagaataaacttatcgtcaagactcacgggccaaaaattgtgtatgccaccgcttgctcccatggatcatgtaagagtgttatgcagaagcctgccacatttgtgttcttgccctacccaggcaacagcgaaatcgtcggtggggatattggcgtgcacatgaccgaggagtcgtccccctctaacatccatatggtagcacactgccctgcgaaagacagctgtgaagtgtcaagttgcctgttttgtgttcacggactcctgaattaccagtgccatactcttttctccgctctgttgatatctacaacggtcatgagcatcctcaccctgttactgctactcgtgaagggcgccaaagatctggtgaagaggttgttttattggcttattactccactgtgttggctctccgtcttctgctcatggatgatcaaaagctggcgcaagcgagttgggagtgcaatttctcggacaaacgacaccatcggatggcgtgataatagaaggtacggtcaagacgtggagcgcgcccagtatacaggcggggctccgggaactaagtactccttttatggcgtgatgatactgggtttactggggaacgtacacagctgttcggaatcagtcattgccgattctaaagtgatgcagtgcaccacgagtggctccagcaccctttgtaaggcatctggaacagttatcatgaaattgggccccattgggagcgagtcctgcctcatcctgaagggactaaaagactcagagaagcaattcataagtatcaagactattagctctgaactgacctgccgggagggtgaatccttttggacaactctctacacccctgtgtgtctgtcaagtagaaggtgccatcttatgggcgagtgtgtcagcgatcgatgcttgaaatggaagacgaatgaaacatccgctgagttcaccgggaaagcccacggagaggtgatgcacgaaaacaagtgttttgagcagtctggcggtatcgggtatggctgcttcaatgttaacccatcgtgtctgtacgtgcatagctacttaaaatcagtatataagaatggatttaagattttccgctgcgtcgcgtggaaccaccggatcagactcgaagtgactacacattccaggaaattccccatggtgctgatggccatgagtacccagcctactgactggggctctatagggcttattctggatagcgagggaatcaccggcacaaatgcttactcctttatgaagcacggttcagggtctttcgcaatcattgacgatccatatagccccgaaccgcgtaaaggatttttgggcgaggtccgctgtcctacggaggaaaccgccatccgggctagtccatcctgcaagatggcccccaacctcattgagtaccagcctgaaatggacactgcagagtgtacaaccaatatgatagaccccatggcgatcttcaacagaggtagcctgccacaagttagggatggcatgacatttactcagtctattgagaaaaataccgtgcaggccctaacgacaggggaagtacgagcttcaatccggctgaccctcgacgattatgacgtggtctaccagaactcccaaagtgattgcagcgccactttcaagaacctgaccggatgctattcgtgtgacgagggctctcgcatgtgctaccaggtgaaagcagaaggggagacaatttttcatttcgttaatgaagatgagtccatcaacgtgataaataaggtcagccctgacgtgtcagattactgtactgttcttcactttagtagacccgtgatctctattgagggaaggtatgactgcggcttgtccaagcggccaatggtcatcaaaggtaccctgattgctacagccccgcacgatgaccgaaagcatgaagggggaagctcattagtagtgaaccctaaaggcggtacggttgatttctttggctgggtgagtgggctcaccagctggctgggaggcccccttaagactttcctgacaatcctagggtttctcgcactgggattgctgttagtcgtggtaataattatcatcgccagaaccggcgtgcagcaggctctcaaaaagaagaataaatga

SEQ ID NO: 11435 - RNA, 4020 nt, synthetic construct
  misc_feature 1..4020: note = derived and/or modified CDS sequence (opt3) from TOSV(TOSV/P51)__KU204979.1__GP
  source 1..4020: mol_type = other RNA
atgttcatcgccaagctgctccttattagctgcctggtgcagcaggcttacttgaaatataccataatctccgagattggcaacgggacaagaacttctttttgttactcaagtaggacgagcttaggatccctgctagaagcatgggacaatgtcaccgagtctatcggtctcacatcgggcacttgcaaggttgggtcactggaaaaccgggattgtcgcaaagacattatgagcaattatgtggccgaggtacacagtaaccttcatggactgggcgcgatgatgcacaattacggtgatgacaagcgagtggaaatcttgaacgatgtcatacccgacgagctcaatcctgggcatcacaactgctccgatctggaccgtaaaccattctggaccgagtttatcaatgtggctaagccgctgtctgaaattgttcccatgagcgtgatccctccacccgtcgtgaagctccaacctccagccgagccctccagtaaaaagcatgtacctttcgatgttttactgtcagaagcagagaaagagcttaaccagacaaagattagattggaagacgagaggaaaagcaatgccgaagagaccgctaaggaacgggcacgcatgaaggagatcgaggatgaactgagaagggagtgggaactagagcggaaacgcaaggacgccatggctgatgacctcgccaaagaaactgcgcgaagaagggagatagaccggaaggcacacgagctggatcgtatgcttaaaaagaaagaacgcgagtctctgattgccaaggaaaaggctgacgagaacatgagatcccacgtgcatgaaccaaatacaaccagggccccggcacccacgatcattactaccttgctcatggcttcagccgcgctggccggacctttagagaaccgggagacaaatcatctgctcaaccgaccaggcaacggcgcatatactcttagcgattttgctgaaagtacctgtacactggcctacgggtctgagtgcaaatcctgggaacacttgctaaatgaggagctgttcccctttttccacagcaacctcgacaagtattcgatgctggaagctgccaccgagacggtccctatccttaataaatcttccgcagtgtgtactatctcaccaagtacacacagctccaacgcctgcggacgcgaggcttctgtgattagaaagaaatgttacagcaatatgtcagcgtttttctacataaacctggcaggtcagatcaccgtcgttaagtgcgagactaatcatgtgttgagttccgattgtggcaactgcattagcaagtctctctcagggcaaaaagtatatacacccgtgcaggacgtcttttgccagaagggatggacccagagtatcccgagcacgaggtactccaaagatatatgttctattggcctgcacaccgtgaaggaatgcaaaatcggtacaacttcgttcgagcgggttgggtttatcgtggtcaagggacgcaagatgtatattgagcaaatgaaaatgagaagcaggcaggaatactccgaggaccagttcttatgttataagtcagaaagtggctctggcagctccgtgaaactgaagaaattcaaggtagagtcatgcaagggggttaccacaagctctgcctccaaatgtagtggagatgaatacttttgcagccgttatccttgtgagactgctaatgtggaggcccattgcatcctacggcgacactctgcaattgtcgaagtgaacgtcaatggtgtgtgggttgtgcccagatgtataggctacgaggaagtactcgtcaagaggacctccctgaaagtggaggacacaaccgggcgcgaatgcgattcatgtctttgggagtgcggaaagaacaaattgatcgttaagactcatggcccaaaagtggtctacgccacggcttgcagtcacggtagctgtaagtcggtgatgcagaagcctgccacattcgtatatctgccctacccagggaactccgagattgtgggcggagacatcggcatccacatgaccgaagagtctagcccctcaaatattcatctcgttgcacactgccctgcgcgggacagttgtgatgtctccgactgcctgttttgtgtgcatgggcttctgaattatcaatgccacactttgttctctgctctcctgataagcaccacagtgatgtccatcttaaccctgctactcctgcttgtcaaaggagccaaggatttggttaaaaagctgttttactggctcattactccactgtgttggttatcagtgttctgctgttgggtggtaaaaagctggaagagaagggtcggtagtgcaatctctcgcacaaacgacacgattggctggcgagaaaaccggcgtcacgcccaggatatcgagagagctcagtataccgggggagccccgggcgcaaagtactccttttatggtgtgatgatactggggcttttgagctcggctcaatcatgctctgagagtgttatcgccgactccaaaattatgcagtgtactacaagcggctctagcaccctctgcaaggcgtccggaacagtgatcatgaggctgggccccattgggtcagaaagttgcctaatcctgaaaggactcaaggatagcgagaaacagttcatatctattaagactatctcctcagaactgacctgtcgcgagggtgaaagtttttggacgaccctttacacacctatttgcttgagctcccggagatgtcatctgatgggcgagtgcgtctctgacaggtgtttaaagtggaaaactaatcagacctcggccgagttcacagggaaggctcacggagatgtgatgcatgaaaaccgatgctttgagcaaagcggcggtatcgggtacggctgtttcaatgttaacccatcatgcctctatgtgcactcctacctgaaaagtgtatatcgcaatggatttaaggtcttccggtgtgtggcatggaaccatagaataaggcttgaagtgactacccactctcgtaaattccccatggtcctgatggccatgagcacgcagcctacagactggggctccatcgggttgattctcgattcagagggaatcaccggcactaattcttacagctttatgaagcacggtagtgggtccttcgctattatcgacgatccatatagccccgaaccgcgcaagggatttctgggcgaggttcggtgccctacagaggaaaccgccatgagagcatctccatcatgtaaaatggcgcccaacctagtggagtaccagcctgaaatggacactgccgagtgcaccacaaatatgatagaccccatggctattttcaacaggggttccctgccacaggtacgagatggcatgacgtttacccaaagtatcgaaaagaatactgtgcaggccctcacaaccggggaggtcaaagcaagcatccggctgacacttgacgattatgacgtggtttaccagaactcgcagtctgattgctccgctactttcaagaatttgaccggatgttacagctgcgacgagggctcacgcctgtgttatcaagtgaaagccgaaggggagacgatttttcatttcatcaacgaagaggagagtattaatgtcataaacaaggtgtctcctagagtttccgattactgcacagtgttacactttagcaggcccgtcatctcaattgaaggaacctatgactgtggcctcagtaaacggccaatggtaatcaagggtactctgattgcaaccgccccgcatgatgaccgaaagcacgaagggggaagctcccttgtggttaaccctaaaggcggttctgtggatttctttggctggctgagcgggctaacatcctggctcggaggccccctgaagactttcttgaccatcctggggtttttagctgtcggactcctgcttgtggtaataatcattatcattatcagaacaggcatgcagcaggcgctgaaaaagaaaataaagtga

SEQ ID NO: 11436 - RNA, 4020 nt, synthetic construct
  misc_feature 1..4020: note = derived and/or modified CDS sequence (opt3) from TOSV(TOSV_Italy/BB8/2014/human)__KY626661.1__GP
  source 1..4020: mol_type = other RNA
atgttcatcgccaagctgctccttattagctgcctggtgcagcaggcttacttgaaatataccataatctccgagattggcaacgggacaagaacttctttttgttactcaagtaggacgagcttaggatccctgctagaagcatgggacaatatcaccgagtctattggtctcacatcgggcacttgcaaggtcgggtcactggaaaaccgggattgtaaacgcgacatcatgagcaattatgttgccgaggtgcacagtaaccttcatggactgggcgcgatgatgcacaattacggtgatgacaagcgagtagaagtgttgaacgatgtcatacccgacgagctcaatcctgggcgtcataactgctccgatctggacagaaaaccattctggaccgagtttatcgatgtggctaagccgacaaataagattgcccccatgtctgttatccctccacccattgtgaaacctatcccagtcgcagaaagcaccataaagaaatccattcccttcgacaagctgctctcagaggccgaaaaagagttaaaccaaactaagatcaggctggagacagaacggcgcagtaatgctgaggaagcagccaaggagagagctaggatgcgggaaattgaggataaacttcgcaaggactgggagttggaacgagagagaaaagatgccgtggcggacgacctggcaaaggaaatcgccaggcggcgtgagatcgaacgcaaagctcacgagctagataagatgctcaaaaagaaggagagagaagacctggtagccagggagcgggttagcgaagatatgcgaaaccatgtgtgtaaacctaataccacgattgcaccagctccgactataatcaccacacttctgatggcctctgcggtcatggccggacccttggagaaccgcgaaactaatcacctcctgaacagacctggcaacggcgcatataccttatccgactttgctgagtcaacatgcaccctggcctacgggagcgagtgtaagagttgggaacaccagctcgatgagctttctttcccatttttccattccaatctggacaaatatagcatgttggaagctgccacggagactattcccatcctaaacaagtcgtctgcagtgtgcacaatatccccttcaacccacagtagcaatgcctgtggaagggaggcttccctgattaaaaagaagtgcggttctaacatgagcgcgtttttctacgtgaatctcgcaggccagatcactgtcgttaaatgtgatacaaaccatgtgctgtcaaatgactgcgggaactgcatcagtaagaccctttccggacaaaagatttacacgccagtacaggatatgttttgtcagaagggctggaccgaaagcatccccaatacacggtattctaaagacctgtgctcaattggtttgcacagtgtgaaggagtgtaagactgggaccacaaacttcgaacgcgtcggatttatagtggttaaaggcagaaagatgtacatcgagcagatgaaaatgaggagccgtcaagagttctccgaagatcagttcctctgctataagtctgagtcgagctccggctcaagtgtgaaactgaagaaggtcaaagtggaatcttgtaagggggtaactaccagctccgcctcaaaatgcagcggagacgagtacttttgttctcggtatccgtgcgaaacagctaatgttgaggcccactgtattttacgaagacattccgcagtgatcgaagtcaacgtgaatggtgtctggatcgtgcctaggtgcattggctacgaggaggttctggtgcgccggaccagtctaaaggtagaagacactagctctagagagtgtgatacgtgcctctgggaatgcgggaaagacaagctgatagtcaaaacacacggacccaagatcgtgtatgccaccgcttgttcccatggctcatgcaagagtgttatgcagaaaccagccactttcgtgtaccttccttaccccggtaacagcgagattgtcgggggcgatatcggagtgcacatgaccgaagagtcgtccccatctaatattcatatggtagcacactgtcccgcgaaggacagctgcgaggtgtcaagttgtttgttttgcgttcacggcctgctcaactatcagtgtcatacactgttctccgctttactgatctctaccactgtcatgagcatattgacactcctgttactgctaatgaaaggggccaaggatctcgtgaaaaggctgttttactggcttatcacgcctttgtgctggctgtccgtgttctgtggatgggtcattaagtcatggaagaaacgcgttggtagcgcaatcagtcgaaccaacgacactattggctggcgggataatcgtagatataggcaagacgtggaacgcgcccagtacacagggggagctccaggcgccaagtattctttttacggtgtgatggtactcgggctgttaggcaacgtccactcctgcagcgagtcggtgatcgcagattcaaaaataatgcagtgtaccacatctggaagttccactctgtgcaaggctagcggcaccgttattatgaaacttgggccgatcggatctgaaagctgcttgattctcaagggtctgaaggactccgagaaacaattcatctcaataaagacgatcagtagcgagctaacctgtcgggaaggcgagtctttttggacaactctgtatacccccgtgtgcctctcctcaagaaggtgtcatctgatgggggaatgcgtcagtgatcgatgtcttaaatggaagacaaatgagactagcgccgagttcaccggaaaagcgcacggcgaagtgatgcacgagaaccgctgctttgaacagtccggtgggattggctacggatgtttcaatgttaacccttcttgcttgtacgtgcattcgtatctgaaaagcgtatacaagaatggctttaaaacgttccggtgtgtcgcctggaaccacagaatcaggttagaggtgacaacccattcacgtaagttcccaatggtgctcatggctatgtccactcagcccacagactgggggagtattggactgatccttgattctgaaggcataaccggtactaatgcatatagctttatgcgccacgggtccggatcattcgccattatcgacgacccttactctccagagccccggaaaggctttctgggtgaagtcagatgcccgaccgaggagacagctatcagggccagccctagttgtaagatggcaccaaacttgattgaatatcagcccgagatggatacggcggaatgcaccactaatatgatcgaccctatggccattttcaaccgaggctccctcccccaagttcgggatgggatgacatttacccagagcatagagaaaaatacagtgcaggctctgactaccggagaagtacgcgcctctatcagactaacgctggacgattacgacgtggtctatcagaactcacaatccgattgcagtgcaacattcaagaatctcaccggctgttacagctgcgacgaggggtcgaggatgtgttaccaggtgaaagctgagggagaaactatttttcatttcatcaacgaggatgaatctattaacgttatctccaaggtgaatccagacgtcagcgattattgcaccgtgctgcacttttcacggcctgttataagtatcgagggccgatacgactgtggtctttctaagagacccatggtgattaaagggacattgatcgccactgcaccacacgatgaccgcaagcatgagggaggctccagcctgattgtcaacccgaaaggtggcaccgtagacttctttgggtgggtgtcaggattaacaagttggctcggcgggcctctgaagacgttccttaccatcctgggatttctagccctcggcctgttgctggttgtgataattatcatcattgctaggactggtgtccagcaggcgcttaaaaagaagaataaatga

SEQ ID NO: 11437 - RNA, 4020 nt, synthetic construct
  misc_feature 1..4020: note = derived and/or modified CDS sequence (opt3) from TOSV(TOSV-54441132704)__KX010933.1__GP
  source 1..4020: mol_type = other RNA
atgttcatcgccaagctgctccttattagctgcctggtgcagcaggcttacttgaaatataccataatctccgagattggcaacgggacaagaacttctttttgttactcaagtaggacgagcttaggatccctgctagaagcatgggacaatgtcaccgagtctatcggtctcacatcgggcacttgcaaggttgggtcactggaaaaccgggattgtcgcaaagacattatgagcaattatgtggccgaggtacacagtaaccttcatggactgggcgcgatgatgcacaattacggtgatgacaagcgagtggaaatcttgaacgatgtcatacccgacgagctcaatcctgggcatcacaactgctccgatctggaccgtaaaccattctggaccgagtttatcaatgtggctaagccgctgtctgaaattgttcccatgagcgtgatccctccacccgtcgtgaagctccagcctccagccgagccctccagtaaaaagcatgtacctttcgatgttttactgtcagaagcagagaaagagcttaaccagacaaagattagattggaagacgagaggaaaagcaatgccgaagagaccgctaaggaacgggcacgcatgaaggagatcgaggatgaactgagaagggagtgggaactagagcggaaacgcaaggacgccatggctgatgacctcgccaaagaaactgcgcgaagaagggagatagagcggaaggcacacgaactggacaaaatgcttaagaaaaaggagcgtaagtctctgattgccaaagaaaaggctgatgtggacatgcgctcccacgtccataaaccaaacacaaccagagccccggcacccacgatcattactaccttgctcatggcttcagccgcgctggccggacctttagagaatagggaaacaaaccatctgctcaatcggccaggcaacggcgcatatactcttagcgattttgctgagagtacctgtacactggcctacgggtctgagtgcaagtcctgggaacacttgctaaacgaggaactgttcccctttttccacagcaatctcgacaaatattcgatgctggaggctgccaccgagacggtgcctatccttaacaagtcttccgcagtgtgtactatctcaccaagtacacacagctccaatgcctgcggacgagaggcttctgtcattcgcaagaaatgttacagcaacatgtcagcgtttttctacataaatctggcaggtcagatcaccgttattaagtgcgaaactaaccatgtgttgagttccgattgtggcaattgcatcagcaaatctctctcagggcaaaaggtatatacacccgtgcaggacgtcttttgccagaaaggatggacccagagtataccgagcacgagatactccaaggatatttgttctatcggcctgcacaccgtgaaggaatgcaaaatcggtacaacttcgttcgagagggttgggtttattgtggtcaagggacggaaaatgtatatcgaacaaatgaagatgcgcagcagacaggagtactccgaggaccagttcttatgttataaatcagaaagtggctctggcagctccgtgaagctgaagaaattcaaggtagagtcatgcaaaggggttaccacaagctctgcctccaagtgtagtggagatgaatacttttgcagcaggtatccttgtgagactgctaacgtggaagcccattgcattctacgtcggcactctgcaatagtcgaggtgaatgtcaacggtgtgtgggttgtgccccgatgtatcggctacgaggaagtactcgtcaaaagaacctccctgaaggtggaggacacaaccgggagggaatgcgattcatgtctttgggagtgcggcaaaaataagttgattgttaagactcatggaccaaaagtggtctacgccacggcttgcagtcacggtagctgtaagtcggtgatgcagaaacctgccacattcgtatatctgccctacccagggaactccgaaatcgtgggcggagacatcggcattcacatgaccgaggagtctagcccctcaaatatacatctcgttgcacactgccctgcgcgcgacagttgtgatgtctccgactgcctgttttgtgtgcatgggcttctgaactatcaatgccacactttgttctctgctctcctgatcagcaccacagtgatgtccattttaaccctgctactcctgcttgtcaagggagccaaagatttggttaagaagctgttttactggctcatcactccactgtgttggttatcagtgttctgctgttgggtggtaaaaagctggaagcggagagtcggtagtgcaatttctaggacaaatgacacgatcggctggcgcgaaaaccgacggcacgcccaggatatagagcgtgctcagtataccgggggagccccgggcgcaaaatactccttttatggtgtgatgatcctggggcttttgagctcggctcaatcatgctctgaaagtgttattgccgactccaagatcatgcagtgtactacaagcggctctagcaccctctgcaaagcgtccggaacagtgattatgagactgggccccatcgggtcagagagttgcctaatactgaagggactcaaggatagcgagaaacagttcatttctatcaagactatttcctcagaactgacctgtagggagggtgaaagtttttggacgaccctttacacacctatctgcttgagctcccgccggtgtcatctgatgggcgagtgcgtctctgacagatgtttaaaatggaagactaaccagacctcggccgagttcacagggaaagctcacggagatgtgatgcatgaaaataggtgctttgagcaaagcggcggtatagggtacggctgtttcaacgttaatccatcatgcctctatgtgcactcctacctgaagagtgtatatcgaaacggatttaaggtcttccgctgtgtggcatggaatcatcggatcagacttgaagtgactacccactctaggaaattccccatggtcctgatggccatgagcacgcagcctacagactggggctccattgggttgatcctcgattcagagggaattaccggcactaactcttacagctttatgaagcacggtagtgggtccttcgctatcatagacgatccatatagccccgaaccgcgtaaaggatttctgggcgaggttcgctgccctacagaagagaccgccatgcgggcatctccatcatgtaagatggcgcccaatctaattgagtaccagcctgaaatggacactgccgagtgcaccacaaacatgatcgaccccatggctatcttcaatagaggttccctgccacaggtgagggatggcatgacgtttacccaaagtattgagaaaaacactgtacaggccctcacaaccggggaagtgaaggcaagcatccgactgattcttgacgattatgacgtcgtgtaccaaaattcgcagtctgattgctccgctacattcaaaaacttgactggatgttacagctgcgacgaaggctcacggctgtgttatcaagttaaggccgagggggagaccatatttcatttcatcaatgaagaggaaagtattaacgtgatcaataaggtctctcctggagtgtccgattactgcacggttttacactttagccgccccgtgatttcaatcgagggcacatatgactgtggtctcagtaaaagaccaatggtcataaaggggaccctgatcgcaactgccccgcatgatgacaggaaacacgagggaggcagctcccttgtagtgaaccctaagggtggctctgttgatttctttgggtggctgagcggactaacctcctggctcggcgggcccctgaaaacattcttgactattctgggatttttagctgtgggcctcctgcttgtcgtgatcattatcataattatccggaccggtatgcagcaggcgctgaagaagaaaatcaagtga

SEQ ID NO: 11438 - RNA, 3222 nt, synthetic construct
  misc_feature 1..3222: note = derived and/or modified CDS sequence (opt3) from SFTSV(HB29)__NC_018138.1__GP
  source 1..3222: mol_type = other RNA
atgatgaaggtgatctggttcagctccctgatttgcctcgtcatacagtgttctggcgactcagggcccatcatttgcgccggacctatccacagtaacaaaagcgctggtattccacatcttctgggctactccgagaagatctgtcaaatagatagattgatccacgtttcttcgtggttaaggaatcattcacagtttcaggggtatgtgggacagcggggcggtcgcagccaagtaagttactatccggcagaaaactcctactctcgatggagcgggctgctatccccctgcgacgccgattggctcggaatgctggtggtcaaaaaggcgaaagagtcagacatgattgtgcctggcccaagttataagggcaaggttttctttgaacgtcccaccttcgatgggtacgtgggatggggttgtggcagcgggaaatctagaacagagtccggagaactttgctcaagcgacagtggcacttcttccggtctgttgcctagcgatagggtcctctggatcggggacgtggcttgtcagccaatgacgcccattcctgaggagacctttctggaactgaagtcgttctctcagtccgagtttccagatatctgcaaaatagacggaattgtattcaatcagtgtgaaggcgagtcactcccgcaaccctttgatgttgcctggatggacgtgggccacagtcataagatcattatgcgggagcacaaaacaaagtgggtccaggaaagctcctctaaggatttcgtgtgctataaagaggggactggaccttgtagcgaatcagaggaaaaggcatgcaaaaccagtggttcctgccgcggcgacatgcagttttgtaaggtggccgggtgcgagcacggagaggaagctagcgaggcaaaatgtagatgctctttagtccataagccaggcgaagttgtggtatcatacggtgggacaagggtgcggcccaaatgttacggcttcagtcgcatgatggccaccctggaggtcaaccctccagaacagcgaatcggacaatgcactggctgtcaccttgagtgcatcaatgggggagtgagattgattacactgaccagcgagctaaggtccgctacggtttgtgcctctcatttttgctcgagcgcgtcctcaggtaagaagagtactgaaatacacttccactctggcagcctcgtggggaaaaccgcaatccatgtcaagggagccctggtggacggcacagagttcacttttgaaggttcctgtatgttccccgatgggtgcgacgctgtagattgcaccttttgtcgggagttccttaaaaacccgcagtgctatcctgccaagaaatggctgtttattatcatagttattttgctcggctacgcaggactgatgttactgacaaatgtgctcaaggctatcggcgtctgggggtcatgggtgatcgcccccgtcaaacttatgttcgcgattatcaagaagctgatgcgtaccgtgagctgtttggttggaaaactaatggaccgcggtagacaggtgattcacgaagagataggcgagaacggggaaggaaatcaagatgacgtaaggatcgagatggcccggccacgacgcgtcagacattggatgtattctcctgtgattctgacgatcctcgcaatcggcctggctgaaggttgcgatgagatggttcacgccgactccaaacttgtgagttgtaggcaggggagcggcaacatgaaggagtgcattactacaggacgggctctgttgcccgccgtcaatccaggccaggaagcatgtctccattttaccgcccccgggtctcctgattccaagtgcctgaagataaaagtgaagcgcatcaacttaaaatgtaagaaatcaagtagctacttcgtaccagacgctagatcgaggtgcacttccgtgcgtcggtgtcgatgggcgggagattgccagtctggctgcccgccccactttacaagcaattcattcagtgacgactgggcaggtaagatggatagagccgggctgggattttccggctgttctgacggttgcggcggggctgcctgtggatgcttcaacgcagcccctagctgtatcttttggaggaagtgggttgagaatccacacggcattatttggaaagtctccccctgcgctgcctgggtgccttcagcagtgatcgaactaaccatgccaagcggggaggtccgcacgttccatcccatgagtggaataccgacccaagttttcaagggcgtgtctgtgacatatctcggttccgatatggaagtaagcgggctgactgacctttgtgagatcgaggaattgaaatcgaagaaactggcgctcgctccttgcaaccaggccggaatgggcgtcgtgggtaaggttggcgagattcagtgttcatctgaagagagtgcacggaccatcaaaaaggatgggtgcatttggaacgccgacctggtgggaatcgaacttagagtcgatgacgctgtgtgttactccaagataacaagcgttgaggccgtggcaaattattctgctattccaactaccatcggcgggctgaggtttgagcgcagccacgattcccagggaaaaatttcaggcagtcccttggacatcacagccatacgaggtagcttctctgtaaactaccgggggctccgtctgtccttatcagaaatcaccgcgacttgcacgggagaggtcacaaatgtgagtggctgctacagctgtatgaccggtgccaaggtgtccattaaactgcattcttcgaagaacagcactgctcacgtcagatgcaaaggcgatgaaaccgcattttcagttctagagggggtgcactcctatatcgtaaggctcagtttcgaccatgccgtggtcgatgaacaatgtcagctgaattgcggaggccacgagtctcaggtgacacttaaggggaacttgatttttctggacgttcctaagttcgtggacggaagctacatgcagacctatcattccactgtccccacaggcgctaatatcccatcacctacggattggctcaacgccctgtttggtaatgggttatctcgctggatactgggagtgattggcgttcttttgggcgggctcgcactgttctttctaatcatgttcctgctcaaactgggaaccaagcaagtgtttcggagcagaactaaacttgcgtga

SEQ ID NO: 11439 - RNA, 3222 nt, synthetic construct
  misc_feature 1..3222: note = derived and/or modified CDS sequence (opt3) from SFTSV(Jilin)__KT890281.1__GP
  source 1..3222: mol_type = other RNA
atgatgaaggtgatctggttcagctccctgatttgcctcgtcatacagtgtggcggggacaccggacccatcatttgcgccggtcctatccactctaacaaatcagctaatattccacatcttctgggctacagtgagaagatctgtcaaatagatagattgatccacgttagctcctggttaaggaaccattctcagtttcaggggtatgtgggacagcggggcggtcgctcgcaagtatcatactatccggcagaaaatagctacagtcgatggtccgggctgctatctccctgcgacgccgattggctcggaatgctggtggtcaaaaaggcgaaaggcagcgacatgattgtgcctggcccatcctataaggggaaggttttctttgagcgtcccacattcgatggatacgtgggttggggctgtgggtcaggaaaaagtagaactgaaagcggcgagctttgttcttccgactcaggtacgagcagtgggctgttgccttctgatagggtcctctggatcggagacgtggcttgccagccaatgacccccattcctgaagagacatttctggagctgaagtccttcagccagtcggaatttccagatatctgcaaaatagacggcattgtattcaaccagtgtgagggcgaatctctcccgcaaccctttgatgttgcctggatggacgtggggcactcccataagatcattatgcgggagcacaaaactaagtgggtccaggagtcaagtagcaaggatttcgtgtgctataaagaaggaaccggtccttgttccgagtctgaagagaagacatgcaaaaccagcggctcatgccgcggggacatgcagttttgtaaggtggcaggatgcgaacacggcgaggaggccagtgaagctaaatgtagatgctccttagtccataagccaggtgaggttgtggtaagctacgggggcatgagggtgcggcccaaatgttacggattctctcgcatgatggcacctctggaagtcaatccacccgagcagcgaatcggccaatgcactgggtgtcaccttgaatgcatcaacggaggtgtgagattgattacactgacctcagagctaaagagtgccacggtttgtgcttatcatttttgcagctgtgccacttccggcaagaaatctaccgagatacagttccactcggggagcctcgtgggaaagacagcgatccacgtcaaaggcgcactggtggacggtactgagttcacctttgaagggaggtgcatgttcccggatggctgcgacgccgtagattgtacattttgccgggagttccttaagaatcctcagtgttaccccgctcaaaaatggctgtttattatcatagttattttgctcggatatgccggcctgatgttactgaccaacgtgctcaaggcaatgggggtctggggatcctgggtgatcgctccagtcaaacttgtgttcgccatcattaaaaagctgatgcgtgcggtttcatgcttgatgggtaaactaatggaccgcggcagacaggtgatccatgaagaaattggggagaatagggagggaaaccaggatgacgtacggatagaaatggcccgacctcgcagagtcaggcactggatgtacagtcccgtgatccagacgattgttgcaatcggcctggctgagggttgtgatgaaatggtgcatgccgactctaagctcgtcagctgccggcaagggtccggcaatatgaaagagtgtgtgactacaggacgcgctctgcttccagccgtaaaccccggccaggaggcatgcctgcactttaccgcccctgggtcaccagatagcaagtgtttgaagatcagagtgaaaaggattaatctcaagtgcaaaaagtcttccagttatttcgttccggacgctcgtagccggtgtacttctgtccgaagatgccgctgggcgggagattgccagtccggctgtccccctcattttacatcaaacagtttcagcgacgactgggcaggtaaaatggatagggccgggctgggattttcgggctgctccgacggttgtggcggggctgcctgcggatgtttcaatgcagccccatcttgcatattttggcggaagtgggtggaaaacccccacggcatcatttggaaggtgagcccttgtgctgcctgggtcccatcagcagttatcgagttaaccatgcccagtggggaagtgagaacgttccacccgatgtccggcattcctacccaggtgttcaaaggagtatctgtcacatacctgggtagcgatatggaggtgtccgggctaactgacctctgcgaaatcgaggagctgaagtcaaagaaacttgcgttggctccatgtaaccaagccggaatgggcgttgtgggtaaggtcggcgaaatacagtgcagcagtgaggaatctgcaaggaccatcaagaaagatgggtgtatttggaatgccgacctggtgggaatcgagctccgcgttgatgacgctgtgtgctattccaagattacaagcgtagaagccgtcgcaaactactcggctatccccactaccataggcgggctgcgatttgagcggtcacatgattctcagggaaagattagtggctcccctcttgacatcacagccattcgtggtagcttctctgtgaattacagagggctgaggttgagcctctccgagatcaccgcgacttgcacgggagaagtgacaaacgtctcaggctgttatagttgcatgaccggtgccaaagttagcataaagctgcactcttccaaaaattcaactgctcatgtgcgctgtaagggcgatgagaccgcatttagtgtattagaaggggtgcacagctactccgtctctctgtcgttcgaccacgccgtggttgatgagcagtgccaactaaactgtggaggccatgaaagccaggtgacactccgggggaatctgatctttcttgacgtccccaaattcgtggacggatcatatatgcagacctaccactccactgttccaacaggcgctaacattcctagtcccacggattggttgaatgccctgtttggtaacgggctctctagatggatcctgggagtgattggcgtcttactgggcgggcttgcattgttctttctcatcatgagcctgttcaagctaggaaccaagcagatatttaggtcccgaactaaactggcgtga

SEQ ID NO: 11440 - RNA, 3222 nt, synthetic construct
  misc_feature 1..3222: note = derived and/or modified CDS sequence (opt3) from SFTSV(05-Lu'an(CHN)-2015)__KX302597.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcggcgctaaatgtagatgctctctcgtccataagccaggtgaagttgtggtatcatacgggggcatgagggtgcggcccaaatgttacggatttagtcgcatgatggcaaccttagaggtcaaccagcctgaacaacgaatcggccagtgcactgggtgtcacctggagtgcatcaatggaggtgtgagacttattacattgaccagcgaactgaagtccgccacggtttgtgcttctcatttctgctcgagcgccacttccggcaagaaatcaaccgagatacagttccacagtgggtctctagtgggaaagacagcgatccacgtcaaaggcgcactcgtggatggtactgagtttaccttcgaagggagctgtatgtttccagacggctgcgatgccgtagactgcacattctgtagggagtttctgaagaacccccaatgctatccggctaaaaagtggcttttcattatcatagttattctgttgggatacgccggcctcatgctgttaaccaatgtgctgaaggcaatcgggatctggggatcctgggtcattgctcctgtgaaactcatgtttgccatcattaagaaacttatgcggacggtctcatatctgatgggtaagttgatggatcgtggccgccaggtgatacatgaagagatcggggaaaacagagagggaaatcaggacgatgttaggattgagatggcgcggccccgacgcgtgagacactggatgtacagcccagtaatcctaactatcctggccattggcctcgcagaatcttgtgacgagatggtccatgctgattccaaactggtgagttgcaggcagggtagcgggaacatgaaggaatgtgttacaaccggccgggcccttctgcctgctgtgaatcccggacaagaggcctgcttgcacttcactgcaccaggctctcccgactccaagtgtctcaaaataaaggtcaaacgcatcaacctgaagtgcaaaaagtcaagtagctattttgtgcctgatgccagatcgaggtgtacatccgtacgtcggtgccgatgggctggggactgtcagtctggatgcccaccgcatttcaccagcaattcatttagtgacgattgggcgggcaagatggacagagcaggtttagggttctccggatgctctgatggctgtggtggcgccgcttgcgggtgttttaacgccgcacccagctgcattttctggaggaaatgggtggagaatcctcacggaatcatttggaaggtttccccatgtgccgcttgggtcccctcagccgtgatcgaactgacgatgcctagcggcgaggtgcgcaccttccacccaatgagtgggatacccacacaggtctttaaaggagtttctgtgacttacctaggctccgacatggaagtgagcggtctcaccgatctgtgcgagatcgaggaacttaagtcgaaaaagttggcactggcgccgtgtaaccaggctgggatgggagtagtcggcaaagtgggtgagattcaatgctcatctgaagagagtgcccggacaatcaagaaggacggctgtatttggaacgcagatctcgttgggatcgaactgagagtggacgatgccgtctgctattccaaaataactagcgtggaggctgttgccaattactctgcaattcctaccacaatcggaggccttaggttcgaacgcagccatgactcccaggggaagatttcaggaagtccactggatatcaccgctatacgaggcagcttttctgtgaactaccggggtttgcgtctctccctgtcagagatcactgccacgtgtacaggggaggtaaccaatgtcagtggatgctatagctgcatgactggcgcgaaagtgtccattaagttacactcttcgaaaaacagcaccgcccatgtgagatgtaagggtgacgaaacagctttctcagtcctggagggcgttcactcctacaccgtgagtctatcttttgatcacgcagtagtggacgaacagtgccagctcaattgtgggggacatgagagccaagtcactctgaagggcaaccttatcttcttggacgtgcccaaatttgttgatgggtcctatatgcagacataccactcaacggtgcctaccggagccaatattccctctccaactgactggctgaacgctctcttcggcaatggtctgagtaggtggatcttaggggtcataggagtgctgcttggcggcttggccctctttttcatgattatgagcctgtttaagctagggacaaaacaggttttccgctcccggaccaagctggcatga

SEQ ID NO: 11441 - RNA, 3222 nt, synthetic construct
  misc_feature 1..3222: note = derived and/or modified CDS sequence (opt3) from SFTSV(07-Lu'an(CHN)-2015)__KX302598.1__GP
  source 1..3222: mol_type = other RNA
atgatgaaggtgatctggttcagctccctgatttgcctcgtcatacagtgttctggcgactcagggcccatcatttgcgccggacctatccacagtaacaaaagcgctggtattccacatcttctgggctactccgagaagatctgtcaaatagatagattgatccacgtttcttcgtggttaaggaatcattcacagtttcaggggtatgtgggacagcggggcggtcgcagccaagtaagttactatccggcagaaaactcctactctcgatggagcgggctgctatccccctgcgacgccgattggctcggaatgctggtggtcaaaaaggcgaaagagtcagacatgattgtgcctggcccaagttataagggcaaggttttctttgaacgtcccaccttcgatgggtacgtgggatggggttgtggcagcgggaaatctagaacagagtccggagaactttgctcaagcgacagtggcacttcttccggtctgttgcctagcgatagggtcctctggatcggggacgtggcttgtcagccaatgacgcccattcctgaggagacctttctggaactgaagtcgttctctcagtccgagtttccagatatctgcaaaatagacggaattgtattcaatcagtgtgaaggcgagtcactcccgcaaccctttgatgttgcctggatggacgtgggccacagtcataagatcattatgcgggagcacaaaacaaagtgggtccaggaaagctcctctaaggatttcgtgtgctataaagaggggactggaccttgtagcgaatcagaggaaaaggcatgcaaaaccagtggttcctgccgcggcgacatgcagttttgtaaggtggccgggtgcgagcacggagaggaagctagcgaggcaaaatgtagatgctctttagtccataagccaggcgaagttgtggtatcatacggtgggatgagggtgcggcccaaatgttacggcttcagtcgcatgatggccacactggaggtcaaccctccagaacagcgaatcggacaatgcaccggctgtcaccttgagtgcatcaatgggggagtgagattgattactctgacaagcgagctaaggtccgctaccgtttgtgcctctcatttttgctcgagcgcgacgtccggtaagaagtcaactgaaatacacttccacagtggctctctcgtggggaaaaccgcaatccatgtcaagggagccctggtggacggcacagagttcacttttgaaggtagctgtatgttccccgatgggtgcgacgctgtagattgcaccttttgtcgggagttccttaaaaacccgcagtgctatcctgccaagaaatggctgtttattatcatagttattttgctcggctacgcaggactgatgttactgacaaatgtgctcaaggctatcggcgtctgggggtcctgggtgatcgcccccgtcaaacttatgttcgcgattatcaagaagctgatgcgtaccgtgtcatgtttggttggaaaactaatggaccgcggtagacaggtgattcacgaagagataggcgagaacggggaaggaaatcaagatgacgtaaggatcgagatggcccggccacgacgcgtcagacattggatgtatagccctgtgattctgacgatcctcgcaatcggcctggctgaaggttgcgatgagatggttcacgccgactctaaacttgtgtcctgtaggcaggggagtggcaacatgaaggagtgcattactacaggacgggctctgttgcccgccgtcaatccaggccaggaagcatgtctccattttaccgcccccgggagccctgattctaagtgcctgaagataaaagtgaagcgcatcaacttaaaatgtaagaaatcctcaagttacttcgtaccagacgctagatcgaggtgcactagcgtgcgtcggtgtcgatgggcgggagattgccagtccggctgcccgccccactttacatctaatagcttctcagacgactgggcaggtaagatggatagagccgggctgggatttagtggctgttccgacggttgcggcggggctgcctgtggatgcttcaacgcagccccttcttgtatcttttggaggaagtgggttgagaatccacacggcattatttggaaagtcagcccctgcgctgcctgggtgccttccgcagtgatcgaactaaccatgccatcaggggaggtccgcacgttccatcccatgagcggaataccgacccaagttttcaagggcgtgagtgtgacatatctcggttctgatatggaagtatccgggctgactgacctttgtgagatcgaggaattgaaaagcaagaaactggcgctcgctccttgcaaccaggccggaatgggcgtcgtgggtaaggttggcgagattcagtgttcgtcagaagagtctgcacggaccatcaaaaaggatgggtgcatttggaacgccgacctggtgggaatcgaacttagagtcgatgacgctgtgtgttacagtaagataacatccgttgaggccgtggcaaattatagcgctattccaactaccatcggcgggctgaggtttgagcgctctcacgatagccagggaaaaatttccggctcacccttggacatcacagccatacgaggtagtttcagcgtaaactaccgggggctccgtctgtctttatccgaaatcaccgcgacttgcacgggagaggtcacaaatgtgtcaggctgctacagttgtatgaccggtgccaaggtgagcattaaactgcattcctctaagaactcgactgctcacgtcagatgcaaaggcgatgaaaccgcatttagcgttctagagggggtgcactcatatatcgtatccctcagtttcgaccatgccgtggtcgatgaacaatgtcagctgaattgcggaggccacgagtctcaggtgacacttaaggggaacttgatttttctggacgttcctaagttcgtggacggaagctacatgcagacctatcattccactgtccccacaggcgctaatatcccatcacctacggattggctcaacgccctgtttggtaatgggttatctaggtggatactgggagtgattggcgttcttttgggcgggctcgcactgttctttctaatcatgttcctgctcaaactgggaaccaagcaagtgtttcgcagccggactaaacttgcgtga

SEQ ID NO: 11442 - RNA, 3222 nt, synthetic construct
  misc_feature 1..3222: note = derived and/or modified CDS sequence (opt3) from SFTSV(12-Lu'an(CHN)-2014)__KX302595.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctactatccggcagaaaatagttactcccgatggtctggtctgctaagcccctgcgacgccgattggctcgggatgctggtggtcaaaaaggcgaaaggatccgacatgattgtgcctggcccatcatataagggcaaggttttctttgagcgtcccacattcgatgggtacgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacatttctggagctcaagagcttctcgcagtctgaatttccagatatctgcaaagtagacggaatagttttcaaccagtgtgattccgagtcactgccgcaacccattgacgtggcctggatggatgtcggccacagtcataagatcattatgcgggaacacaaaactaagtgggtgcaggagagctcctctaaggactttgtgtgctataaagagggcaccgggccttgtagcgaatcagaggaaaagacatgcaaaaccagtggatcctgccgcggtgacatgcagttctgtaaggtcgcaggctgcgagcacggggaagaggccagcgaggctaaatgtagatgctctttagttcataagccaggagaagtggtagtgtcatacggcggtatgagggtccggcccaaatgttacgggtttagtcgcatgatggcaactctggaggtgaatcctccagaacagcgaatcggccaatgcacaggatgtcaccttgagtgcatcaacggcggggttagattgattaccctgacgagcgaactaaagtccgccactgtgtgtgcttctcatttctgctcgagcgccacctccggaaagaaatcaacagagatacagtttcacagtggttctctcgtcggcaaggcggcaatccacgtgaaaggggccctggtagatggaactgagttcaccttcgaaggcagctgtatgtttcccgacggttgcgatgctgttgactgcacattctgtagggagtttcttaagaatccgcagtgctatcctgccaaaaagtggctgttcattatcatagtgattttgctcgggtacgcaggcctgatgttactgaccaacgtcctcaaggctatcggagtgtggggctcctgggtcatggcccccgtgaaacttatgtttgcgatcatgaagaaactgatgcggtcagttagctgtttgatggggaagctaatggatcgtggacgccaagtgattcatgaagagatcggtgaaaatagagagggcaaccaggacgatgtaaggattgagatggcccggccacgacgcgtcagacactggatgtattctcctgtgatactgacgatcctcgcaattgggctggctgaaggatgcgacgagatggttcatgccgattccaaacttgtgagttgtaggcagggcagcggtaatatgaaggaatgcgtcactacagggcgggctctgttgcccgccgtgaacccaggccaggaggcatgtctccacttcaccgcccccggatctcctgactccaagtgcctgaaaatcaaggtaaaacgcatcaatttaaagtgtaaaaagtcaagtagctactttgtgccagatgctagatcgaggtgcacttccgttcgtcggtgtcgatgggcgggcgactgccaatctgggtgcccgagctatttcacatcaaacagtttttccgacgattgggcaggaaagatggacagagccggcctgggtttctctgggtgtagcgatggatgcggcggtgctgcctgtggctgctttaatgcagccccctcctgtattttctggaggaaatgggtcgagaaccctcatgggataatctggaaggtgtcaccatgcgctgcctgggtgcccagcgcagtcattgaactaaccatgcctagtggagaggttcgcacgtttcacccaatgtctggcatccccacccaggtgttcaaaggggtgtccgtaacatacctcggaagcgacatggaagtctcgggcctgactgatctttgtgagattgaagagttgaagtctaaaaagctggcgctcgctccgtgcaaccaggccggtatgggggtggttggaaaagtgggcgagatccagtgttcaagtgaagagtccgcacggaccataaagaaggacggttgcatctggaatgccgatctggtcggcattgaacttagagtggacgatgctgtttgttatagcaaaatcacatctgtggaggccgtagcaaactacagcgctattcctactaccatcgggggactgaggttcgaacgctcccacgactcacaaggcaagataagtgggagcccattggatattacagccatccgaggatctttttccgtcaattaccggggcctccgtctgtcattaagtgagattaccgcgacttgcacgggtgaggtgacaaacgtgagcgggtgctattcctgtatgaccggagccaaagtctctatcaagctgcattcgagcaaaaattcaactgctcacgttagatgcaggggcgacgaaaccgcattctccgtgctagagggtgtacatagttacacagtgtctctcagctttgatcacgccgtcgtggacgaacagtgtcagctgaactgcggcgggcacgagtcccaggttacccttaagggaaatttgatattcctggacgtgcccaagtttgtcgatggctcatatatgcaaacttaccattctagcgtgcctacaggggctaacatccccagtccaacggactggctcaatgccctgttcggaaacggcttatcccgctggattctgggtgttatcggggtgcttttgggagtcctcgcactgtttttcctaattatgagcctgtttaaactcggcaccaagcaggtaatccggtctagaactaaactggcgtga

SEQ ID NO: 11443 - RNA, 3222 nt, synthetic construct
  misc_feature 1..3222: note = derived and/or modified CDS sequence (opt3) from SFTSV(14-Lu'an(CHN)-2014)__KX302596.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctactatccggcagaaaatagttactcccgatggtctggtctgctaagcccctgcgacgccgattggctcgggatgctggtggtcaaaaaggcgaaaggatccgacatgattgtgcctggcccatcatataagggcaaggttttctttgagcgtcccacattcgatgggtacgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacatttctggagctcaagagcttctcgcagtctgaatttccagatatctgcaaagtagacggaatagttttcaaccagtgtgattccgagtcactgccgcaacccattgacgtggcctggatggatgtcggccacagtcataagatcattatgcgggaacacaaaactaagtgggtgcaggagagctcctctaaggactttgtgtgctataaagagggcaccgggccttgtagcgaatcagaggaaaagacatgcaaaaccagtggatcctgccgcggtgacatgcagttctgtaaggtcgcaggctgcgagcacggggaagaggccagcgaggctaaatgtagatgctctttagttcataagccaggagaagtggtagtgtcatacggcggtatgagggtccggcccaaatgttacgggtttagtcgcatgatggcaactctggaggtgaatcctccagaacagcgaatcggccaatgcacaggatgtcaccttgagtgcatcaacggcggggttagattgattaccctgacgagcgaactaaagtccgccactgtgtgtgcttctcatttctgctcgagcgccacctccggaaagaaatcaacagagatacagtttcacagtggttctctcgtcggcaaggcggcaatccacgtgaaaggggccctggtagatggaactgagttcaccttcgaaggcagctgtatgtttcccgacggttgcgatgctgttgactgcacattctgtagggagtttcttaagaatccgcagtgctatcctgccaaaaagtggctgttcattatcatagtgattttgctcgggtacgcaggcctgatgttactgaccaacgtcctcaaggctatcggagtgtggggctcctgggtcatggcccccgtgaaacttatgtttgcgatcatgaagaaactgatgcggtcagttagctgtttgatggggaagctaatggatcgtggacgccaagtgattcatgaagagatcggtgaaaatagagagggcaaccaggacgatgtaaggattgagatggcccggccacgacgcgtcagacactggatgtattctcctgtgatactgacgatcctcgcaattgggctggctgaaggatgcgacgagatggttcatgccgattccaaacttgtgagttgtaggcagggcagcggtaatatgaaggaatgcgtcactacagggcgggctctgttgcccgccgtgaacccaggccaggaggcatgtctccacttcaccgcccccggatctcctgactccaagtgcctgaaaatcaaggtaaaacgcatcaatttaaagtgtaaaaagtcaagtagctactttgtgccagatgctagatcgaggtgcacttccgttcgtcggtgtcgatgggcgggcgactgccaatctgggtgcccgagccatttcacatcaaacagtttttccgacgattgggcaggaaagatggacagagccggcctgggtttctctgggtgtagcgatggatgcggcggtgctgcctgtggctgctttaatgcagccccctcctgtattttctggaggaaatgggtcgagaaccctcacgggataatctggaaggtgtcaccatgcgctgcctgggtgcccagcgcagtcattgaactaaccatgcctagtggagaggttcgcacgtttcacccaatgtctggcatccccacccaggtgttcaaaggggtgtccgtaacatatctcggaagcgacatggaagtctcgggcctgactgatctttgtgagattgaagagttgaagtctaaaaagctggcgctcgctccgtgcaaccaggccggtatgggggtggttggaaaagtgggcgagatccagtgttcaagtgaagagtccgcacggaccataaagaaggacggttgcatctggaatgccgatctggtcggcattgaacttagagtggacgatgctgtttgttacagcaaaatcacatctgtggaggccgtagcaaactatagcgctattcctactaccatcgggggactgaggttcgaacgctcccatgactcacaaggcaagataagtgggagcccattggatattacagccatccgaggatctttttccgtcaattaccggggcctccgtctgtcattaagtgagattaccgcgacttgcacgggtgaggtgacaaacgtgagcgggtgctactcctgtatgaccggagccaaagtctctatcaagctgcactcgagcaaaaattcaactgctcatgttagatgcaggggcgacgaaaccgcattctccgtgctagagggtgtacacagttatacagtgtctctcagctttgatcacgccgtcgtggacgaacagtgtcagctgaactgcggcgggcatgagtcccaggttacccttaagggaaatttgatattcctggacgtgcccaagtttgtcgatggctcatacatgcaaacttatcactctagcgtgcctacaggggctaacatccccagtccaacggactggctcaatgccctgttcggaaacggcttatcccgctggattctgggtgttatcggggtgcttttgggagtcctcgcactgtttttcctaattatgagcctgtttaaactcggcaccaagcaggtattccggtctagaactaaactggcgtga

SEQ ID NO: 11444 - RNA, 3222 nt, synthetic construct
  misc_feature 1..3222: note = derived and/or modified CDS sequence (opt3) from SFTSV(18-Lu'an(CHN)-2015)__KX302599.1__GP
  source 1..3222: mol_type = other RNA
atgatgaaggtgatctggttctttagcctgatttgcttcgtcatacagtgttccggcgactctgggcccatcatttgcgccggacctatccactcaaacaaaagtgctgatattccacatctccttggttacagcgagaagatctgtcaaatagacagactgatccacgtttcctcttggttgaggaatcattcgcagtttcagggctatgtggggcagcggggaggccgctcacaagtaagctactatccggcagaaaacagttactcccgatggtctggtttactgagcccctgcgatgccgactggctagggatgctcgtggtcaaaaaggcgaaaggatccgatatgattgtgcctggcccatcatataagggcaaggttttctttgagcgtcccaccttcgacgggtacgtgggatggggttgtggcagtgggaaaagcagaacagaatctggagagctgtgctcctcagatagcggcacttcctctggtcttctgccttccgacagggtcttgtggatcggggatgtggcttgtcagccaatgacgcccattcctgaagagacctttctcgagctcaagagcttctcgcagtctgaatttccagacatctgcaaaatagatggaattgtattcaatcagtgtgagggcgaatccctgccgcaaccctttgacgttgcctggatggatgtgggccactcacataagatcattatgcgggagcacaaaacaaagtgggtccaggagagtagctccaaggacttcgtgtgctataaagaagggactggaccttgttctgagagcgaagagaagacctgcaaaacatcaggtagttgccgcggcgacatgcagttttgtaaggtggcagggtgcgaacacggagaggaggcctccgaagctaaatgtagatgcagcctggtccataagccaggcgaggttgtggtatcttacaggggtatgcggatccgccccaaatgttacgggttctcacgaatgatggcaaccttagaagtgaaccagcctgagcaaagaatcggccagtgcactggatgtcacctggaatgcattaatggcggggtcaggcttataacattgaccagtgagctaaagagcgccacggtgtgtgcttcccatttctgcagttcggccactagcggaaagaaatccaccgagatccagtttcactcaggtagtctggttggcaagacagcgattcacgtgaaaggggcactcgtcgatggaactgagttcacctttgaaggctcttgtatgttcccagacggttgcgatgccgtggactgcacattttgtcgggagttcctgaagaacccccaatgctatccggctaaaaagtggctttttatcataattgtaatcctgttggggtacgccggcctcatgctgttaaccaatgttctgaaggcaatcggaatttggggcagctgggtgatcgctcctgtcaaactcattttcgccataatcaagaaacttatgcgtacggtgtcctgtctgatggggaagttgatggatcgcggaagacaggtcattcatgaagaaatcggtgagaacagggagggcaatcaggacgatgtgcggatcgaaatggcgcgaccccgcagagttaggcactggatgtattcaccagtgattctaactatactggccatcgggctcgcagagggatgcgacgaaatggtacatgctgatagcaaactggtctcttgtcggcagggctccggtaacgtgaaggagtgcgttacaaccgggcgcgcccttctgcctgctgtgaatcccggccaagaggcctgtttgcactttactgcaccaggaagtcccgacagcaagtgcctcaaaattagagtcaagaggatcaacctgaaatgtaagaaatcttcctcatacttcgtgcctgatgcccgtagtcggtgcacaagcgtacgaagatgtaggtgggctggcgactgccagtcggggtgcccaccgcattttacctccaattctttcagcgacgattgggcgggaaagatggaccgcgcaggcttaggtttttcagggtgtagtgatggatgcggcggtgccgcttgtggctgcttcaacgccgcaccctcctgtattttctggcggaagtgggtggaaaatcctcacgggatcatatggaaagtttctccatgcgccgcttgggtccccagcgccgtgatcgagctgacgatgccttccggagaagtgagaacctttcacccaatgtcaggcattcccacacaggtcttcaagggggttagcatcacttatctaggaagtgacatggaggtgtctggcctcaccgatctgtgtgaaattgaggagcttaaatccaagaaattggcactggcgccgtgcaaccaggctggtatgggggtggtaggaaaggtcggcgaaatccaatgtagctcggaggaatcagccaggacaataaagaaggacggttgcatttggaacgcagatctcgtgggcatcgagctgcgcgttgacgatgccgtgtgttactctaagattacttctgtcgaagctgtggccaattattccgcaatccctaccacaatagggggacttcgatttgagcggagccatgactctcagggcaaaatcagcgggtccccactggatattaccgctatccgtggatcattcagtgttaactacagaggcttgaggctcagcctgtctgagattactgccacgtgcacaggtgaagtgaccaatgtatccgggtgctactcatgtatgactggagcgaaggtcagtatcaaattacacagcaacaagaatagtaccgcccatgtgcgctgcaaaggcgacgagacagctttttctgtgctggaaggtgtccactcgtataccgttagcctatcattcgatcacgcagtggtagacgagcagtgtcagctcaactgcggcgggcatgaatcccaagtgactctgaagggaaatcttatatttttggacgtccccaagttcgtggatggcagttacatgcagacatatcactctacggttcctaccggggccaacattcccagcccaactgactggctgaatgctctctttggaaacggcctgtcccggtggatcttaggtgtgatcggggtcctgcttggaggcttggccctcttctttatgattatgtcactgttcaaactaggcacaaaacaggtgtttagatctaggaccaaactggcatga

SEQ ID NO: 11445 - RNA, 3222 nt, synthetic construct
  misc_feature 1..3222: note = derived and/or modified CDS sequence (opt3) from SFTSV(27-Lu'an(CHN)-2015)__KX302600.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgaggatccggcccaaatgttacggctttagtcgcatgatggcaaccttagaagtgaaccagcctgagcaacgaatcggacagtgcactggctgtcacctggaatgcattaatgggggagtcagacttataacattgaccagcgagctgaagtccgccacggtgtgtgcttctcatttctgctcgagcgccacttccggtaagaaatcaaccgagatccagttccacagtggctctctagttgggaagacagcgattcacgtgaaaggagcactcgtcgatggcactgaatttaccttcgagggtagctgtatgtttccagacgggtgcgatgccgtggactgcacattctgtagggaatttctgaagaacccccaatgctatccggctaaaaagtggcttttcatcataattgtaatcctgttgggctacgccggactcatgctgttaaccaatgttctgaaggcaatcggcatttgggggtcctgggtgatcgctcctgtcaaactcatttttgccataatcaagaaacttatgcggacggtgtcatgtctgatgggaaagttgatggatcgtggtcgccaggtcattcatgaggaaatcggcgagaacagagaggggaatcaggacgatgtgaggatcgaaatggcgcggccccgacgcgttagacactggatgtatagcccagtgattctaactatactggccatcggactcgcagagtcttgcgacgaaatggtacatgctgattccaaactggtcagttgtaggcagggcagcggtaacatgaaggagtgcgtgacaaccgggcgggcccttctgcctgctgttaatcccggccaagaggcctgtttgcacttcactgcaccaggatctcccgactccaagtgcctcaaaattaaggtgaaacgcatcaacctgaagtgtaaaaagtcaagtagctactttgtccctgatgccagatcgaggtgcacatccgtgcgtcggtgtcgatgggctggcgactgccagtctgggtgcccaccgcatttcaccagcaattcatttagtgacgattgggcgggaaagatggacagagcaggcttaggtttctccgggtgttctgatggatgcggcggtgccgcttgtggctgctttaacgccgcacccagctgtattttctggaggaaatgggtagaaaatcctcacgggatcatatggaaggtgtccccatgcgccgcttgggttccctcagccgtcatcgagctgacgatgcctagcggagaagtgcgcaccttccacccaatgagtggcattcccacacaggtgtttaaaggggtctctgttacttatctaggatccgacatggaggtgagcggcctcaccgatctgtgtgaaatcgaggagcttaagtcgaaaaagttggcactggcgccgtgcaaccaggctggtatgggggtggtaggaaaagtcggcgaaattcaatgttcatctgaggaaagtgcccggacaatcaagaaggacggttgcatatggaacgcagatctcgtgggcattgagctgagagttgacgatgccgtgtgttactccaaaatcactagcgtcgaagctgtggccaattattctgcaattcctaccacaatcgggggacttaggttcgagcgcagccatgactcccagggcaagatatcagggagtccactggatatcaccgctattcgaggcagcttttctgttaactaccggggattgcgtctctccctgtcagagatcactgccacgtgcacaggtgaagtgaccaatgtaagtgggtgctacagctgtatgactggagcgaaagtctccattaagttacactcttcgaaaaacagcaccgcccatgtgagatgcaagggcgacgagacagctttctcagtgctggaaggtgtccactcctataccgttagtctatcttttgatcacgcagtggtagacgagcagtgtcagctcaattgcggcgggcatgaaagccaagtgactctgaagggaaaccttatcttcttggacgtccccaaatttgtggatggctcctacatgcagacatatcactcaacggttcctaccggggccaatataccctctccaactgactggctgaacgctctcttcggaaatggcctgagtaggtggattttaggtgtgatcggggtcctgcttggaggcttggccctctttttcatgatcatgagcctgtttaagctaggcacaaaacaggtgttccgctcccggaccaagctggcatga

SEQ ID NO: 11446 - RNA, 3222 nt, synthetic construct
  misc_feature 1..3222: note = derived and/or modified CDS sequence (opt3) from SFTSV(36-Lu'an(CHN)-2015)__KX302601.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaaccagcctgagcaacgaatcggacagtgcactggctgtcacctggaatgcatcaatgggggagtgagacttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggatggcactgaatttaccttcgagggtagctgtatgtttccagacgggtgcgatgccgtagactgcacattctgtagggaatttctgaagaacccccaatgctatccggctaaaaagtggcttttcattatcatagttattctgttgggctacgccggactcatgctgttaaccaatgtgctgaaggcaatcggcatctgggggtcctgggtcattgctcctgtgaaactcatgtttgccatcattaagaaacttatgcggacggtctcatgtctgatgggaaagttgatggatcgtggtcgccaggtgatacatgaggaaatcggcgagaacagagaggggaatcaggacgatgttaggattgaaatggcgcggccccgacgcgtgagacactggatgtatagcccagtagtcctaactatcctggccatcggactcgcagagtcttgcgacgaaatggtgcatgctgattccaaactggttagttgtaggcagggcagcggtaacatgaaggagtgcgtgacaaccgggcgggcccttctgcctgctgtcaatcccggccaagaggcctgtttgcacttcactgcaccaggatctcccgactccaagtgcctcaaaattaaggtgaaacgcataaacctgaagtgtaaaaagtcaagtagctactttgtacctgatgccagatcgaggtgcacatccgtgcgtcggtgtcgatgggctggcgactgccagtctgggtgcccaccgcatttcaccagcaattcatttagtgacgattgggcgggaaagatggacagagcaggcttaggtttctccgggtgttctgatggatgcggcggtgccgcttgtggctgctttaacgccgcacccagctgtatcttctggaggaaatgggttgaaaatcctcacgggattatctggaaggtctccccatgcgccgcttgggtgccctcagccgtgattgagctgacgatgcctagcggagaagtccgcaccttccacccaatgagtggcatccccacacaggtttttaaaggggtgtctgtgacttatctaggatccgacatggaggtaagcggcctcaccgatctgtgtgaaatagaggagcttaagtcgaaaaagttggcactggcgccgtgcaaccaggctggtatgggggtcgtgggaaaagttggcgaaatccaatgttcatctgaggaaagtgcccggacaattaagaaggacggttgcatctggaacgcagatctcgtgggcattgagctgagagtcgacgatgccgtgtgttactccaaaatcactagcgttgaagctgtggccaattattctgcaatacctaccacaattgggggacttaggttcgagcgcagccatgactcccagggcaagatctcagggagtccactggatattaccgctatccgaggcagcttttctgtaaactaccggggattgcgtctctccctgtcagagataactgccacgtgcacaggtgaagtcaccaatgtgagtgggtgctacagctgtatgactggagcgaaagtgtccatcaagttacactcttcgaaaaacagcaccgcccatgtcagatgcaagggcgacgagacagctttctcagttctggaaggtgtgcactcctataccgtaagtctatcttttgatcacgcagtggtcgacgagcagtgtcagctcaattgcggcgggcatgaaagccaagtgactctgaagggaaaccttattttcttggacgttcccaaatttgtggatggctcctacatgcagacatatcactcaacggtccctaccggggccaatatcccctctccaactgactggctgaacgctctcttcggaaatggcctgagtaggtggattttaggtgtgatcggggttctgcttggaggcttggccctctttttcatgataatgagcctgtttaagctaggcacaaaacaggtgttccgctcccggaccaagctggcatga

SEQ ID NO: 11447 - RNA, 3222 nt, synthetic construct
  misc_feature 1..3222: note = derived and/or modified CDS sequence (opt3) from SFTSV(42-Lu'an(CHN)-2015)__KX302602.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggtttctccgagaagatctgtcaaatagacagactgatccacgtttcttcgtggttgaggaatcattcacagtttcagggctacgtggggcagcggggaggccgcagccaagtaagttattacccggcagaaaactcctattctcgatggagcggtttactgtccccctgcgatgccgactggctagggatgctcgtggtcaaaaaggcgaaaggatcagatatgattgtgcctggcccaagttacaagggcaaggttttctttgagcgtcccaccttcgacgggtatgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagacctttctcgagctgaagtcgttctctcagtccgaatttccagacatctgcaaaatagatggaattgtattcaatcagtgtgagggcgaatcactgccgcaaccctttgacgttgcctggatggatgtgggccacagtcataagatcattatgcgggagcacaaaacaaagtgggtccaggagagctcctctaaggacttcgtgtgctacaaagaagggactggaccttgtagcgagtcagaagagaagacctgcaaaacaagtggttcctgccgcggcgacatgcagttttgtaaggtggcagggtgcgaacacggagaggaggccagcgaagctaaatgtagatgctctctcgtccataagccaggcgaggttgtggtatcatatggtaggatgcgggtgcgccccaaatgttacgggttcagtcgaatgatggcaaccttagaagtcaaccagcctgagcaaagaatcggccagtgcactggatgtcacctggaatgcatcaatggcggggtgaggcttattacattgaccagcgagctgaagtccgccacggtttgtgcttctcatttctgctcgagcgccacttccggaaagaaatcaaccgagatacagtttcacagtggttctctagtgggcaagacagcgatccacgtcaaaggggcactcgtggatggaactgagttcacctttgaaggcagctgtatgttcccagacggttgcgatgccgtagactgcacattttgtcgggagttcctgaagaacccccaatgctacccggctaaaaagtggctttttattatcatagttattctgttggggtatgccggcctcatgctgttaaccaatgtgctgaaggcaatcggaatctggggctcctgggtcattgctcctgtgaaactcatcttcgccattataaagaaacttatgcgtacggtctcatgtctgatggggaagttgatggatcgcggaagacaggtgatccatgaagaaattggtgagaacagggagggcaatcaggacgatgttcggatcgaaatggcgcgaccccgcagagtgaggcactggatgtacagcccagtaatcctaactattctggccatagggctcgcagagtcttgcgacgaaatggtccatgctgattccaaactggtgagttgtcggcagggaagcggcaacatgaaggagtgcgttacaaccggtcgcgcccttctgcctgctgtgaatcccgggcaagaggcctgtttgcactttactgcaccaggctctcccgactccaagtgcctcaaaatcaaggtcaaaagaattaacctgaagtgtaaaaagtcaagtagctatttcgtgcctgatgccaggtcgcgttgcacatccgtacggcgatgtagatgggctggagactgccagtctggctgcccaccgcattttaccagcaattcattcagtgacgattgggcggggaagatggacagggcaggattaggcttttccggttgttctgatgggtgcggaggcgccgcttgtggttgcttcaacgccgcacccagctgtatcttctggcgcaaatgggtggaaaatcctcacggcattatctggaaggtttccccatgcgccgcttgggtcccctcagccgtgatagagctgacgatgcctagcggggaagtgcggacctttcacccaatgagtggaatccccacacaggtcttcaaaggcgtttctgtgacttacctagggtccgacatggaggtgagcggactcaccgatctgtgtgaaattgaggagcttaagtcgaaaaagttggcactggcgccgtgcaaccaggctggcatgggtgtagtcgggaaagtgggagaaatccaatgttcatctgaggaaagtgccagaacaattaagaaggacggctgcatctggaacgcagatctcgttggtatagagctgagggtggacgatgccgtctgttattccaaaattactagcgtggaagctgtttctaattacagcgccatccctaccacaattggcgggcttcgctttgagcgatcccatgactcacagggaaagatcagtggcagcccactggatataaccgcaatccgggggtctttctccgtgaactatcgtggattgagactctcactgagtgagattactgctacgtgcacaggcgaagtaaccaatgtcagcggttgctactcctgtatgactggggccaaagtgtctatcaagttacactcgagcaaaaactcaaccgcgcatgtgaggtgcaagggagacgagacagccttttccgtcctggaaggcgttcacagttacaccgtgtctttgagcttcgatcacgctgtagtggacgagcagtgtcagctcaattgcggtggccatgaatcccaagtcactctgaaggggaaccttatttttctagacgtgcccaaattcgttgatggatcatatatgcagacataccactctacggtgcctaccggcgcaaatatccccagcccaactgactggctgaacgccctctttgggaatggactgagtcgctggatattaggcgtcattggtgtgctgcttgggggattggctctcttctttatgatcatgtccctgttcaagctaggcacaaaacaggtttttcggagcagaaccaagctggcctga

SEQ ID NO: 11448 - RNA, 3222 nt, synthetic construct
  misc_feature 1..3222: note = derived and/or modified CDS sequence (opt3) from SFTSV(44-Lu'an(CHN)-2015)__KX302603.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggtttctccgagaagatctgtcaaatagacagactgatccacgtttcttcgtggttgaggaatcattcacagtttcagggctacgtggggcagcggggaggccgcagccaagtaagttattacccggcagaaaactcctattctcgatggagcggtttactgtccccctgcgatgccgactggctagggatgctcgtggtcaaaaaggcgaaaggatcagatatgattgtgcctggcccaagttacaagggcaaggttttctttgagcgtcccaccttcgacgggtatgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagacctttctcgagctgaagtcgttctctcagtccgaatttccagacatctgcaaaatagatggaattgtattcaatcagtgtgagggcgaatcactgccgcaaccctttgacgttgcctggatggatgtgggccacagtcataagatcattatgcgggagcacaaaacaaagtgggtccaggagagctcctctaaggacttcgtgtgctacaaagaagggactggaccttgtagcgagtcagaagagaagacctgcaaaacaagtggttcctgccgcggcgacatgcagttttgtaaggtggcagggtgcgaacacggagaggaggccagcgaagctaaatgtagatgctctctcgtccataagccaggcgaggttgtggtatcatatggtgggatgagggtgcggcccaaatgttacggcttcagtcgcatgatggcaaccttagaagtcaaccagcctgagcaacgaatcggacagtgcactggctgtcacctggaatgcatcaatgggggagtgagacttattacattgaccagcgagctgaagtccgccacggtttgtgcttctcatttctgctcgagcgccacttccggtaagaaatcaaccgagatacagtttcacagtggctctctagtggggaagacagcgatccacgtcaaaggagcactcgtggatggcactgagttcacctttgaaggtagctgtatgttcccagacgggtgcgatgccgtagactgcacattttgtagggagttcctgaagaacccccaatgctacccggctaaaaagtggctttttattatcatagttattctgttgggctatgccggactcatgctgttaaccaatgtgctgaaggcaatcggcatctgggggtcctgggtcattgctcctgtgaaactcatcttcgccattataaagaaacttatgcggacggtctcatgtctgatgggaaagttgatggatcgtggtcgccaggtgatccatgaagaaattggcgagaacagagaggggaatcaggacgatgttaggatcgaaatggcgcggccccgacgcgtgagacactggatgtacagcccagtaatcctaactattctggccataggactcgcagagtcttgcgacgaaatggtccatgctgattccaaactggtgagttgtaggcagggcagcggtaacatgaaggagtgcgttacaaccgggcgggcccttctgcctgctgtgaatcccggccaagaggcctgtttgcactttactgcaccaggatctcccgactccaagtgcctcaaaatcaaggtcaaacgcattaacctgaagtgtaaaaagtcaagtagctatttcgtgcctgatgccagatcgaggtgcacatccgtacgtcggtgtcgatgggctggcgactgccagtctgggtgcccaccgcattttaccagcaattcattcagtgacgattgggcgggaaagatggacagagcaggcttaggtttttccgggtgttctgatggatgcggcggtgccgcttgtggctgcttcaacgccgcacccagctgtatcttctggaggaaatgggtggaaaatcctcacgggattatctggaaggtttccccatgcgccgcttgggtcccctcagccgtgatagagctgacgatgcctagcggagaagtgcgcacctttcacccaatgagtggcatccccacacaggtcttcaaaggggtttctgtgacttacctaggatccgacatggaggtgagcggcctcaccgatctgtgtgaaattgaggagcttaagtcgaaaaagttggcactggcgccgtgcaaccaggctggtatgggggtagtcggaaaagtgggcgaaatccaatgttcatctgaggaaagtgcccggacaattaagaaggacggttgcatctggaacgcagatctcgttggcatagagctgagagtggacgatgccgtctgttattccaaaattactagcgtggaagctgtttctaattacagcgccatccctaccacaattgggggacttaggtttgagcgctcccatgactcacagggcaagatcagtgggagcccactggatataaccgcaatccgaggatctttctccgtgaactatcggggcttgcgtctctcactgagtgagattactgctacgtgcacaggtgaagtaaccaatgtcagcgggtgctactcctgtatgactggagccaaagtgtctatcaagttacactcgagcaaaaactcaaccgcgcatgtgagatgcaagggcgacgagacagccttttccgtcctggaaggtgttcacagttacaccgtgtctttgagcttcgatcacgctgtagtggacgagcagtgtcagctcaattgcggcgggcatgaatcccaagtcactctgaagggaaaccttatttttctagacgtgcccaaattcgttgatggctcatatatgcagacataccactctacggtgcctaccggggcaaatatccccagcccaactgactggctgaacgccctctttggaaatggcctgagtaggtggatattaggtgtcattggggtgctgcttggaggcttggctctcttctttatgatcatgtccctgttcaagctaggcacaaaacaggtttttcgcagccggaccaagctggcctga

SEQ ID NO: 11449 - RNA, 3222 nt, synthetic construct
  misc_feature 1..3222: note = derived and/or modified CDS sequence (opt3) from SFTSV(52-Lu'an(CHN)-2015)__KX302604.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaaccagcctgagcaacgaatcggacagtgcactggctgtcacctggaatgcatcaatgggggagtgagacttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggatggcactgaatttaccttcgagggtagctgtatgtttccagacgggtgcgatgccgtagactgcacattctgtagggaatttctgaagaacccccaatgctatccggctaaaaagtggcttttcattatcatagttattctgttgggctacgccggactcatgctgttaaccaatgtgctgaaggcaatcggcatctgggggtcctgggtcattgctcctgtgaaactcatctttgccattataaagaaacttatgcggacggtctcatgtctgatgggaaagttgatggatcgtggtcgccaggtgatccatgaggaaattggcgagaacagagaggggaatcaggacgatgttaggatcgaaatggcgcggccccgacgcgtgagacactggatgtatagcccagtaatcctaactattctggccataggactcgcagagtcttgcgacgaaatggtccatgctgattccaaactggtgagttgtaggcagggcagcggtaacatgaaggagtgcgttacaaccgggcgggcccttctgcctgctgtgaatcccggccaagaggcctgtttgcacttcactgcaccaggatctcccgactccaagtgcctcaaaatcaaggtcaaacgcattaacctgaagtgtaaaagatcaagtagctactttgtgcctgatgccaggtcgcgttgcacatccgtacggcgatgtagatgggctggcgactgccagtctgggtgcccaccgcatttcaccagcaattcatttagtgacgattgggcgggaaagatggacagggcaggcttaggtttctccgggtgttctgatggatgcggcggtgccgcttgtggctgctttaacgccgcacccagctgtatcttctggcgcaagtgggtggaaaatcctcacgggattatctggaaagtttccccatgcgccgcttgggtcccctcagccgtgatagagctgacgatgcctagcggagaagtgcggaccttccacccaatgagtggcatccccacacaggtctttaagggggtttctgtgacttatctaggatccgacatggaggtgagcggcctcaccgatctgtgtgaaattgaggagcttaaatcgaagaaattggcactggcgccgtgcaaccaggctggtatgggggtagtcggaaaggtgggcgaaatccaatgttcatctgaggaaagtgccagaacaattaaaaaggacggttgcatctggaacgcagatctcgttggcatagagctgagggtggacgatgccgtctgttactccaagattactagcgtggaagctgttgccaattattctgcaatccctaccacaattgggggacttcgcttcgagcgaagccatgactcccagggcaaaatctcagggagtccactggatataaccgctatccggggcagcttttctgtgaactaccgtggattgagactctccctgtcagagattactgccacgtgcacaggtgaagtaaccaatgtcagtgggtgctacagctgtatgactggagcgaaggtgtccatcaaattacactcttcgaagaacagcaccgcccatgtgaggtgcaaaggcgacgagacagctttctcagtcctggaaggtgttcactcctataccgtgagtctatcttttgatcacgcagtagtggacgagcagtgtcagctcaattgcggcgggcatgaaagccaagtcactctgaagggaaaccttattttcttggacgtgcccaagtttgttgatggctcctacatgcagacatatcactcaacggtgcctaccggggccaatatcccctctccaactgactggctgaacgctctcttcggaaatggcctgagccgctggatattaggtgtcattggggtgctgcttggaggcttggccctctttttcatgatcatgagtctgtttaaactaggcacaaagcaggttttccggtccagaaccaaactggcatga

SEQ ID NO: 11450 - RNA, 3222 nt, synthetic construct
  misc_feature 1..3222: note = derived and/or modified CDS sequence (opt3) from SFTSV(HL/Injected)__KF791953.1__GP
  source 1..3222: mol_type = other RNA
atgatgaaggtgatctggttcagctccctgatttgcctcgtcatacagtgtggcggggacaccggacccatcatttgcgccggtcctatccactctaacaaatcagctgatattccacatcttctgggctacagtgagaagatctgtcaaatagacagattgatccacgttagctcctggttaaggaatcattctcagtttcaggggtatgtgggacagcggggcggtcgctcgcaagtatcatactatccggcagaaaacagctacagtcgatggtccgggctgctatctccctgcgatgccgactggctcggaatgctggtggtcaaaaaggcgaaaggcagcgatatgattgtgcctggcccatcctataaggggaaggttttctttgagcgtcccacattcgacggatacgtgggttggggctgtgggtcaggaaaaagtagaactgaaagcggcgagctttgcagttccgattcaggtacgagcagtgggctgttgccttctgacagggtcctctggatcggagatgtggcttgtcagccaatgacccccattcctgaagagacatttctggagctgaagtccttcagccagtcggaatttccagacatctgcaaaatagatggcattgtattcaatcagtgtgagggcgaatctctcccgcaaccctttgacgttgcctggatggatgtggggcactcccataagatcattatgcgggagcacaaaactaagtgggtccaggagtcaagtagcaaggacttcgtgtgctataaagaaggaaccggtccttgttccgagtctgaagagaagacatgcaaaaccagcggctcatgccgcggggacatgcagttttgtaaggtggcaggatgcgaacacggcgaggaggccagtgaagctaaatgtagatgctccttagtccataagccaggtgaggttgtggtaagctacgggggcatgagggtgcggcccaaatgttacggattctctcgcatgatggcaactctggaagtctcacagcctgagcaacgaatcggccagtgcacagggtgtcaccttgaatgcatcaacggaggtgtgagattgattaccctgacgagtgagctaaagagcgccactgtttgtgcttcccatttttgttcttcggccaccagcggcaagaaatccacagagatacagttccactcagggagtctcgtgggaaagactgcgatccacgtcaaaggcgcactggtggatggtaccgagttcacatttgaagggtcttgcatgttcccagacggctgcgatgccgtagactgcaccttttgtagggagttccttaagaatccccaatgctatccggctaaaaagtggctgtttattatcatagttattttgctcggatacgccggcctgatgttactgacgaacgtgctcaaggcaatcggggtctggggaagctgggtgatcgctcctgtcaaacttgtgttcgccattatcaagaaactgatgcgggcggtttcctgtttgatgggtaagctaatggatcgtggccgccaggtgattcatgaagaaataggggagaatagagagggaaaccaggacgatgtaaggatcgaaatggcccggccccgacgcgtcagacactggatgtattcaccagtgattctgactatcctcgcaatcggcctggctgagggttgcgacgaaatggttcatgccgatagcaaacttgtgtcttgtaggcaggggtccggcaatatgaaggagtgcgtcacaaccggacgggctctgttgcctgccgtgaaccccggccaagaggcatgtctccactttactgccccagggagtcccgacagcaagtgcctgaaaattaaggtaaaacgcataaatttaaagtgtaaaaagtcttcctcatacttcgtgcctgatgctagaagtaggtgcacaagcgttcgtcggtgtcgatgggcgggagactgccagtcgggctgcccaccgcattttacctccaactctttcagcgacgattgggcaggtaagatggacagagccgggctgggattttcaggctgtagtgatggttgcggcggggctgcctgtggatgcttcaatgcagccccctcctgtatcttttggaggaaatgggtcgaaaaccctcacggcattatctggaaggtgtctccatgcgctgcctgggtgcccagcgcagtcattgagctaacgatgccttccggggaagttcgcaccttccacccaatgtcaggaatccccacacaggtgttcaaaggcgtgagcgtaacttatctcggtagtgacatggaggtctctgggctgaccgatctttgtgaaatagaggagttgaagtccaaaaagctggcgctcgctccgtgcaatcaggccggaatgggcgtggttggtaaagtgggcgaaatccaatgtagctcggaggaatcagcacggacaattaagaaggacgggtgcatctggaacgccgatctggtcggaattgagcttagagtggacgatgctgtttgttactctaaaatcacttctgtggaagccgtagcaaactattccgctatacctaccacaattggcgggctgaggtttgagcgcagccatgactctcagggaaagatcagcggctccccattggatattaccgccatccgaggttcattcagtgtcaattaccgggggctccgtctgagcttatctgagataactgcgacgtgcacaggagaagtgaccaacgtgtccggctgctactcatgtatgactggtgccaaagtcagtatcaagctgcacagctccaaaaattctaccgctcatgttagatgcaagggcgacgagacagcattttcggtgctagaaggggtacacagctattcagtgtccctcagtttcgatcacgccgtcgtggacgagcagtgtcagctgaactgcggaggccatgaatctcaagttacccttagggggaatttgatttttctggacgtgcccaagttcgtcgatggaagctacatgcagacttatcactccacagtgcctacgggcgctaacatcccctcaccaaccgactggctcaatgccctgtttggtaacgggttatctcgctggattctgggagttatcggcgtgcttttgggcgggctcgcactgttctttctaataatgagcctgttcaaactcggaactaagcagatttttcggagtagaacaaaactggcgtga

SEQ ID NO: 11451 - RNA, 3222 nt, synthetic construct
  misc_feature 1..3222: note = derived and/or modified CDS sequence (opt3) from SFTSV(HL/Larvae/G2)__KF791955.1__GP
  source 1..3222: mol_type = other RNA
atgatgaaggtgatctggttcagctccctgatttgcctcgtcatacagtgtggcggggacaccggacccatcatttgcgccggtcctatccactctaacaaatcagctgatattccacatcttctgggctacagtgagaagatctgtcaaatagacagattgatccacgttagctcctggttaaggaatcattctcagtttcaggggtatgtgggacagcggggcggtcgctcgcaagtatcatactatccggcagaaaacagctacagtcgatggtccgggctgctatctccctgcgatgccgactggctcggaatgctggtggtcaaaaaggcgaaaggcagcgatatgattgtgcctggcccatcctataaggggaaggttttctttgagcgtcccacattcgacggatacgtgggttggggctgtgggtcaggaaaaagtagaactgaaagcggcgagctttgcagttccgattcaaggacgagcagtggtctgttgccttctgaccgggtcctctggatcggggatgtggcttgtcagccaatgacccccattcctgaagagacatttctggagctgaagtccttcagccagtcggaatttccagacatctgcaaaatagatggaattgtattcaatcagtgtgagggcgaatctctcccgcaaccctttgacgttgcctggatggatgtgggccactcccataagatcattatgcgcgagcacaaaactaagtgggtccaggagtcaagtagcaaggacttcgtgtgctataaagaagggaccggaccttgttccgagtctgaagagaagacatgcaaaaccagcggttcatgcagaggcgacatgcagttttgtaaggtggcagggtgcgaacacggagaggaggccagtgaagctaaatgtaggtgctccttagtccataagccaggcgaggttgtggtaagctacggtgggatgcgggtgcgccccaaatgttacggcttctctcgaatgatggcaactctggaagtctcacagcctgagcaaagaatcggacagtgcacaggctgtcaccttgaatgcatcaacgggggagtgaggttgattaccctgacgagtgagctaaagagcgccactgtttgtgcttcccatttttgttcttcggccaccagcggtaagaaatccacagagatacagttccactcaggcagtctcgtggggaagactgcgatccacgtcaaaggagcactggtggatggcaccgagttcacatttgaaggttcttgcatgttcccagacgggtgcgatgccgtagactgcaccttttgtcgggagttccttaagaatccccaatgctatccggctaaaaagtggctgtttattatcatagttattttgctcggctacgccggactgatgttactgacgaacgtgctcaaggcaatcggcgtctgggggagctgggtgatcgctcctgtcaaacttgtgttcgccattatcaagaaactgatgcgtgcggtttcctgtttgatgggaaagctaatggatcgcggtagacaggtgattcatgaagaaataggcgagaatagggaggggaaccaggacgatgtacggatcgaaatggcccgaccccgcagagtcaggcactggatgtattcaccagtgattctgactatcctcgcaatcggactggctgagggctgcgacgaaatggttcatgccgatagcaaacttgtgtcttgtcggcagggttccgggaatatgaaggagtgcgtcacaaccggccgcgctctgttgcctgccgtgaaccccggacaagaggcatgtctccactttactgccccaggcagtcccgacagcaagtgcctgaaaattaaggtaaaaagaataaatttaaagtgtaaaaagtcttcctcatacttcgtgcctgatgctaggagtcgttgcacaagcgttcggcgatgtagatgggcgggggactgccagtcgggatgcccaccgcattttacctccaactctttcagcgacgattgggcaggcaagatggacagggccggtctggggttttcaggatgtagtgatggctgcggtggcgctgcctgtgggtgcttcaatgcagccccctcctgtatcttttggcgcaaatgggtcgaaaaccctcacggaattatctggaaggtgtctccatgcgctgcctgggtgcccagcgcagtcattgagctaacgatgccttccggcgaagttcggaccttccacccaatgtcagggatccccacacaggtgttcaaaggagtgagcgtaacttatctcggcagtgacatggaggtctctggtctgaccgatctttgtgaaatagaggagttgaagtccaaaaagctggcgctcgctccgtgcaatcaggccgggatgggagtggttggcaaagtgggtgaaatccaatgtagctcggaggaatcagcaagaacaattaagaaggacggctgcatctggaacgccgatctggtcgggattgagcttagggtggacgatgctgtttgttactctaaaatcacttctgtggaagccgtagcaaactattccgctatacctaccacaattggaggcctgcgctttgagcgaagccatgactctcaggggaagatcagcggatccccattggatattaccgccatccggggctcattcagtgtcaattaccgtggtctcagactgagcttatctgagataactgcgacgtgcacaggggaagtgaccaacgtgtccggatgctactcatgtatgactggcgccaaagtcagtatcaagctgcacagctccaaaaattctaccgctcatgttaggtgcaagggtgacgagacagcattttcggtgctagaaggcgtacacagctattcagtgtccctcagtttcgatcacgccgtcgtggacgagcagtgtcagctgaactgcgggggacatgaatctcaagttacccttcgcggcaatttgatttttctggacgtgcccaagttcgtcgatgggagctacatgcagacttatcactccacagtgcctacgggagctaacatcccctcaccaaccgactggctcaatgccctgtttggcaacggtttatctcggtggattctgggggttatcggagtgcttttgggcggcctcgcactgttctttctaataatgagcctgttcaaactcgggactaagcagatttttagaagtaggacaaaactggcgtga

SEQ ID NO: 11452 - RNA, 3222 nt, synthetic construct
  misc_feature 1..3222: note = derived and/or modified CDS sequence (opt3) from SFTSV(JS2011-004)__KC505124.1__GP
  source 1..3222: mol_type = other RNA
atgatgaaggtgatctggttcagctccctgatttgcctcgtcatacagtgtggcggggacaccggacccatcatttgcgccggtcctatccactctaacaaatcagctgatattccacatcttctgggctacagtgagaagatctgtcaaatagacagattgatccacgttagctcctggttaaggaatcattctcagtttcaggggtatgtgggacagcggggcggtcgctcgcaagtatcatactatccggcagaaaacagctacagtcgatggtccgggctgctatctccctgcgatgccgactggctcggaatgctggtggtcaaaaaggcgaaaggcagcgatatgattgtgcctggcccatcctataaggggaaggttttctttgagcgtcccacattcgacggatacgtgggttggggctgtgggtcaggaaaaagtagaactgaaagcggcgagctttgttcttccgattcaggtacgagcagtgggctgttgccttctgacagggtcctctggatcggagatgtggcttgccagccaatgacccccattcctgaagagacatttctggagctgaagtccttcagccagtcggaatttccagacatctgcaaaatagatggcattgtattcaatcagtgtggcggggagtctctcccgcaaccctttgacgttgcctggatggatgtgggacactcccataagatcattatgcgggaacacaaaactaagtgggtccaggagtcaagtagcaaggacttcgtgtgctataaagagggtaccggcccttgttccgaatctgaggaaaagacatgcaaaaccagcgggtcatgccgcggagacatgcagttttgtaaggtggcaggctgcgagcacggtgaagaggccagtgaggctaaatgtagatgctccttagtccataagccaggggaagttgtggtaagctacggcggaatgagggtgcggcccaaatgttacggcttctctcgcatgatggcaactctggaggtcaaccagcctgaacaacgaatcgggcagtgcacaggatgtcaccttgagtgcatcaatggtggcgtgagattgattaccctgacgtcagaactaaagagtgccactgtttgtgctagccatttttgctcctctgccacctcggggaagaaaagcacagagatacagttccactccggatcactcgtgggcaagactgcgatccacgtcaaaggtgcactggtggatgggaccgagttcacatttgaaggcagttgtatgttcccagacggatgcgatgccgtagactgcaccttttgtagggagttccttaagaacccccaatgctatccggctaaaaagtggctgtttattatcatagttattttgctcggctacgccgggctgatgttactgacgaatgtgctcaaggcaatcggagtctggggttcttgggtgatcgctcctgtcaaacttgtgttcgccattatgaagaaactgatgcgggcggttagctgtttgatgggcaagctaatggatcgtgggcgccaggtgatccatgaagagattggagaaaacagagagggcaatcaggacgatgtaaggatagagatggcccggccccgacgcgtcagacactggatgtattccccagtgatcctgactattctcgcaatcggtctggctgaagggtgcgacgagatggttcatgccgattcaaaacttgtgagctgtaggcagggctctggaaacatgaaggaatgcgtcacaaccggccgggctctgttgcctgccgtgaatcccgggcaagaggcatgtctccactttactgccccaggatcccccgacagtaagtgcctgaaaatcaaggtaaaacgcattaacttaaagtgtaaaaagtcgtcttcctacttcgtgcctgatgctagatcaaggtgcacaagtgttcgtcggtgtcgatgggcgggcgactgccagagcggttgcccaccgcattttaccagcaattccttctctgacgattgggcagggaagatggacagagccggactgggctttagcggttgttcagatggctgcgggggagctgcctgtggctgcttcaacgcagcccccagttgtatattttggaggaaatgggtcgagaatcctcacgggatcatttggaaggtgtccccatgcgctgcctgggtgccctctgcagtcatcgaactaacgatgcctagcggagaggttcgcaccttccacccaatgtccggcattcccacacaggtgttcaaaggtgtgtcagtaacttatctcgggagcgacatggaagtcagtggactgaccgatctttgtgagatcgaagagttgaagtctaaaaagctggcgctcgctccgtgcaaccaggccggcatgggtgtggttggcaaagtgggggagatacaatgttccagcgaagagtcggcacggacaatcaagaaggacggatgcatttggaacgccgatctggtcggcatcgaacttagagtggacgatgctgtttgttactcaaaaattacttctgtggaggccgtagcaaattatagtgctatccctaccacaatagggggactgaggtttgaacgctcccatgacagccagggcaagatttctggtagcccattggatatcaccgccattcgagggtccttctcagtcaactaccggggactccgtctgagtttaagcgagatcactgcgacgtgcacaggcgaggtgaccaatgtgtctggttgctactcctgtatgactggcgccaaagtctcaataaagctgcacagtagcaaaaactccaccgctcatgttagatgcaagggggacgaaacagcattttctgtgctagagggagtacactcgtatagcgtgtcactctccttcgatcacgccgtcgtggacgaacagtgtcagctgaattgcggcgggcatgagagtcacgttacccttaagggaaacttgatctttctggacgtgcccaaattcgtcgatggctcttacatgcaaacttatcatagcacagtgcctacgggtgctaatattccctccccaaccgactggctcaacgccctgtttgggaatggattatcaaggtggatcctgggcgttattggcgtgcttctcgggggattggcactgttctttctaatcatgtctctgttcaagctcggtactaaacaggtctttcgcagccggacaaagctggcgtga

SEQ ID NO: 11453 - RNA, 3222 nt, synthetic construct
  misc_feature 1..3222: note = derived and/or modified CDS sequence (opt3) from SFTSV(JS2011-013-1)__KC505127.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaaccagcctgagcaacgactgggacagtgcactggctgtcaccttgaatgcatcaatgggggagtgagattgatcacactgaccagcgagctaaagtccgccacggtttgtgcttctcatttctgctcgagcgccacttccggtaagaaatcaaccgagattcagttccacagtggctctctcgtggggaagacagcgatacacgtcaaaggagcactggtggatggcactgaatttaccttcgagggtagctgtatgtttccagacgggtgcgatgccgtagactgcacattctgtagggaatttcttaagaacccccaatgctatccggctaaaaagtggctgttcatcattatcgttatattgctcggctacgccggactgatgttactgaccaatgtgctcaaggcaattggcatctgggggtcctgggtcatcgctcctgtgaaacttatgtttgccattatcaagaaactgatgcggacggtctcatgtttgatgcgtaagctaatggatcgcggaagacaggtgattcatgaggaaataggtgagaacagggagggcaatcaggacgatgttcggatcgaaatggcgcgaccccgcagagtgaggcactggatgtatagcccagtaattctgactatcctcgccatcgggctggcagagtcttgcgacgaaatggtccatgctgattccaaacttgtgagttgtcggcagggaagcggcaacatgaaggagtgcgttacaaccggtcgcgccctgttgcctgctgtgaatcccgggcaagaggcctgtctccacttcactgcaccaggctctcccgactccaagtgcctgaaaattaaggtcaaaagaataaacttaaagtgtaaaaagtcaagtagctactttgtgcctgatgccaggtcgcgttgcacatccgtacggcgatgtagatgggctggagactgccagtctggctgcccaccgcatttcaccagcaattcatttagtgacgattgggcggggaagatggacagggcaggactgggcttctccggttgttctgatgggtgcggaggcgccgcttgtggttgctttaacgccgcacccagctgtatcttctggcgcaaatgggtggaaaatcctcacggcattatctggaaggtttccccatgcgccgcttgggtcccctcagccgtgattgagctaacgatgcctagcggggaagtgcggaccttccacccaatgagtggaatccccacacaggtctttaaaggcgtttctgtgacttatctcgggtccgacatggaggtgagcggactgaccgatctttgtgaaatagaggagttgaagtcgaaaaagctggcactcgcgccgtgcaaccaggctggcatgggtgtagtcgggaaagtgggagaaatccaatgttcatctgaggaaagtgccagaacaattaagaaggacggctgcatctggaacgcagatctggttggtattgagcttagggtggacgatgccgtctgttactccaaaatcactagcgtggaagctgttgccaattattctgcaatacctaccacaattggcgggctgcgcttcgagcgaagccatgactcccagggaaagatctcaggcagtccattggatattaccgctatccgggggagcttttctgtgaaataccgtggactcagactgtccttatcagagataactgccacgtgcacaggcgaagtaaccaacgtcagtggttgctacagctgtatgactggggcgaaggtgtccatcaaactgcactcttcgaagaatagcaccgcccatgtgaggtgcaagggagacgagacagctttctcagtcctagaaggcggtcactcctataccgttagtctctcttttgatcacgcagtggtagacgagcagtgtcagctgaactgcggcgggcatgaaagccaagtgactcttaaaggaaatttgattttcctggacgtccccaagtttgtggatggctcctacatgcagacatatcactcaacggttcctaccggggccaacatcccctctccaactgactggctcaatgctctgttcggaaacggcttaagccgctggattctgggtgtgatcggggtccttttgggaggcctcgccctgtttttcatgataatgagtctatttaaactgggcacaaaacaggtgttccggtccagaaccaagctcgcatga

SEQ ID NO: 11454 - RNA, 3222 nt, synthetic construct
  misc_feature 1..3222: note = derived and/or modified CDS sequence (opt3) from SFTSV(JS2011-027)__KC505130.1__GP
  source 1..3222: mol_type = other RNA
atgatgaaggtgatctggttcagctccctgatttgcctcgtcatacagtgtggcggggacaccggacccatcatttgcgccggtcctatccactctaacaaatcagctgatattccacatcttctgggctacagtgagaagatctgtcaaatagacagattgatccacgttagctcctggttaaggaatcattctcagtttcaggggtatgtgggacagcggggcggtcgctcgcaagtatcatactatccggcagaaaacagctacagtcgatggtccgggctgctatctccctgcgatgccgactggctcggaatgctggtggtcaaaaaggcgaaaggcagcgatatgattgtgcctggcccatcctataaggggaaggttttctttgagcgtcccacattcgacggatacgtgggttggggctgtgggtcaggaaaaagtagaactgaaagcggcgagctttgcagttccgattcaggtacgagcagtgggctgttgccttctgacagggtcctctggatcggagatgtggcttgtcagccaatgacccccattcctgaagagacatttctggagctgaagtccttcagccagtcggaatttccagacatctgcaaaatagatggcattgtattcaatcagtgtgagggcgaatctctcccgcaaccctttgacgttgcctggatggatgtggggcactcccataagatcattatgcgggagcacaaaactaagtgggtccaggagtcaagtagcaaggacttcgtgtgctataaagaaggaaccggtccttgttccgagtctgaagagaagacatgcaaaaccagcggctcatgccgcggggacatgcagttttgtaaggtggcaggatgcgaacacggcgaggaggccagtgaagctaaatgtagatgctccttagtccataagccaggtgaggttgtggtaagctacgggggcatgagggtgcggcccaaatgttacggattctctcgcatgatggcaactctggaagtcaacgagcctgaacagcgaatcggccaatgcacagggtgtcaccttgagtgcatctcaggaggtgtgagattgattaccctgacgagtgagctaaagagcgccactgtttgtgcttcccatttttgttcttcggccaccagcggcaagaaatccacagaaatacagttccactcagggagtctcgtgggaaagactgcgatccacgtcaaaggcgcactggtggatggtaccgagttcacatttgaagggtcttgcatgttcccagacggctgcgatgccgtagactgcaccttttgtagggagttccttaagaatccccagtgctatccggctaaaaagtggctgtttattatcatagttattttgctcggatacgccggcctgatgttactgacgaacgtgctcaaggcaatcggggtctggggaagctgggtgatcgctcctgtcaaacttgtgttcgccattatcaagaaactgatgcgggcggtttcctgtttgatgggtaagctaatggatcgtggccgccaagtgattcatgaagagataggggagaatagagaaggaaaccaggacgatgtaaggatcgagatggcccggccccgacgcgtcagacactggatgtattcaccagtgattctgactatcctcgcaatgggcctggctgaaggttgcgacgagatggttcatgccgatagcaaacttgtgtcttgtaggcaggggtccggcaatatgaaggagtgcgtcacaaccggacgggctctgttgcctgccgtgaaccccggccaggaagcatgtctccactttactgccccagggagtcccgacagcaagtgcctgaaaatcaaggtaaaacgcattaatttaaagtgtaaaaagtcttcctcatacttcgtgcctgatgctagaagtaggtgcacaagcgttcgtcggtgtcgatgggcgggagactgccaatcgggctgcccaccgcattttacctccaactctttcagcgacgattgggcaggtaagatggacagagccgggctgggattttcaggctgtagtgatggttgcggcggggctgcctgtggatgcttcaatgcagccccctcctgtatattttggaggaaatgggtcgagaaccctcacggcatcatttggaaggtgtctccatgcgctgcctgggtgcccagcgcagtcatcgaactaacgatgccttccggggaggttcgcaccttccacccaatgtcaggcattcccacacaggtgttcaaaggagtgagcgtaacttatctcggtagtgacatggaagtctctgggctgaccgatctttgtgagatcgaggaattgaagtccaaaaagctggcgctcgctccgtgcaatcaggccggaatgggcgtggttggtaaagtgggcgagatacagtgtagctcggaagagtcagcacggacaatcaagaaggacgggtgcatttggaacgccgatctggtcggaatcgaacttagagtggacgatgctgtttgttactctaaaattacttctgtggaggccgtagcaaactattccgctatccctaccacaataggcgggctgaggtttgagcgcagccatgactctcaaggaaagattagcggctccccattggatatcaccgccattcgaggttcattcagtatcaattaccgggggctccgtctgagcttatctgaaataactgcgacgtgcacaggagaggtcaccaacgtgtccggctgctactcatgtatgactggtgccaaagtgagtatcaagctgcacagctccaaaaattctaccgctcatgtcagatgcaagggcgacgaaacagcattttcggttctagagggggtgcacagctattcagtatccctcagtttcgatcacgccgtggtcgacgaacagtgtcagctgaactgcggaggccatgagtctcaggtgacccttagggggaatttgatttttctggacgttcccaagttcgtggatggaagctacatgcaaacttatcactccacagtccctacgggcgctaacatcccctcaccaaccgactggctcaatgccctgtttggtaacgggttatctcgctggattctgggagtgatcggcgttcttttgggcgggctcgcactgttctttctaataatgagcctgttcaaactcggaactaaacaggtgtttcggagtagaacaaagctggcgtga

SEQ ID NO: 11455 - RNA, 3222 nt, synthetic construct
  misc_feature 1..3222: note = derived and/or modified CDS sequence (opt3) from SFTSV(JS2011-034)__KC505133.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgaggatccggcccaaatgttacggctttagtcgcatgatggcaaccttagaagtgaaccagcctgagcaacgaatcggacagtgcactggctgtcacctggaatgcattaatgggggagtcagacttataacattgaccagcgagctgaagtccgccacggtgtgtgcttctcatttctgctcgagcgccacttccggtaagaaatcaaccgagatccagttccacagtggctctctagttgggaagacagcgattcacgtgaaaggagcactcgtcgatggcactgaatttaccttcgagggtagctgtatgtttccagacgggtgcgatgccgtggactgcacattctgtagggaatttctgaagaacccccaatgctatccggctaaaaagtggcttttcatcataattgtaatcctgttgggctacgccggactcatgctgttaaccaatgttctgaaggcaatcggcatttgggggtcctgggtgatcgctcctgtcaaactcatgtttgccattataaagaaacttatgcggacggtgtcatgtctgatgggaaagttgatggatcgtggtcgccaggtcatccatgaggaaattggcgagaacagagaggggaatcaggacgatgtgaggatcgaaatggcgcggccccgacgcgttagacactggatgtatagcccagtgatcctaactttcctggccattggactcgcagagtcttgcgacgaaatggtacatgctgattccaaactggtcagttgtaggcagggcagcggtaacatgaaggagtgcgtgacaaccgggcgggcccttctgcctgctgttaatcccggccaagaggcctgtttgcactttactgcaccaggatctcccgactccaagtgcctcaaaataaaggtgaaacgcatcaacctgaagtgtaaaaagtcaagtagctacttcgtccctgatgccagatcgaggtgcacatccgtgcgtcggtgtcgatgggctggcgactgccagtctgggtgcccaccgcattttaccagcaattcattcagtgacgattgggcgggaaagatggacagagcaggcttaggtttttcctgttgctctgatgggtgtggaggcgccgcttgcggttgtttcaacgccgcacccagctgcattttctggaggaaatgggtagaaaatcctcacggcatcatttggaaggtgtccccatgtgccgcttgggttccctcagccgtcatcgagctgacgatgcctagcggggaagtgcgcacctttcacccaatgagtggaatacccacacaggtgttcaaaggcgtctctgttacttatctagggtccgacatggaggtgagcggactcaccgatctgtgcgaaatcgaggagcttaagtcgaaaaagttggcactggcgccgtgtaaccaggctggcatgggtgtggtagggaaagtcggagaaattcaatgctcatctgaggaaagtgcccggacaatcaagaaggacggctgtatttggaacgcagatctcgtgggtatcgagctgagagttgacgatgccgtgtgctactccaaaataactagcgtcgaagctgtggccaattattctgcaattcctaccacaatcggcgggcttaggtttgagcgcagccatgactcccagggaaagatttcaggcagtccactggatatcaccgctatacgagggagcttctctgttaactaccggggattgcgtctctccctgtcagagatcactgccacgtgcacaggcgaagtgaccaatgtaagtggttgttacagctgcatgactggggcgaaagtctccattaagttacactcttcgaaaaacagcaccgcccatgtgagatgtaagggagacgagacagctttttcagtgctggaaggcgtccactcctataccgttagtctatctttcgatcacgcagtggtagacgagcagtgccagctcaattgtggtggccatgaaagccaagtgactctgaaggggaaccttatctttttggacgtccccaaattcgtggatggatcctacatgcagacatatcactcaacggttcctaccggcgccaatattccctctccaactgactggctgaacgctctctttgggaatggactgagtaggtggatcttaggcgtgataggtgtcctgcttgggggattggccctcttctttatgattatgagcctgctaaagctgggcacaaaacaggtgtaccgctcccggaccaagctcgcatga

SEQ ID NO: 11456 - RNA, 3222 nt, synthetic construct
  misc_feature 1..3222: note = derived and/or modified CDS sequence (opt3) from SFTSV(JS2011-062)__KC505136.1__GP
  source 1..3222: mol_type = other RNA
atgatgaaggtgatctggttcagctccctgatttgcctcgtcatacagtgttctggcgactcagggcccatcatttgcgccggacctatccacagtaacaagagcgctgatattccacatcttctgggttactccgagaagatctgtcaaatagacagattgatccacgtttcttcgtggttaaggaatcattcacagtttcagggctatgtggggcagcggggaggccgcagccaagtaagttactatccggcagtgaactcctactctcgatggagcggtctgctatccccctgcgatgccgactggctcgggatgctggtcgtgaaaaaggcgaaaggatcagatatgattgttcctggcccaagttataagggcaaggtgttctttgaacgtcccaccttcgacgggtacgtcggatggggttgtggcagcgggaaatctagaacagagtccggagaactttgctcaagcgatagtggcacttcttccggtctgttgcctagcaatagggtgctctggatcggggacgtagcttgtcagccaatgacgcccattcctgaggaaacctttctggagctgaagtcgttctctcagtccgagtttccagatatctgcaaaatagacggaattgttttcaaccagtgtgaaggcgagtcactcccgcaaccctttgatgtggcctggatggacgtcggccacagtcataagatcattatgcgggaacacaaaacaaagtgggtgcaggagagctcctctaaggatttcgtgtgctataaagaggggactggaccttgtagcgaatcagaggaaaaggcatgcaaaaccagtggttcctgccgcggcgacatgcagttttgtaaggtcgccgggtgcgagcacggagaagaggctagcgaggcaaaatgtagatgctctttagttcataagccaggcgaagtggtagtgtcatacggtgggatgagggtccggcccaaatgttacggcttcagtcgcatgatggccacactggaggtgaatcctccagaacagcgaatcggacaatgcaccggctgtcaccttgagtgcatcaacgggggagttagattgattactctgacaagcgaactaaagtccgctaccgtgtgtgcctctcatttttgctcgagcgcgacgtccggtaagaaatcaactgagatacagttccacagtggctctctcgtcgggaagaccgcaatccacgtgaaaggagccctggtagacggcacagagttcacttttgaaggtagctgtatgttccccgatgggtgcgacgctgttgattgcaccttttgtagggagttccttaagaatccgcagtgctatcctgccaaaaagtggctgtttattatcatagtgattttgctcggctacgcaggactgatgttactgacaaacgtcctcaaggctatcggcgtgtgggggtcctgggtcatcgcccccgtgaaacttatgttcgcgattatgaagaaactgatgcggaccgtttcatgtttgatgggaaagctaatcgaccgtggtcgccaagtgattcatgaagagataggcgaaaatggggagggaaacagagatgacgtaaggatcgagatggcccggccacgacgcgtcagacactggatgtatagccctgtgattctgacgatcctcgcaatcggcctggctgaaggttgcgatgagatggttcatgccgactctaaacttgtgtcctgtaggcaggggagtggcaatatgaaggaatgcgtcactacaggacgggctctgttgcccgccgtgaacccaggccaggaggcatgtctccactttaccgcccccgggagccctgattctaagtgcctgaaaattaaggtaaaacgcataaatttaaagtgtaaaaagtcctcaagttacttcgtgccagacgctagatcgaggtgcactagcgttcgtcggtgtcgatgggcgggagattgccagtccggctgcccgccccattttacatctaacagcttctcagacgactgggcaggtaagatggatagagccgggctgggatttagtggctgttccgacggttgcggcggggctgcctgtggatgcttcaatgcagccccttcttgtatcttttggaggaaatgggtcgagaacccacacggcattatctggaaggtgagcccctgcgctgcctgggtgccttccgcagtcattgaactaaccatgccatcaggggaggttcgcacgttccaccccatgagcggaatcccgacccaagtgttcaaaggcgtgagtgtaacatatctcggttctgatatggaagtctccgggctgactgacctttgtgagatagaagagttgaaaagcaagaagctggcgctcgctccttgcaaccaggccggaatgggcgtggttggtaaagtgggcgagatccagtgttcgtcagaagagtctgcacggaccattaagaaggatgggtgcatctggaatgccgacctggtcggaattgaacttagagtggatgacgctgtttgttacagtaaaatcacatccgtggaggccgtagcaaactatagcgctataccaactaccattggcgggctgaggtttgaacgctctcatgatagccagggaaagatctccggctcacccttggacattacagccatccgaggtagtttcagcgtcaattaccgggggctccgtctgtctttatccgagataaccgcgacttgcacgggagaggtgacaaacgtgtcaggctgctacagttgtatgaccggtgccaaagtcagcatcaagctgcactcctctaaaaattcgactgctcatgttagatgcaagggcgatgaaaccgcatttagcgtgctagagggggtacactcatatacagtgtccctcagtttcgaccacgccgtcgtggatgaacaatgtcagctgaactgcggaggccatgagtctcaggttacccttaaggggaatttgatttttctggacgtgcctaaattcgtcgacggaagctacatgcagacttatcactccacagtgcccacgggcgctaacatcccatcacctaccgattggctcaatgccctgtttggtaacgggttatctaggtggattctgggacttatcggcgttttgctcggcgggctggcactattctttctgataatgagcctcttcaagctgggaactaaacaagtgtttcgcagtcggacaaaacttgcgtga

SEQ ID NO: 11457 - RNA, 3222 nt, synthetic construct
  misc_feature 1..3222: note = derived and/or modified CDS sequence (opt3) from SFTSV(JS2011-109)__KC505139.1__GP
  source 1..3222: mol_type = other RNA
atgatgaaggtgatctggttcagctccctgatttgcctcgtcatacagtgtggcggggacaccggacccatcatttgcgccggtcctatccactctaacaaatcagctgatattccacatcttctgggctacagtgagaagatctgtcaaatagacagattgatccacgttagctcctggttaaggaatcattctcagtttcaggggtatgtgggacagcggggcggtcgctcgcaagtatcatactatccggcagaaaacagctacagtcgatggtccgggctgctatctccctgcgatgccgactggctcggaatgctggtggtcaaaaaggcgaaaggcagcgatatgattgtgcctggcccatcctataaggggaaggttttctttgagcgtcccacattcgacggatacgtgggttggggctgtgggtcaggaaaaagtagaactgaaagcggcgagctttgttcttccgattcaggtacgagcagtgggctgttgccttctgacagggtcctctggatcggagatgtggcttgccagccaatgacccccattcctgaagagacatttctggagctgaagtccttcagccagtcggaatttccagacatctgcaaaatagatggcattgtattcaatcagtgtgagggcgaatctctcccgcaaccctttgacgttgcctggatggatgtggggcactcccataagatcattatgcgggagcacaaaactaagtgggtccaggagtcaagtagcaaggacttcgtgtgctataaagaaggaaccggtccttgttccgagtctgaagagaagacatgcaaaaccagcggctcatgccgcggggacatgcagttttgtaaggtggcaggatgcgaacacggcgaggaggccagtgaagctaaatgtagatgctccttagtccataagccaggtgaggttgtggtaagctacgggggcatgagggtgcggcccaaatgttacggattctctcgcatgatggcaactctggaagtcaaccagcctgagcaacgaatcggccagtgcacagggtgtcaccttgaatgcatcaatggaggtgtgagattgattaccctgacgtcagagctaaagagtgccactgtttgtgctagccatttttgctcctctgccacctcgggcaagaaaagcacagagatacagttccactccgggtcactcgtgggaaagactgcgatccacgtcaaaggcgcactggtggatggtaccgagttcacatttgaagggagttgtatgttcccagacggctgcgatgccgtagactgcaccttttgtagggagttccttaagaacccccaatgctatccggctaaaaagtggctgtttattatcatagttattttgctcggatacgccggcctgatgttactgacgaatgtgctcaaggcaatcggggtctggggatcttgggtgatcgctcctgtcaaacttgtgttcgccattatcaagaaactgatgcgggcggttagctgtttgatgggtaagctaatggatcgtggccgccaggtgattcatgaagaaataggggagaacagagagggaaatcaggacgatgtaaggatcgaaatggcccggccccgacgcgtcagacactggatgtattccccagtgattctgactatcctcgcaatcggcctggctgagggttgcgacgaaatggttcatgccgattcaaaacttgtgagctgtaggcaggggtctggcaacatgaaggagtgcgtcacaaccggacgggctctgttgcctgccgtgaatcccggccaagaggcatgtctccactttactgccccagggtcccccgacagtaagtgcctgaaaattaaggtaaaacgcataaacttaaagtgtaaaaagtcgtcttcctacttcgtgcctgatgctagatcaaggtgcacaagtgttcgtcggtgtcgatgggcgggagactgccagagcggctgcccaccgcattttaccagcaattccttctctgacgattgggcaggtaagatggacagagccgggctgggatttagcggctgttcagatggttgcggcggggctgcctgtggatgcttcaacgcagcccccagttgtatcttttggaggaaatgggtcgaaaatcctcacggcattatctggaaggtgtccccatgcgctgcctgggtgccctctgcagtcattgagctaacgatgcctagcggggaagttcgcaccttccacccaatgtccggaatccccacacaggtgttcaaaggcgtgtcagtaacttatctcggtagcgacatggaggtcagtgggctgaccgatctttgtgaaatagaggagttgaagtctaaaaagctggcgctcgctccgtgcaaccaggccggaatgggcgtggttggtaaagtgggcgaaatccaatgttccagcgaggaatcggcacggacaattaagaaggacgggtgcatctggaacgccgatctggtcggaattgagcttagagtggacgatgctgtttgttactcaaaaatcacttctgtggaagccgtagcaaattatagtgctatacctaccacaattggcgggctgaggtttgagcgctcccatgacagccagggaaagatctctggcagcccattggatattaccgccatccgaggttccttctcagtcaactaccgggggctccgtctgagtttaagcgagataactgcgacgtgcacaggagaagtgaccaatgtgtctggctgctactcctgtatgactggtgccaaagtctcaatcaagctgcacagtagcaaaaactccaccgctcatgttagatgcaagggcgacgagacagcattttctgtgctagaaggggtacactcgtatagcgtgtcactctccttcgatcacgccgtcgtggacgagcagtgtcagctgaattgcggaggccatgaaagtcacgttacccttagggggaacttgatttttctggacgtgcccaagttcgtcgatggatcttacatgcaaacttatcatagcacagtgcctacgggcgctaatatcccctccccaaccgactggctcaacgccctgtttggtaatgggttatcacgctggattctgggagttatcggcgtgcttttgggcgggctcgcactgttctttctaataatgtctctgttcaaactcggaactaagcaggtctttcggagcagaacaaaactggcgtga

SEQ ID NO: 11458 - RNA, 3222 nt, synthetic construct
  misc_feature 1..3222: note = derived and/or modified CDS sequence (opt3) from SFTSV(JS2011-13-2)__KR230770.1__GP
  source 1..3222: mol_type = other RNA
atgatgaaggtgatctggttcagctccctgatttgcctcgtcatacagtgtggcggggacaccggacccatcatttgcgccggtcctatccactctaacaaatcagctgatattccacatcttctgggctacagtgagaagatctgtcaaatagacagattgatccacgttagctcctggttaaggaatcattctcagtttcaggggtatgtgggacagcggggcggtcgctcgcaagtatcatactatccggcagaaaacagctacagtcgatggtccgggctgctatctccctgcgatgccgactggctcggaatgctggtggtcaaaaaggcgaaaggcagcgatatgattgtgcctggcccatcctataaggggaaggttttctttgagcgtcccacattcgacggatacgtgggttggggctgtgggtcaggaaaaagtagaactgaaagcggcgagctttgttcttccgattcaggtacgagcagtgggctgttgccttctgacagggtcctctggatcggagatgtggcttgccagccaatgacccccattcctgaagagacatttctggagctgaagtccttcagccagtcggaatttccagacatctgcaaaatagatggcattgtattcaatcagtgtgagggcgaatctctcccgcaaccctttgacgttgcctggatggatgtggggcactcccataagatcattatgcgggagcacaaaactaagtgggtccaggagtcaagtagcaaggacttcgtgtgctataaagaaggaaccggtccttgttccgagtctgaagagaagacatgcaaaaccagcggctcatgccgcggggacatgcagttttgtaaggtggcaggatgcgaacacggcgaggaggccagtgaagctaaatgtagatgctccttagtccataagccaggtgaggttgtggtaagctacgggggcatgagggtgcggcccaaatgttacggattctctcgcatgatggcaactctggaagtcaaccagcctgagcaacgaatcggccagtgcacagggtgtcaccttgaatgcatcaatggaggtgtgagattgattaccctgacgtcagagctaaagagtgccactgtttgtgctagccatttttgctcctctgccacctcgggcaagaaaagcacagagatacagttccactccgggtcactcgtgggaaagactgcgatccacgtcaaaggcgcactggtggatggtaccgagttcacatttgaagggagttgtatgttcccagacggctgcgatgccgtagactgcaccttttgtagggagttccttaagaacccccaatgctatccggctaaaaagtggctgtttattatcatagttattttgctcggatacgccggcctgatgttactgacgaatgtgctcaaggcaatcggggtctggggatcttgggtgatcgctcctgtcaaacttgtgttcgccattatcaagaaactgatgcgggcggttagctgtttgatgggtaagctaatggatcgtggccgccaggtgattcatgaagaaataggggagaacagagagggaaatcaggacgatgtaaggatcgaaatggcccggccccgacgcgtcagacactggatgtattccccagtgattctgactatcctcgcaatcggcctggctgagggttgcgacgaaatggttcatgccgattcaaaacttgtgagctgtaggcaggggtctggcaacatgaaggagtgcgtcacaaccggacgggctctgttgcctgccgtgaatcccggccaagaggcatgtctccactttactgccccagggtcccccgacagtaagtgcctgaaaattaaggtaaaacgcataaacttaaagtgtaaaaagtcgtcttcctacttcgtgcctgatgctagatcaaggtgcacaagtgttcgtcggtgtcgatgggcgggagactgccagagcggctgcccaccgcattttaccagcaattccttctctgacgattgggcaggtaagatggacagagccgggctgggatttagcggctgttcagatggttgcggcggggctgcctgtggatgcttcaacgcagcccccagttgtatcttttggaggaaatgggtcgaaaatcctcacggcattatctggaaggtgtccccatgcgctgcctgggtgccctctgcagtcattgagctaacgatgcctagcggggaagttcgcaccttccacccaatgtccggaatccccacacaggtgttcaaaggcgtgtcagtaacttatctcggtagcgacatggaggtcagtgggctgaccgatctttgtgaaatagaggagttgaagtctaaaaagctggcgctcgctccgtgcaaccaggccggaatgggcgtggttggtaaagtgggcgaaatccaatgttccagcgaggaatcggcacggacaattaagaaggacgggtgcatctggaacgccgatctggtcggaattgagcttagagtggacgatgctgtttgttactcaaaaatcacttctgtggaagccgtagcaaattatagtgctatacctaccacaattggcgggctgaggtttgagcgctcccatgacagccagggaaagatctctggcagcccattggatattaccgccatccgaggttccttctcagtcaactaccgggggctccgtctgagtttaagcgagataactgcgacgtgcacaggagaagtgaccaatgtgtctggctgctactcctgtatgactggtgccaaagtctcaatcaagctgcacagtagcaaaaactccaccgctcatgttagatgcaagggcgacgagacagcattttctgtgctagaaggggtacactcgtatagcgtgtcactctccttcgatcacgccgtcgtggacgagcagtgtcagctgaattgcggaggccatgaaagtcacgttacccttaaggggaacttgatttttctggacgtgcccaaattcgtcgatggatcttacatgcaaacttatcatagcacagtgcctacgggcgctaatatcccctccccaaccgactggctcaacgccctgtttggtaatgggttatcaaggtggattctgggagttatcggcgtgcttttgggcgggctcgcactgttctttctaataatgtctctgttcaagctcggaactaaacaggtctttcgcagccggacaaagctggcgtga

SEQ ID NO: 11459 - RNA, 3222 nt, synthetic construct
  misc_feature 1..3222: note = derived and/or modified CDS sequence (opt3) from SFTSV(JS2011-69)__KR230771.1__GP
  source 1..3222: mol_type = other RNA
atgatgaaggtgatctggttcagctccctggtctgcctcgttattcagtgttctggcgacaccgggcccataatctgcgccggacctattcactcaaacaaaagtgctaatatcccacatcttctgggttacagcgagaagatttgtcaaatcgatagattgatacacgtgtcctcttggttaaggaaccattcgcagtttcagggctatgtagggcagcggggaggccgctcacaagtgagctactatccggcagaaaatagttactcccgatggtctggtctgctaagcccctgcgacgccgattggctcgggatgctggtcgtgaaaaaggcgaaaggatccgacatgatcgttcctggcccatcatataagggcaaggtgttctttgagcgtcccacattcgatgggtacgtcggatggggttgtggcagtgggaaaagcagaactgaatctggagagctttgctcctcagacagcggcacgagttctggtctgttgccttccgatagggtgctctggattggggacgtagcttgtcagccaatgacccccatccctgaagagacatttctggagctcaagagcttctcgcagtctgaatttccagatatttgcaaaatcgacggaatagttttcaaccagtgtgattccgagtcactgccgcaaccctttgacgtggcctggatggatgtcggccacagtcataagattatcatgcgggaacacaaaactaagtgggtgcaggagagctcctctaaggacttcgtgtgctataaagagggcaccgggccttgtagcgaatcagaggaaaagacatgcaaaaccagtggatcctgccgcggtgacatgcagttttgtaaggtcgcaggctgcgagcacggggaagaggccagcgaggctaaatgtagatgctctttagttcataagccaggagaagtggtagtgtcatacggcggtatgagggtccggcccaaatgttacgggttcagtcgcatgatggcaactctggaggtgaatcctccagaacagcgaattggccaatgcacaggatgtcaccttgagtgcatcaacggcggggttagattgatcaccctgacgagcgaactaaagtccgccactgtgtgtgcttctcatttttgctcgagcgccacctccggaaagaaatcaacagagattcagttccacagtggttctctcgtcggcaaggcggcaatacacgtgaaaggggccctggtagatggaactgagttcacctttgaaggcagctgtatgttccccgacggttgcgatgctgttgactgcacattttgtagggagttccttaagaatccgcagtgctatcctgccaaaaagtggctgtttatcattatcgtgatattgctcgggtacgcaggcctgatgttactgaccaacgtcctcaaggctattggagtgtggggctcctgggtcatggcccccgtgaaacttatgttcgcgatcatcaagaaactgatgcggtcagttagctgtttgatggggaagctaatggatcgtggacgccaagtgattcatgaagagatcggtgaaaatagagagggcaaccaggacgatgtaaggattgagatggcccggccacgacgcgtcagacactggatgtattctcctgtgatactgacgatcctcgcaattgggctggctgaaggatgcgacgagatggttcatgccgattccaaacttgtgagttgtaggcagggcagcggtaatatgaaggaatgcgtcactacagggcgggctctgttgcccgccgtgaacccaggccaggaggcatgtctccactttaccgcccccggatctcctgactccaagtgcctgaaaatcaaggtaaaacgcatcaatttaaagtgtaaaaagtcaagtagctacttcgtgccagatgctagatcgaggtgcacttccgttcgtcggtgtcgatgggcgggcgactgccaatctgggtgcccgagccattttacatcaaacagtttctccgacgattgggcaggaaagatggacagagccggcctgggtttttctgggtgtagcgatggatgcggcggtgctgcctgtggctgcttcaatgcagccccctcctgtatattttggaggaaatgggtcgagaaccctcacgggattatctggaaggtgtcaccatgcgctgcctgggtgcccagcgcagtcattgaactaaccatgcctagtggagaggttcgcacgttccacccaatgtctggcatccccacccaggtgttcaaaggggtgtccgtaacatatctcggaagcgacatggaagtctcgggcctgactgatctttgtgagattgaagagttgaagtctaaaaagctggcgctcgctccgtgcaaccaggccggtatgggggtggttggaaaagtgggcgagatccagtgttcaagtgaagagtccgcacggaccataaagaaggacggttgcatctggaatgccgatctggtcggcattgaacttagagtggacgatgctgtttgttacagcaaaatcacatctgtggaggccgtagcaaactatagcgctattcctactaccatcgggggactgaggtttgaacgctcccatgactcacaaggcaagataagtgggagcccattggatattacagccgtccgaggatctttctccgtgaattaccggggcctccgtctgtcattaagtgagatcaccgcgacttgcacgggtgaggtgacaaacgtcagcgggtgctactcctgtatgaccggagccaaagtttctattaagctgcactcgagcaaaaattcaactgctcatgtgagatgcaagggcgacgaaaccgcattttccgtactagagggtgtgcacagttatacagtctctctcagcttcgatcacgccgtggttgacgaacagtgtcagctgaactgcggcgggcatgagtcccaggtgacccttaagggaaatttgatctttctggacgtccccaaattcgtggatggctcatacatgcaaacttatcactctagcgttcctacaggggctaacatacccagtccaacggactggctcaatgccctgtttggaaacggcttatccaggtggatcctgggtgtgattggggtccttttgggagtactcgcactgttctttctaatcatgagcctgttcaagctcggcaccaaacaggtgtttcgctctcggactaagctggcgtga

SEQ ID NO: 11460 - RNA, 3222 nt, synthetic construct
  misc_feature 1..3222: note = derived and/or modified CDS sequence (opt3) from SFTSV(JS2012-020)__KC505142.1__GP
  source 1..3222: mol_type = other RNA
atgatgaaggtgatctggttcagctccctgatttgcctcgtcatacagtgtggcggggacaccggacccatcatttgcgccggtcctatccactctaacaaatcagctgatattccacatcttctgggctacagtgagaagatctgtcaaatagacagattgatccacgttagctcctggttaaggaatcattctcagtttcaggggtatgtgggacagcggggcggtcgctcgcaagtatcatactatccggcagaaaacagctacagtcgatggtccgggctgctatctccctgcgatgccgactggctcggaatgctggtggtcaaaaaggcgaaaggcagcgatatgattgtgcctggcccatcctataaggggaaggttttctttgagcgtcccacattcgacggatacgtgggttggggctgtgggtcaggaaaaagtagaactgaaagcggcgagctttgttcttccgattcaggtacgagcagtgggctgttgccttctgacagggtcctctggatcggagatgtggcttgccagccaatgacccccattcctgaagagacatttctggagctgaagtccttcagccagtcggaatttccagacatctgcaaaatagatggcattgtattcaatcagtgtggcggggagtctctcccgcaaccctttgacgttgcctggatggatgtgggacactcccataagatcattatgcgggaacacaaaactaagtgggtccaggagtcaagtagcaaggacttcgtgtgctataaagagggtaccggcccttgttccgaatctgaggaaaagacatgcaaaaccagcgggtcatgccgcggagacatgcagttttgtaaggtggcaggctgcgagcacggtgaagaggccagtgaggctaaatgtagatgctccttagtccataagccaggggaagttgtggtaagctacggcggaatgagggtgggccccaaatgttacgggttctctcggatgatggcaactctggaggtcaaccagcctgaacaacgcatcggacagtgcacaggttgtcaccttgagtgcatcaatggcggggtgcgattgattaccctgacgtcagaactaaagagtgccactgtttgtgctagccatttttgctcctctgccacctcgggaaagaaaagcacagagatacagttccactccggctcactcgtgggtaagactgcgatccacgtcaaaggggcactggtggatggcaccgagttcacatttgaaggaagttgtatgttcccagacggctgcgatgccgtagactgcaccttttgtagagagttccttaagaacccccaatgctatccggctaaaaagtggctgtttattatcataattatcttgctcgggtacgccggactgatgttactgacgaatgttctcaaggcaatcggtgtgtggggctcttgggtcattgctcctgtgaaacttgtcttcgccatcattaagaaactgatgagggcggtgagctgtttgatggggaagctaatggatcggggacgtcaggttatacatgaagagatcggcgaaaaccgcgagggtaatcaggacgatgtgagaattgagatggccaggccccggcgagtacgccactggatgtattccccagtcatcctgactatcctcgcaattgggctggctgaaggctgcgacgagatggtgcatgccgattcaaaacttgttagctgtagacagggatctggcaacatgaaggaatgcgtgacaaccgggagggctctgttgcctgccgtcaatcccggacaagaggcatgtctccactttactgccccaggctcccccgacagtaagtgcctgaaaataaaggtgaaacggatcaacttaaagtgtaaaaagtcgtcttcctacttcgtacctgatgctcgctcaagatgcacaagtgtgaggcgttgtcggtgggcgggtgactgccagagcgggtgcccaccgcattttaccagcaattccttctctgacgattgggcaggaaagatggaccgagccggcctgggttttagcggctgttcagatgggtgcggaggcgctgcctgtgggtgcttcaacgcagcccccagttgtatcttttggagaaaatgggttgagaatcctcacggaattatttggaaggtctccccatgcgctgcctgggtgccctctgcagtgatcgaactaacgatgcctagcggcgaggtcaggaccttccacccaatgtccggtatacccacacaggttttcaaaggggtgtcagtgagctatctcggaagtgacatggaagtatctggcctgactgatctttgtgagatcgaagagttgaagtccaaaaagctggcgctcgctccgtgcaaccaggccggtatgggcgtcgtggggaaagttggagagattcaatgtagctcggaagagtcagcacgcaccatcaagaaggacggctgcatttggaacgccgatctggtggggatcgaacttcgggtcgacgatgctgtgtgttactctaaaataacaagtgttgaggccgtggcaaattattccgctattcctactaccatcggaggcctgagatttgaaaggagccatgactctcagggtaagattagcgggtccccattggatatcacagccatacgcggatcattcagtgtaaactaccgaggcctccggctgagcttatctgagatcaccgcgacttgcacgggtgaggtcacaaatgtgtccggctgctactcatgtatgaccggggccaaagtgagtattaagctgcacagctccaaaaactctactgctcatgtccgttgcaagggagacgaaaccgcattttcggttctagagggcgtgcacagctattcagtatccctcagtttcgatcacgccgtggtcgacgaacagtgtcagctgaattgcgggggacatgagtctcacgtgacacttaagggcaacttgatctttctggacgttcccaaattcgtggatggtagctacatgcaaacctatcattccactgtccctacaggggctaatattccctcaccaacggactggctcaacgccctgtttggaaatggcttatctagatggatcctgggcgtgataggggttcttttgggaggtctcgcactgttctttctaattatgagcctgttcaagctcggcaccaaacaggtgtttaggagtcgcactaagctggcgtga

SEQ ID NO: 11461 - RNA, 3222 nt, synthetic construct
  misc_feature 1..3222: note = derived and/or modified CDS sequence (opt3) from SFTSV(JS2012-035)__KC505145.1__GP
  source 1..3222: mol_type = other RNA
atgatgaaggtgatctggttcagctccctgatttgcctcgtcatacagtgtggcggggacaccggacccatcatttgcgccggtcctatccactctaacaaatcagctgatattccacatcttctgggctacagtgagaagatctgtcaaatagacagattgatccacgttagctcctggttaaggaatcattctcagtttcaggggtatgtgggacagcggggcggtcgctcgcaagtatcatactatccggcagaaaacagctacagtcgatggtccgggctgctatctccctgcgatgccgactggctcggaatgctggtggtcaaaaaggcgaaaggcagcgatatgattgtgcctggcccatcctataaggggaaggttttctttgagcgtcccacattcgacggatacgtgggttggggctgtgggtcaggaaaaagtagaactgaaagcggcgagctttgttcttccgattcaggtacgagcagtgggctgttgccttctgacagggtcctctggatcggagatgtggcttgccagccaatgacccccattcctgaagagacatttctggagctgaagtccttcagccagtcggaatttccagacatctgcaaaatagatggcattgtattcaatcagtgtgagggcgaatctctcccgcaaccctttgacgttgcctggatggatgtggggcactcccataagatcattatgcgggagcacaaaactaagtgggtccaggagtcaagtagcaaggacttcgtgtgctataaagaaggaaccggtccttgttccgagtctgaagagaagacatgcaaaaccagcggctcatgccgcggggacatgcagttttgtaaggtggcaggatgcgaacacggcgaggaggccagtgaagctaaatgtagatgctccttagtccataagccaggtgaggttgtggtaagctacgggggcatgagggtgcggcccaaatgttacggattctctcgcatgatggcaactctgggcgtcaaccagcctgaacaacgaatcgggcagtgcacaggatgtcaccttgagtgcatcaatggtggcgtgagattgattaccctgacgtcagaactaaagagtgccactgtttgtgctagccatttttgctcctctgccacctcggggaagaaaagcacagagatacagttccactccggatcactcgtgggcaagactgcgatccacgtcaaaggtgcactggtggatgggaccgagttcacatttgaaggcagttgtatgttcccagacggatgcgatgccgtagactgcaccttttgtagggagttccttaagaacccccaatgctatccggctaaaaagtggctgtttattatcatagttattttgctcggctacgccgggctgatgttactgacgaatgtgctcaaggcaatcggagtctggggttcttgggtgatcgctcctgtcaaacttgtgttcgccattatcaagaaactgatgcgggcggttagctgtttgatgggcaagctaatggatcgtgggcgccaggtgattcatgaagagataggagaaaacagagagggcaatcaggacgatgtaaggatcgagatggcccggccccgacgcgtcagacactggatgtattccccagtgattctgactatcctcgcaatcggtctggctgaagggtgcgacgagatggttcatgccgattcaaaacttgtgagctgtaggcagggctctggaaacatgaaggaatgcgtcacaaccggccgggctctgttgcctgccgtgaatcccgggcaagaggcatgtctccactttactgccccaggatcccccgacagtaagtgcctgaaaattaaggtaaaacgcataaacttaaagtgtaaaaagtcgtcttcctacttcgtgcctgatgctagatcaaggtgcacaagtgttcgtcggtgtcgatgggcgggcgactgccagagcggttgcccaccgcattttaccagcaattccttctctgacgattgggcagggaagatggacagagccggactgggctttagcggttgttcagatggctgcgggggagctgcctgtggctgcttcaacgcagcccccagttgtatcttttggaggaaatgggtcgagaatcctcacgggattatctggaaggtgtccccatgcgctgcctgggtgccctctgcagtcattgaactaacgatgcctagcggagaggttcgcaccttccacccaatgtccggcatccccacacaggtgttcaaaggtgtgtcagtaacttatctcgggagcgacatggaagtcagtggactgaccgatctttgtgagatagaagagttgaagtctaaaaagctggcgctcgctccgtgcaaccaggccggcatgggtgtggttggcaaagtgggggagatccaatgttccagcgaagagtcggcacggacaattaagaaggacggatgcatctggaacgccgatctggtcggcattgaacttagagtggacgatgctgtttgttactcaaaaatcacttctgtggaggccgtagcaaattatagtgctatacctaccacaattgggggactgaggtttgaacgctcccatgacagccagggcaagatctctggtagcccattggatattaccgccatccgagggtccttctcagtcaactaccggggactccgtctgagtttaagcgagataactgcgacgtgcacaggcgaggtgaccaatgtgtctggttgctactcctgtatgactggcgccaaagtctcaatcaagctgcacagtagcaaaaactccaccgctcatgttagatgcaagggggacgaaacagcattttctgtgctagagggagtacactcgtatagcgtgtcactctccttcgatcacgccgtcgtggacgaacagtgtcagctgaattgcggcgggcatgagagtcacgttacccttaggggaaacttgatttttctggacgtgcccaagttcgtcgatggctcttacatgcaaacttatcatagcacagtgcctacgggtgctaatatcccctccccaaccgactggctcaacgccctgtttgggaatggattatcacgctggattctgggcgttatcggcgtgcttctcgggggattggcactgttctttctaataatgtctctgttcaaactcggtactaagcaggtctttcggagcagaacaaaactggcgtga

SEQ ID NO: 11462 - RNA, 3222 nt, synthetic construct
  misc_feature 1..3222: note = derived and/or modified CDS sequence (opt3) from SFTSV(JS2012-79)__KR230772.1__GP
  source 1..3222: mol_type = other RNA
atgatgaaggtgatctggttcagctccctgacctgctttgtcattcagtgttctggcgactcagggcccataatctgcgccggacctattcacagtaacaaaagcgctgatatcccacatctccttggttactccgagaagatttgtcaaatcgacagactgatacacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgatcgtgcctggcccaagttataagggcaaggttttcttcgagcgtcccacatttgacgggtacgtgggatggggttgtggcagcgggaaatctagaactgaatccggagagctgtgctcaagcgatagtggcacgtcttccggtcttctgcctagcgacagggtcttgtggattggggatgtggcttgtcagccaatgacccccatccctgaagagacattcctcgagctgaagtcgttttctcagtccgaatttccagacatttgcaaaatcgatggaatagtatttaatcagtgtgagggcgaatcactgccgcaacccttcgacgttgcctggatggatgtgggccacagtcataagattatcatgcgggagcacaaaactaagtgggtccaggagagctcctctaaggactttgtgtgctataaagaagggaccggaccttgtagcgagtcagaagagaagacatgcaaaaccagtggttcctgccgcggcgacatgcagttctgtaaggtggcagggtgcgaacacggagaggaggccagcgaagctaaatgtagatgctctctcgtccataagccaggcgaggttgtggtatcatacggtgggatgaggattcggcccaaatgttacggctttagtcgcatgatggcaactttagaagtgaaccagcctgagcaacgactgggacagtgcacaggctgtcaccttgaatgcatcaatgggggagtcagattgatcaccctgacgagcgagctaaagtccgccactgtgtgtgcttctcatttctgctcgagcgccacctccggtaagaaatcaacagagattcagttccacagtggctctctcgttgggaagactgcgatacacgtgaaaggagcactggtcgatggcaccgaatttacattcgagggtagctgtatgtttccagacgggtgcgatgccgtggactgcaccttctgtagggaatttcttaagaacccccaatgctatccggctaaaaagtggctgttcatcattatcgtaatattgctcggctacgccggactgatgttactgacgaatgttctcaaggcaattggcatctgggggtcctgggtgatcgctcctgtcaaacttatgtttgccattatcaagaaactgatgcggactgtgtcatgtttgatgcgtaagctaatggatcgcggaagacaggtcattcatgaggaaataggtgagaacagggagggcaatcaggacgatgtgcggatcgaaatggcgcgaccccgcagagttaggcactggatgtatagcccagtgattctgacaatcctcgccatcgggctggcagagtcttgcgacgaaatggtacatgctgattccaaacttgtcagttgtcggcagggaagcggcaacatgaaggagtgcgtgaccactggtcgcgccctgttgtctgctgttaatcctgggcaagaggcctgtctccacttcacagcacccggctccccagactcaaagtgcctgaaaattaaggtgaaaagaataaacttaaagtgtaaaaagagtagctcgtactttgtccccgatgccaggtcccgttgcacctctgtgcggcgatgtagatgggctggagactgccagagcggctgccctccacatttcacgtcaaatagtttttccgacgattgggcggggaagatggacagggcaggactgggcttctctggttgtagcgatgggtgcggaggcgccgcttgtggttgctttaacgccgcaccgtcctgtatcttctggcgcaaatgggtagaaaatccccacggcattatctggaaggtgtcaccttgcgccgcttgggttccaagcgccgtcattgagctaaccatgcccagtggggaagtgcggacattccaccctatgtctggaatcccaactcaggtgtttaaaggcgtctccgttacctatctcgggagcgacatggaggtgtcgggactgacagatctttgtgaaatagaggagttgaagtctaaaaagctggcactcgcgccctgcaaccaggctggcatgggtgtggtagggaaagtcggagaaatccaatgttcaagtgaggaatccgccagaactattaagaaggacggctgcatctggaacgcagatctggtgggtattgagcttagggttgacgatgccgtgtgttacagcaaaatcacctctgtcgaagctgtggccaattatagcgcaataccgacaaccattggcgggctgcgcttcgagcgatcccatgactcacagggaaagatcagtggcagccctttggatattactgctatccgggggtctttttccgttaactaccgtggactcagactgtcattaagtgagataacggccacatgcaccggcgaagtgactaatgtaagcggttgctactcctgtatgaccggggcgaaagtctctatcaagctgcactcgagcaaaaactcaacagcccatgtgaggtgcaagggagacgagaccgctttctccgtgctagaaggcggtcacagttatactgtctctctcagctttgatcacgcagttgtggacgagcagtgtcagctgaattgcggcgggcatgaatcccaagtaacacttaagggaaacttgattttcctggacgtgccaaaatttgtcgatggctcatacatgcagacgtatcactctaccgtgcccactggggccaatatccctagccccacagactggctcaacgctctgttcggaaatggcttaagtcgctggattctgggtgttatcggggtgcttttgggaggcctcgccctgtttttcatgataatgtccctatttaagctgggcaccaaacaggtcttccggagcagaacaaagctcgcatga

SEQ ID NO: 11463 - RNA, 3222 nt, synthetic construct
  misc_feature 1..3222: note = derived and/or modified CDS sequence (opt3) from SFTSV(JS2013-44)__KR230773.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggagaccagcgaagccaaatgtagatgctctctcgtccataagccaggcgaggttgtggtatcatacggtgggatgaggatccggcccaaatgttacggctttagtcgcatgatggctactttagaagtgaaccagcctgagcaacgactgggacagtgcacaggctgtcaccttgaatgcatcaatgggggagtcagattgattaccctgacgagcgagctaaagtccgcaactgtgtgtgcctctcatttctgctcgagcgctacctccggtaagaaatcaacagagatacagttccacagtggctctctcgttgggaagactgccatccacgtgaaaggagcgctggtcgatggcaccgaatttacattcgagggtagctgtatgtttccagacgggtgcgatgcagtggactgcaccttctgtagggaatttcttaagaacccccaatgctatccggccaaaaagtggctgttcattatcatagtaattttgctcggctacgctggactgatgttactgacgaatgttctcaaggccatcggcatctgggggtcctgggtgattgcacctgtcaaacttatgtttgctatcattaagaaactgatgcggactgtgtcatgtttgatgcgtaagctaatggatcgcggaagacaggtcatacatgaggaaatcggtgagaacagggagggcaatcaggacgatgtgcggattgaaatggcccgaccccgcagagttaggcactggatgtatagcccagtgatcctgacaatcctcgcgattgggctggccgagtcttgcgacgaaatggtacatgcagattccaaacttgtcagttgtcggcagggaagcggcaacatgaaggagtgcgtgaccactggtcgcgctctgttgcctgccgttaatcccgggcaagaggcttgtctccacttcacagccccaggctctcccgactccaagtgcctgaaaataaaggtgaaaagaatcaacttaaagtgtaaaaagtcaagtagctactttgtccctgatgcaaggtcgcgttgcacctccgtgcggcgatgtagatgggccggagactgccagtctggctgcccaccgcatttcacgagcaattcatttagtgacgattgggctgggaagatggacagggcgggactgggcttctccggttgttctgatgggtgcggaggcgcagcctgtggttgctttaacgctgcccccagctgtattttctggcgcaaatgggtagaaaatcctcacggcatcatttggaaggtgtccccatgcgcagcctgggttccctcagctgtcatcgagctaaccatgcctagcggggaagtgcggacattccacccaatgagtggaatacccactcaggtgtttaaaggcgtctctgttacctatctcgggtccgacatggaggtgagcggactgacagatctttgtgaaatcgaggagttgaagtcgaaaaagctggccctcgcaccgtgcaaccaggcgggcatgggtgtggtagggaaagtcggagaaattcaatgttcatctgaggaaagtgctagaactatcaagaaggacggctgcatttggaacgccgatctggtgggtatcgagcttagggttgacgatgcagtgtgttactccaaaataaccagcgtcgaagccgtggctaattattctgccattcctacaaccatcggcgggctgcgcttcgagcgaagccatgactcccagggaaagatttcaggcagtccattggatatcagcgcaatacgggggtctttttccgttaactaccgtggactcagactgtcattaagtgagatcactgctacgtgcacaggcgaagtgaccaatgtaagcggttgctactcctgtatgactggggccaaagtctctattaagctgcactcgagcaaaaactcaaccgcgcatgtgaggtgcaagggagacgagacagccttctccgtgctagaaggcgtccacagttatatcgtttctctcagctttgatcacgctgtggtagacgagcagtgtcagctgaattgcggtggccatgaatcccaagtgacccttaaggggaacttgattttcctggacgtccccaaatttgtggatggatcatacatgcagacttatcactctacagttcctacgggcgcaaatatccccagcccaaccgactggctcaacgccctgttcgggaatggattaagtcgctggatactgggcgtgattggtgtccttctcgggggattggctctgttttccatgatcatgagcctattcaagctgggcactaaacaggtgtttcggtctagaacaaagctcgcctga

SEQ ID NO: 11464 - RNA, 3222 nt, synthetic construct
  misc_feature 1..3222: note = derived and/or modified CDS sequence (opt3) from SFTSV(JS2013-46)__KR230774.1__GP
  source 1..3222: mol_type = other RNA
atgatgaaggtgatctggttcagctccctgatttgcctcgtcatacagtgtggcggggacaccggacccatcatttgcgccggtcctatccactctaacaaatcagctgatattccacatcttctgggctacagtgagaagatctgtcaaatagacagattgatccacgttagctcctggttaaggaatcattctcagtttcaggggtatgtgggacagcggggcggtcgctcgcaagtatcatactatccggcagaaaacagctacagtcgatggtccgggctgctatctccctgcgatgccgactggctcggaatgctggtggtcaaaaaggcgaaaggcagcgatatgattgtgcctggcccatcctataaggggaaggttttctttgagcgtcccacattcgacggatacgtgggttggggctgtgggtcaggaaaaagtagaactgaaagcggcgagctttgttcttccgattcaggtacgagcagtgggctgttgccttctgacagggtcctctggatcggagatgtggcttgccagccaatgacccccattcctgaagagacatttctggagctgaagtccttcagccagtcggaatttccagacatctgcaaaatagatggcattgtattcaatcagtgtgagggcgaatctctcccgcaaccctttgacgttgcctggatggatgtggggcactcccataagatcattatgcgggagcacaaaactaagtgggtccaggagtcaagtagcaaggacttcgtgtgctataaagaaggaaccggtccttgttccgagtctgaagagaagacatgcaaaaccagcggctcatgccgcggggacatgcagttttgtaaggtggcaggatgcgaacacggcgaggaggccagtgaagctaaatgtagatgctccttagtccataagccaggtgaggttgtggtaagctacgggggcatgagggtgcggcccaaatgttacggattctctcgcatgatggcaactctggaagtcaacgagcctgaacagcgaatcggccaatgcacagggtgtcaccttgagtgcatctcaggaggtgtgagattgattaccctgacgagtgagctaaagagcgccactgtttgtgcttcccatttttgttcttcggccaccagcggcaagaaatccacagaaatacagttccactcagggagtctcgtgggaaagactgcgatccacgtcaaaggcgcactggtggatggtaccgagttcacatttgaagggtcttgcatgttcccagacggctgcgatgccgtagactgcaccttttgtagggagttccttaagaatccccagtgctatccggctaaaaagtggctgtttattatcatagttattttgctcggatacgccggcctgatgttactgacgaacgtgctcaaggcaatcggggtctggggaagctgggtgatcgctcctgtcaaacttgtgttcgccattatcaagaaactgatgcgggcggtttcctgtttgatgggtaagctaatggatcgtggccgccaagtgattcatgaagagataggggagaatagagaaggaaaccaggacgatgtaaggatcgagatggcccggccccgacgcgtcagacactggatgtattcaccagtgattctgactatcctcgcaatgggcctggctgaaggttgcgacgagatggttcatgccgatagcaaacttgtgtcttgtaggcaggggtccggcaatatgaaggagtgcgtcacaaccggacgggctctgttgcctgccgtgaaccccggccaggaagcatgtctccactttatggccccagggagtcccgacagcaagtgcctgaaaatcaaggtaaaacgcattaatttaaagtgtaaaaagtcttcctcatacttcgtgcctgatgctagaagtaggtgcactagcgttcgtcggtgtcgatgggcgggagactgccaatcgggctgcccaccgcattttacatccaactctttcagcgacgattgggcaggtaagatggacagagccgggctgggattttcaggctgtagtgatggttgcggcggggctgcctgtggatgcttcaatgcagccccctcctgtatattttggaggaaatgggtcgagaaccctcacggcatcatttggaaggtgtctccatgcgctgcctgggtgcccagcgcagtcatcgaactaaccatgccttccggggaggttcgcacgttccacccaatgtcaggcattcccacccaggtgttcaaaggagtgagcgtaacatatctcggtagtgacatggaagtctctgggctgactgatctttgtgagatcgaggaattgaagtccaaaaagctggcgctcgctccgtgcaatcaggccggaatgggcgtggttggtaaagtgggcgagatacagtgtagctcggaagagtcagcacggaccatcaagaaggacgggtgcatttggaacgccgatctggtcggaatcgaacttagagtggacgatgctgtttgttactctaaaattacaagtgtggaggccgtagcaaactattccgctatccctactaccataggcgggctgaggtttgagcgcagccatgactctcaaggaaagattagcggctccccattggatatcacagccattcgaggttcattcagtatcaattaccgggggctccgtctgagcttatctgaaatatccgcgacctgcactggagaggtcacgaacgtgtcaggctgctacagttgtatgacaggtgccaaagtgagcatcaagctgcactcctctaaaaattcgaccgctcatgtcagatgcaagggcgacgaaactgcatttagcgttctagagggggtgcactcatattccgtaagtctctctttcgatcacgccgtggtcgacgaacagtgtcagctgaactgcggaggccatgagagccaggtgacccttagggggaatttgatttttctggacgttcccaagttcgtggatggatcctacatgcaaacatatcactcaaccgtccctactggcgctaacatcccctctccaacagactggctcaatgccctgtttggtaacgggttaagccgctggattctgggagtgatcggcgttcttttgggcgggctcgcactgttctttctaataatgagtctgttcaaactcggaacgaaacaggtgtttcggtccagaaccaagctggcgtga

SEQ ID NO: 11465 - RNA, 3222 nt, synthetic construct
  misc_feature 1..3222: note = derived and/or modified CDS sequence (opt3) from SFTSV(JS2013-52)__KR230775.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaaccagcctgagcaacgaatcggacagtgcactggctgtcacctggaatgcatcaatgggggagtgagacttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggatggcactgaatttaccttcgagggtagctgtatgtttccagacgggtgcgatgccgtagactgcacattctgtagggaatttctgaagaacccccaatgctatccggctaaaaagtggcttttcattatcatagttattctgttgggctacgccggactcatgctgttaaccaatgtgctgaaggcaatcggcatctgggggtcctgggtcattgctcctgtgaaactcatgtttgccatcattaagaaacttatgcggacggtctcatgtctgatgggaaagttgatggatcgtggtcgccaggtgatacatgaggaaatcggcgagaacagagaggggaatcaggacgatgttaggattgaaatggcgcggccccgacgcgtgagacactggatgtatagcccagtaatcctaactttcctggccatcggactcgcagagtcttgcgacgaaatggtccatgctgattccaaactggtgagttgtaggcagggcagcggtaacatgaaggagtgcgttacaaccgggcgggcccttctgcctgctgtgaatcccggccaagaggcctgtttgcactttactgcaccaggatctcccgactccaagtgcctcaaaattaaggtcaaacgcataaacctgaagtgtaaaaagtcaagtagctacttcgtgcctgatgccagatcgaggtgcacatccgtacgtcggtgtcgatgggctggcgactgccagtctgggtgcccaccgcattttaccagcaattcattcagtgacgattgggcgggaaagatggacagagcaggcttaggtttttccgggtgttctgatggatgcggcggtgccgcttgtggctgcttcaacgccgcacccagctgtatcttctggaggaaatgggtggaaaatcctcacgggattatctggaaggtttccccatgcgccgcttgggtcccctcagccgtgattgagctgacgatgcctagcggagaagtgcgcacctttcacccaatgagtggcatccccacacaggtcttcaaaggggtttctgtgacttatctaggatccgacatggaggtgagcggcctcaccgatctgtgtgaaatagaggagcttaagtcgaaaaagttggcactggcgccgtgcaaccaggctggtatgggggtagtcggaaaagtgggcgaaatccaatgttcatctgaggaaagtgcccggacaattaagaaggacggttgcatctggaacgcagatctcgttggcattgagctgagagtggacgatgccgtctgttactccaaaatcactagcgtggaagctgttgccaattattctgcaatacctaccacaattgggggacttaggtttgagcgcagccatgactcccagggcaagatctcagggagtccactggatattaccgctatccgaggcagcttctctgtgaactaccggggattgcgtctctccctgtcagagataactgccacgtgcacaggtgaagtaaccaatgtcagtgggtgctacagctgtatgactggagcgaaagtgtccatcaagttacactcttcgaaaaacagcaccgcccatgtgagatgcaagggcgacgagacagctttttcagtcctggaaggtgttcactcctataccgtgagtctatctttcgatcacgcagtagtggacgagcagtgtcagctcaattgcggcgggcatgaaagccaagtcactctgaagggaaaccttatctttttggacgtgcccaaattcgttgatggctcctacatgcagacatatcactcaacggtgcctaccggggccaatattccctctccaactgactggctgaacgctctctttggaaatggcctgagtaggtggattttaggtgtcatcggggtgctgcttggagttttggccctcttctttctgataatgagcctattcaagctgggcacaaaacaggtgtttcgctcccggaccaagctcgcatga

SEQ ID NO: 11466 - RNA, 3222 nt, synthetic construct
  misc_feature 1..3222: note = derived and/or modified CDS sequence (opt3) from SFTSV(JS2013-69)__KR230776.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatattatcgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggattggggatgtggcttgtcagccaatgacgcccatccctgaagagaccttcctcgagctgaagtcgttttctcagtccgaatttccagacatatgcaaaattgatggaatcgtatttaatcagtgtgagggcgaatcactgccgcaacccttcgacgttgcctggatggatgtgggccacagtcataagattatcatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaaccagcctgagcaacgactgggacagtgcactggctgtcaccttgaatgcatcaatgggggagtgagattgattacactgaccagcgagctaaagtccgccacggtttgtgcttctcatttctgctcgagcgccacttccggtaagaaatcaaccgagatacagttccacagtggctctctcgtggggaagacagcgatccacgtcaaaggagcactggtggatggcactgaatttacccttgagagctcctgtatgttcccagacggttgcgatgccgtagactgcacattttgtagggaatttctgaagaacccccaatgctatccggctaaaaagtggttgtttattatcatagttattctcctggggtacgccggcttaatgctgctcaccaatgtgcttaaggcaatcggaatctggggctcatgggtcattgctcctgtgaaactgatgttcgccatcattaagaaattgatgcggacggtcagctgtctaatgcgtaagctgatggatcgcgggagacaggtgatacatgaggaaatcggagagaacagggagggtaatcaggacgatgttcggattgaaatggcgcgaccccgcagagtgaggcactggatgtattctccagtaatcctcactatcctggccattggccttgcagagtcctgcgacgaaatggtccatgctgatagtaaactggtgagctgtcggcaggggtctggaaacatgaaggagtgcgttacaaccggccgcgccttgctccctgctgtgaatcccggtcaagaggcctgtctgcactttactgcaccagggtcccccgactcaaagtgcttaaaaataaaggtcaaaagaatcaacctgaagtgtaaaaagagtagctcgtacttcgtgcctgatgccaggtcccgttgcacatctgtacggcgatgtagatgggctggcgactgccagagcggatgcccaccgcattttacctcaaatagtttctccgacgattgggcgggcaagatggacagggcagggctaggattttctggctgtagcgatggttgcgggggagccgcttgtggctgcttcaacgccgcaccctcctgtattttctggcgcaaatgggtggaaaatcctcacggtatcatttggaaggtttcaccatgcgccgcttgggtccccagcgccgtgatcgagctcacgatgcctagtggcgaagtgcggaccttccacccaatgtctgggatacccacacaggtcttcaaaggagtttccgtgacttatctgggcagcgacatggaggtgtcggggcttaccgatttgtgtgaaatcgaggagctgaagtcaaagaagctcgcactggcgccgtgcaaccaggctggaatgggcgtagtcggtaaagtgggggaaattcaatgttctagtgaggaatccgccagaacaatcaagaaggacggatgcatttggaacgcagatcttgttggcatcgagctgagggtggacgatgccgtctgttacagcaaaataacttctgtggaagctgttgccaattatagcgcaattcctaccacaatcggtggcttgcgctttgagcgatcccatgactcacaggggaagattagtggaagcccactcgatatcaccgctatacggggctctttctccgtgaactaccgtgggctgagattatcactgagtgagatcactgccacgtgcacaggagaagtaaccaatgtcagcggctgctactcctgtatgactggtgcgaaagtgtctattaagctacactcgagcaaaaactcaaccgcccatgtgaggtgcaagggggacgagacagctttttccgtcctcgaaggagttcacagttataccgtgtctctgagcttcgatcacgcagtagtggacgagcagtgtcagcttaattgcggcggtcatgaatcccaagtcactttgaagggcaacctgatctttctcgacgtgcccaaattcgttgatgggtcatacatgcagacatatcactctagcgtgcctacgggagccaatattcccagtccaaccgactggctgaacgctttatttggcaatgggctgtcccgctggatccttggagtcataggcgtgttgctcggtgttctggccctattctttctgattatgagcctcttcaagctggggactaaacaggtgtttcggtctagaacaaaacttgcatga

SEQ ID NO: 11467 - RNA, 3222 nt, synthetic construct
  misc_feature 1..3222: note = derived and/or modified CDS sequence (opt3) from SFTSV(JS2013-71)__KR230777.1__GP
  source 1..3222: mol_type = other RNA
atgatgaaggtgatctggttcagctccctgatttgctttgtcatacagtgtggcggggacaccggacccatcatttgcgccggtcctatccactctaacaaatcagctgatattccacatctccttggctacagtgagaagatctgtcaaatagacagactgatccacgttagctcctggttgaggaatcattctcagttccaggggtatgtgggacagcggggcggtcgctcgcaagtatcatactatccggcagaaaacagctacagtcgatggtccgggttactgtctccctgcgatgccgactggctaggaatgctcgtggtcaaaaaggcgaaaggcagcgatatgattgtgcctggcccatcctataaggggaaggttttcttcgagcgtcccacatttgacggatacgtgggttggggctgtgggtcaggaaaaagtagaactgaaagcggcgagctgtgcagctccgattcaggtacgagcagtgggcttctgccttctgacagggtcttgtggatcggagatgtggcttgtcagccaatgacccccattcctgaagagacattcctcgagctgaagtcctttagccagtcggaatttccagacatctgcaaaatagatggcattgtatttaatcagtgtgagggcgaatctctgccgcaacccttcgacgttgcctggatggatgtggggcactcccataagatcattatgcgggagcacaaaactaagtgggtccaggagtcaagtagcaaggactttgtgtgctataaagaaggaaccggtccttgttccgagtctgaagagaagacatgcaaaaccagcggctcatgccgcggggacatgcagttctgtaaggtggcaggatgcgaacacggcgaggaggccagtgaagctaaatgtagatgctccctcgtccataagccaggtgaggttgtggtaagctacgggggcatgagggtgcggcccaaatgttacggattttctcgcatgatggcaactttagaagtcaaccagcctgagcaacgaatcggccagtgcacagggtgtcacctggaatgcatcaatggaggtgtgagacttattaccttgacgtcagagctgaagagtgccactgtttgtgctagccatttctgctcctctgccacctcgggcaagaaaagcacagagatacagttccactccgggtcgctagtgggaaagactgcgatccacgtcaaaggcgcactcgtggatggtaccgaatttacattcgaggggagttgtatgtttccagacggctgcgatgccgtagactgcaccttctgtagggaatttctgaagaacccccaatgctatccggctaaaaagtggcttttcattatcatagttattctgttgggatacgccggcctcatgctgttaacgaatgtgctgaaggcaatcggggtctggggatcttgggtgatcgctcctgtcaaactcgtgtttgccattatcaagaaacttatgcgggcggttagctgtctgatgggtaagttgatggatcgtggccgccaggtgattcatgaggaaataggggagaacagagagggaaatcaggacgatgtaaggatcgaaatggcccggccccgacgcgtcagacactggatgtattccccagtgattctaactatcctggcaatcggcctcgctgagggttgcgacgaaatggttcatgccgattcaaaactggtgagctgtaggcaggggtctggcaacatgaaggagtgcgtcacaaccggacgggcccttctgcctgctgtgaatcccggccaagaggcatgtttgcacttcactgccccagggtcccccgacagtaagtgcctcaaaattaaggtaaaacgcataaacctgaagtgtaaaaagtcttcttcctactttgtgcctgatgctagatcaaggtgcacaagtgttcgtcggtgtcgatgggcgggagactgccagagcggctgcccaccgcatttcacctcaaattccttttctgacgattgggcaggtaagatggacagagccgggttaggattcagcggctgttcagatggttgcggcggggctgcctgtggatgctttaacgcagcccccagttgtatcttctggaggaaatgggtcgaaaatcctcacggcattatctggaaggtgtccccatgcgctgcctgggtgccctctgcagtcattgagctgacgatgcctagcggggaagttcgcaccttccacccaatgtccggaatccccacacaggtgtttaaaggcgtgtcagtaacttatctaggtagcgacatggaggtcagtgggctcaccgatctgtgtgaaatagaggagcttaagtctaaaaagttggcgctggctccgtgcaaccaggccggaatgggcgtggttggtaaagtgggcgaaatccaatgttccagcgaggaatcggcacggacaattaagaaggacgggtgcatctggaacgccgatctcgtcggaattgagctgagagtggacgatgctgtttgttactcaaaaatcacttctgtggaagccgtagcaaattatagtgctatacctaccacaattggcgggcttaggttcgagcgctcccatgacagccagggaaagatctctggcagcccactggatattaccgccatccgaggttccttttcagtcaactaccgggggttgcgtctcagtctgagcgagataactgcgacgtgcacaggagaagtgaccaatgtgtctggctgctactcctgtatgactggtgccaaagtctcaatcaagttacacagtagcaaaaactccaccgctcatgttagatgcaagggcgacgagacagcattctctgtgctggaaggggtacactcgtatagcgtgtcactatcctttgatcacgccgtcgtggacgagcagtgtcagctcaattgcggaggccatgaaagtcacgttaccctgagggggaaccttattttcttggacgtgcccaagtttgtcgatggatcttacatgcaaacttatcatagcacagtgcctacgggcgctaatatcccctccccaaccgactggctgaacgccctcttcggtaatgggctgtcacgctggattttaggagttatcggcgtgctgcttggcgggttggcactctttttcctgataatgtctctatttaaactgggaactaagcaggtcttccggagcagaacaaaactcgcgtga

SEQ ID NO: 11468 - RNA, 3222 nt, synthetic construct
  misc_feature 1..3222: note = derived and/or modified CDS sequence (opt3) from SFTSV(JS2014-03)__KR230778.1__GP
  source 1..3222: mol_type = other RNA
atgatgaaggtgatctggttcagctccctgatttactttgtcatacagtgctctggcgactcagggcccatcatttgtgccggacctatccacagtaacaaaagcgctgatattccacatctccttggttattccgagaagatctgccaaatagacagactgatccacgtttcttcgtggttgaggaatcattcacagttccagggctacgtggggcagcggggaggccgcagccaagtaagttattacccggcagaaaactcctattctcgatggagcggtttactgtccccctgtgatgccgactggctagggatgctcgtggtcaaaaaggcgaaaggatcagatatgattgtgcctggcccaagttacaagggcaaggttttcttcgagcgtcccacctttgacgggtatgtgggatggggttgcggcagcgggaaatctagaacagaatccggagagctgtgttcaagcgatagtggcacttcttccggtcttctgcctagcgacagggtcttgtggatcggggatgtggcttgccagccaatgacgcccattcctgaagagaccttcctcgagctgaagtcgttttctcagtccgaatttccagacatctgtaaaatagatggaattgtatttaatcagtgcgagggcgaatcactgccgcaacccttcgacgttgcctggatggatgtgggccacagtcataagatcattatgcgggagcacaaaacaaagtgggtccaggagagctcctctaaggactttgtgtgttacaaagaagggactggaccttgcagcgagtcagaagagaagacctgtaaaacaagtggttcctgccgcggcgacatgcagttctgcaaggtggcagggtgtgaacacggagaggaggccagcgaagctaaatgcagatgttctctcgtccataagccaggcgaggttgtggtatcatacggtgggatgaggatccggcccaaatgctatggctttagtcgcatgatggcaaccttagaagtgaaccagcctgagcaacgaatcggacagtgtactggctgccacctggaatgtattaatgggggagtcagacttataacattgaccagcgagctgaagtccgccacggtgtgcgcttctcatttctgttcgagcgccacttccggtaagaaatcaaccgagatccagttccacagtggctctctagttgggaagacagcgattcacgtgaaaggagcactcgtcgatggcactgaatttaccttcgagggtagctgcatgtttccagacgggtgtgatgccgtggactgcacattctgcagggaatttctgaagaacccccaatgttacccggctaaaaagtggcttttcatcataattgtaatcctgttgggctatgccggactcatgctgttaaccaatgttctgaaggcaatcggcatttgggggtcctgggtgatcgctcctgtcaaactcatgtttgccattataaagaaacttatgcggacggtgtcatgcctgatgggaaagttgatggatcgtggtcgccaggtcatccatgaggaaattggcgagaacagagaggggaatcaggacgatgtgaggatcgaaatggcgcggccccgacgcgttagacactggatgtacagcccagtgatcctaactttcctggccattggactcgcagagtcttgtgacgaaatggtacatgctgattccaaactggtcagttgcaggcagggcagcggtaacatgaaggagtgtgtgacaaccgggcgggcccttctgcctgctgttaatcccggccaagaggcctgcttgcactttactgcaccaggatctcccgactccaagtgtctcaaaataaaggtgaaacgcatcaacctgaagtgcaaaaagtcaagtagctatttcgtccctgatgccagatcgaggtgtacatccgtgcgtcggtgccgatgggctggcgactgtcagtctgggtgcccaccgcattttaccagcaattcattcagtgacgattgggcgggaaagatggacagagcaggcttaggtttttccgggtgctctgatggatgtggcggtgccgcttgcggctgtttcaacgccgcacccagctgcattttctggaggaaatgggtagaaaatcctcacgggatcatttggaaggtgtccccatgtgccgcttgggttccctcagccgtcatcgagctgacgatgcctagcggagaagtgcgcacctttcacccaatgagtggcatacccacacaggtgttcaaaggggtctctgttacttacctaggatccgacatggaggtgagcggcctcaccgatctgtgcgaaatcgaggagcttaagtcgaaaaagttggcactggcgccgtgtaaccaggctggtatgggggtggtaggacgggtcggcgaaattcaatgctcatctgaggaaagtgccagaacaatcaaaaaggacggttgtatttggaacgcagatctcgtgggcatcgagctgagggttgacgatgccgtgtgctattccaagataactagcgtcgaagctgtggccaattactctgcaattcctaccacaatcgggggacttcgctttgagcgaagccatgactcccagggcaaaatttcagggagtccactggatatcaccgctatacggggcagcttctctgttaactaccgtggattgagactctccctgtcagagatcactgccacgtgtacaggtgaagtgaccaatgtaagtgggtgctatagctgcatgactggagcgaaggtctccattaaattacactcttcgaagaacagcaccgcccatgtgaggtgtaaaggcgacgagacagctttttcagtgctggaaggtgtccactcctacaccgttagtctatctttcgatcacgcagtggtagacgagcagtgccagctcaattgtggcgggcatgaaagccaagtgactctgaagggaaaccttatctttttggacgtccccaagttcgtggatggctcctatatgcagacataccactcaacggttcctaccggggccaatattccctctccaactgactggctgaacgctctctttggaaatggcctgagccgctggatcttaggtgtgataggggtcctgcttggaggcttggccctcttctttatgattatgagtctgttcaaactaggcacaaaacaggtgtttcggtccagaaccaagctggcatga

SEQ ID NO: 11469 - RNA, 3222 nt, synthetic construct
  misc_feature 1..3222: note = derived and/or modified CDS sequence (opt3) from SFTSV(JS2014-16)__KR230780.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctactatccggcagaaaatagttactcccgatggtctggtctgctaagcccctgcgacgccgattggctcgggatgctggtggtcaaaaaggcgaaaggatccgacatgattgtgcctggcccatcatataagggcaaggttttctttgagcgtcccacattcgatgggtacgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacatttctggagctcaagagcttctcgcagtctgaatttccagatatctgcaaagtagacggaatagttttcaaccagtgtgattccgagtcactgccgcaacccattgacgtggcctggatggatgtcggccacagtcataagatcattatgcgggaacacaaaactaagtgggtgcaggagagctcctctaaggactttgtgtgctataaagagggcaccgggccttgtagcgaatcagaggaaaagacatgcaaaaccagtggatcctgccgcggtgacatgcagttctgtaaggtcgcaggctgcgagcacggggaagaggccagcgaggctaaatgtagatgctctttagttcataagccaggagaagtggtagtgtcatacggcggtatgagggtccggcccaaatgttacgggtttagtcgcatgatggcaactctggaggtgaatcctccagaacagcgaatcggccaatgcacaggatgtcaccttgagtgcatcaacggcggggttagattgattaccctgacgagcgaactaaagtccgccactgtgtgtgcttctcatttctgctcgagcgccacctccggaaagaaatcaacagagatacagtttcacagtggttctctcgtcggcaaggcggcaatccacgtgaaaggggccctggtagatggaactgagttcaccttcgaaggcagctgtatgtttcccgacggttgcgatgctgttgactgcacattctgtagggagtttcttaagaatccgcagtgctatcctgccaaaaagtggctgttcattatcatagtgattttgctcgggtacgcaggcctgatgttactgaccaacgtcctcaaggctatcggagtgtggggctcctgggtcatggcccccgtgaaacttatgtttgcgatcattaagaaactgatgcggtcagttagctgtatgatggggaagttgatggatcgtggacgccaagtgatccatgaagagattggtgaaaatagagagggcaaccaggacgatgtaaggatagagatggcccggccacgacgcgtcagacactggatgtattctcctgtgatcctaacgattctggcaatcgggctcgctgaaggatgcgacgagatggttcatgccgattccaaactggtgctttgtaggcagggcagtggtaatatgaaggaatgcgtcactacagggcgggctctgttgcccgccgtgaacccaggccaggaggcatgtctccacttcaccgcccccggaagccctgactctaagtgcctgaaaatcaaggtaaaacgcattaatttaaagtgtaaaaagtcctcaagttactttgtgccagatgctagatcgaggtgcactagcgttcgtcggtgtcgatgggcgggcgactgccaatccgggtgcccgtctcatttcacaagcaactcatttagtgacgattgggcaggaaagatggacagagccggcctgggtttctccgggtgttctgatggatgcggcggtgctgcctgtggctgctttaatgcagcccccagctgtatattctggaggaaatgggtcgagaaccctcacgggatcatttggaaggtgtccccatgcgctgcctgggtgccctcagcagtcatcgaactaaccatgcctagcggagaggttcgcacgtttcacccaatgagtggcattcccacccaggtgttcaaaggggtgtctgtaacatatctcggatccgacatggaagtcagcggcctgactgatctttgtgagatcgaagagttgaagtcgaaaaagctggcgctcgctccgtgcaaccaggccggtatgggggtggttggaaaagtgggcgagatacagtgttcatctgaagagagtgcacggaccatcaagaaggacggttgcatttggaatgccgatctggtcggcatcgaacttagagtggacgatgctgtttgttactccaaaattacaagcgtggaggccgtagcaaactattctgctatccctactaccatagggggactgaggttcgaacgcagccatgactcccaaggcaagatttcagggagtccattggatatcacagccattcgaggcagcttttctgtcaattaccggggactccgtctgtccttatcagagatcaccgcgacttgcacgggtgaggtgacaaacgtgagtgggtgctacagctgtatgaccggagccaaagtctccataaagctgcactcttcgaaaaatagcactgctcatgttagatgcaggggcgacgaaaccgcattctcagtgctagagggtgtacactcctatacagtgagtctctcttttgatcacgccgtcgtggacgaacagtgtcagctgaactgcggcgggcatgagagccaggttacccttaagggaaatttgatcttcctggacgtgcccaagtttgtcgatggctcctacatgcaaacttatcactcatctgtgcctacaggggctaacattcccagcccaacggactggctcaatgccctgttcggaaacggcttaagtcgctggatcctgggtgttattggggtgcttttgggagtcctcgcactgtttttcctaatcatgtccctgtttaaactcggcaccaagcaggtattccggagcagaactaaactggcgtga

SEQ ID NO: 11470 - RNA, 3222 nt, synthetic construct
  misc_feature 1..3222: note = derived and/or modified CDS sequence (opt3) from SFTSV(JS2014-18)__KR230781.1__GP
  source 1..3222: mol_type = other RNA
atgatgaaggtgatctggttcagctccctgatttgcctcgtcatacagtgtggcggggacaccggacccatcatttgcgccggtcctatccactctaacaaatcagctgatattccacatcttctgggctacagtgagaagatctgtcaaatagacagattgatccacgttagctcctggttaaggaatcattctcagtttcaggggtatgtgggacagcggggcggtcgctcgcaagtatcatactatccggcagaaaacagctacagtcgatggtccgggctgctatctccctgcgatgccgactggctcggaatgctggtggtcaaaaaggcgaaaggcagcgatatgattgtgcctggcccatcctataaggggaaggttttctttgagcgtcccacattcgacggatacgtgggttggggctgtgggtcaggaaaaagtagaactgaaagcggcgagctttgttcttccgattcaggtacgagcagtgggctgttgccttctgacagggtcctctggatcggagatgtggcttgccagccaaccacacccattcctgaagagacttttctggagctgaagtccttcagccagtcggaatttccagacgtatgcaaaatcgatggcatagttttcaatcagtgtgagggcgaatctctcccgcaaccctttgacgtggcctggatggatgtcgggcactcccataagattatcatgcgggagcacaaaaccaagtgggtgcaggagtcaagtagcaaggacttcgtgtgctataaagaaggaacaggtccttgttccgagtctgaagagaagacctgcaaaactagcggctcatgccgcggggacatgcagttttgtaaggtcgcaggatgcgaacacggcgaggaggccagtgaagctaaatgtagatgctccttagttcataagccaggtgaggtggtagtgagctacgggggcatgagggtccggcccaaatgttacggattctctcgcatgatggcaacactggaagtgaaccctccagagcagcgaattggccaatgcaccgggtgtcaccttgaatgcatcaatggaggtgttagattgatcacgctgacttcagagctaaagagtgccaccgtgtgtgctagccatttttgctcctctgccacatcgggcaagaaaagcactgagattcagttccactccgggtcactcgtcggaaagaccgcgatacacgtgaaaggcgcactggtagatggtacagagttcacctttgaagggagttgtatgttccccgacggctgcgatgccgttgactgcacgttttgtagggagttccttaagaacccgcagtgctatcctgctaaaaagtggctgtttatcattatcgtgatattgctcggatacgccggcctgatgttactgactaatgtcctcaaggcaattggggtgtggggatcttgggtcatcgctcccgtgaaacttgttttcgccatcattaagaaactgatgcgggcggtgagctgtttgatgggtaagctaatggatcgtggccgccaagtaatccatgaagaaattggggagaacagagagggaaatcaggacgatgtcaggatagaaatggcccggccacgacgcgtgagacactggatgtattcccctgttatcctgacaattctcgcaatcggcctggctgagggttgcgacgaaatggtgcatgccgattcaaaacttgtcagctgtaggcaggggtctggcaacatgaaggagtgcgtgaccactggacgggctctgttgcccgccgtaaatccaggccaggaggcatgtctccactttacagcccccgggtcccctgacagtaagtgcctgaaaatcaaggtgaaacgcattaacttaaagtgtaaaaagtcgtcttcctacttcgttccagatgctagatcaaggtgcaccagtgtccgtcggtgtcgatgggcgggagactgccaaagcggctgcccgccccattttacgagcaattccttctctgacgattgggcaggtaagatggacagagccgggctgggatttagcggctgttcagatggttgcggcggggctgcctgtggatgcttcaacgcagcccctagttgtatattttggaggaaatgggtggaaaatccacacggcatcatttggaaggtgtccccctgcgctgcctgggtcccttctgcagttatcgagctaaccatgccaagcggggaagtgcgcacattccaccccatgtccggcattccgactcaggtgttcaaaggagtatcagtcacctatctcggtagcgacatggaggtgagtgggctgacagatctttgtgaaatcgaggagttgaagtctaaaaagctggcgctcgctccttgcaaccaggccggaatgggcgttgtgggtaaagtcggcgaaatacagtgttccagcgaggaatcggcacggactatcaagaaggacgggtgcatttggaacgccgatctggtgggaatcgagcttagagttgacgatgctgtgtgttactcaaaaattacctctgtagaagccgtcgcaaattatagtgctatcccaacaaccataggcgggctgaggtttgagcgctcccatgacagccaaggaaagatttctggcagccccttggatatcactgccattcgaggttccttctcagtgaactaccgggggctccgtctgagtttaagcgagatcacggcgacatgcaccggagaagtgactaatgtctctggctgctactcctgtatgaccggtgccaaagtttcaataaagctgcacagtagcaaaaactccacagctcatgtgagatgcaagggcgacgagaccgcattttctgtactagaaggggtgcactcgtatagcgtctcactctccttcgatcacgccgtggttgacgagcagtgtcagctgaattgcggaggccatgaaagtcaggtgactcttagggggaacttgatctttctggacgtccctaagttcgtggatggatcttacatgcaaacatatcacagcacggttcccaccggcgctaatattccatcccctactgactggctcaacgccctgtttggtaatgggttatcacgctggatcctgggagtgattggcgtccttttgggcgggctcgcactgttctttctaatcatgtctctgttcaaactcggaacaaagcaggtatttcggagcagaaccaaactggcgtga

SEQ ID NO: 11471 - RNA, 3222 nt, synthetic construct
  misc_feature 1..3222: note = derived and/or modified CDS sequence (opt3) from SFTSV(JS2014-31)__KR230782.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgaggatccggcccaaatgttacggctttagtcgcatgatggcaaccttagaagtgaaccagcctgagcaacgactgggacagtgcactggctgtcaccttgaatgcatcaatgggggagtcagattgattacactgaccagcgagctaaagtccgccacggtgtgtgcttctcatttctgctcgagcgccacttccggtaagaaatcaaccgagatacagttccacagtggctctctcgttgggaagacagcgatccacgtgaaaggagcactggtcgatggcactgaatttaccttcgagggtagctgtatgtttccagacgggtgcgatgccgtggactgcacattctgtagggaatttcttaagaacccccaatgctatccggctaaaaagtggctgttcattatcatagtaattttgctcggctacgccggactgatgttactgaccaatgttctcaaggcaatcggcatctgggggtcctgggtgattgctcctgtcaaacttatgtttgccatcattaagaaactgatgcggacggtgtcatgtttgatgcgtaagctaatggatcgcggaagacaggtcatacatgaggaaatcggtgagaacagggagggcaatcaggacgatgtgcggattgaaatggcgcgaccccgcagagttaggcactggatgtatagcccagtgatcctgactatcctcgccattgggctggcagagtcttgcgacgaaatggtacatgctgattccaaacttgtcagttgtcggcagggaagcggcaacatgaaggagtgcgtgacaaccggtcgcgccctgttgcctgctgttaatcccgggcaagaggcctgtctccacttcactgcaccaggctctcccgactccaagtgcctgaaaataaaggtgaaaagaatcaacttaaagtgtaaaaagtcaagtagctactttgtccctgatgccaggtcgcgttgcacatccgtgcggcgatgtagatgggctggagactgccagtctggctgcccaccgcatttcaccagcaattcatttagtgacgattgggcggggaagatggacagggcaggactgggcttctccggttgttctgatgggtgcggaggcgccgcttgtggttgctttaacgccgcacccagctgtattttctggcgcaaatgggtagaaaatcctcacggcatcatttggaaggtgtccccatgcgccgcttgggttccctcagccgtcatcgagctaacgatgcctagcggggaagtgcggaccttccacccaatgagtggaatacccacacaggtgtttaaaggcgtctctgttacttatctcgggtccgacatggaggtgagcggactgaccgatctttgtgaaatcgaggagttgaagtcgaaaaagctggcactcgcgccgtgcaaccaggctggcatgggtgtggtagggaaagtcggagaaattcaatgttcatctgaggaaagtgccagaacaatcaagaaggacggctgcatttggaacgcagatctggtgggtatcgagcttagggttgacgatgccgtgtgttactccaaaataactagcgtcgaagctgtggccaattattctgcaattcctaccacaatcggcgggctgcgcttcgagcgaagccatgactcccagggaaagatttcaggcagtccattggatatcaccgctatacgggggagcttttctgttaactaccgtggactcagactgtccttatcagagatcactgccacgtgcacaggcgaagtgaccaatgtaagtggttgctacagctgtatgactggggcgaaagtctccattaagctgcactcttcgaaaaacagcaccgcccatgtgaggtgcaagggagacgagacagctttctcagtgctagaaggcgtccactcctataccgttagtctctcttttgatcacgcagtggtagacgagcagtgtcagctgaattgcggtggccatgaaagccaagtgactcttaaggggaacttgatcttcctggacgtccccaaatttgtggatggatcctacatgcagacatatcactcaacggttcctaccggcgccaatattccctctccaactgactggctcaacgctctgttcgggaatggattaagccgctggatcctgggcgtgataggtgtccttttgggggtgctcgccctgtttttcctaattatgagtctgtttaagctcggaacaaaacaggttttccggtccagaaccaagctggcatga

SEQ ID NO: 11472 - RNA, 3222 nt, synthetic construct
  misc_feature 1..3222: note = derived and/or modified CDS sequence (opt3) from SFTSV(JS2014-33)__KR230783.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaaccagcctgagcaacgaatcggacagtgcactggctgtcacctggaatgcatcaatgggggagtgagacttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggatggcactgaatttaccttcgagggtaactgtatgtttccagacgggtgcgatgccgtagactgcacattctgtagggaatttctgaagaatccccaatgctatccggctaaaaagtggcttttcattatcatagttattctgttgggctacgccggactcatgctgttaaccaacgtgctgaaggcaatcggcatctgggggagctgggtcattgctcctgtgaaactcatctttgccattataaagaaacttatgcgggcggtcggatgtctgatgggtaagttgatggatcgtggccgccaggtgatccatgaggaaattggggagaatagagagggaaaccaggacgatgttaggatcgaaatggcccggccccgacgcgtgagacactggatgtattccccagtaatcctaacgattctggcaataggcctcgctgagtcatgcgacgaaatggtccatgccgatagcaaactggtgtcttgtaggcagggtgggggcaatatgaaggagtgcgttactacaggacgggcccttctgcctgctgtgaaccccggccaagaggcatgtttgcacttcaccgccccagggtcccccgacagtaagtgcctcaaaatcaaggtcaaacgcattaatctgaagtgtaaaaagagttcttcctactttgtgcctgatgctagatcaaggtgcactagcgtacgtcggtgtcgatgggcgggagactgccagagcggctgcccaccgcatttcacatcgaactccttttctgacgattgggcaggtaagatggacagagccgggttaggattcagcggctgttcagatggttgcggcggggctgcctgtggatgctttaatgcagcccccagttgtatcttctggaggaaatgggtggaaaaccctcacggcattatctggaaggtttccccatgcgctgcctgggtcccctctgcagtgatagagctgaccatgcctagcggggaagtgcgcacgttccacccaatgtccggaatccccacccaggtctttaaaggcgtttcagtgacatatctaggtagcgacatggaggtgagtgggctcactgatctgtgtgaaattgaggagcttaagtctaaaaagttggcgctggctccgtgcaaccaggccggaatgggcgtagtcggtaaagtgggcgaaatccaatgttccagcgaggaatcggcacggaccattaagaaggacgggtgcatctggaatgccgatctcgttggaatagagctgagagtggacgatgctgtctgttactcaaaaattacatctgtggaagccgttgcaaactatagtgctatccctactaccattggcgggcttaggttcgagcgctcccatgacagccagggaaagatctctggcagcccactggatataacagccatccgaggttccttttcagtgaattaccgggggttgcgtctcagtctgagcgagattaccgcgacttgcacgggagaagtaacaaacgtctctggctgctactcctgtatgaccggtgccaaagtgtcaatcaagttacacagtagcaaaaattccactgctcatgtgagatgcaagggcgacgagaccgcattctctgtcctggaaggggttcactcgtatacagtgagcctatcatttgatcacgccgtagtggacgagcagtgtcagctcaactgcggaggccatgaatcccaagtcaccctgaaggggaatcttattttcttggacgtgcccaaatttgttgatggaagttacatgcagacttatcactctgctgtgcctacaggcgccaacatccccagcccaacggactggctgaatgcactcttcggtaacgggctgtccaggtggatattaggagtcattggcgtgctgcttggcgggttggcgctctttttcatgatcatgtcactgtttaagctaggaaccaaacaggccttccgctctcggactaagctggcttga

SEQ ID NO: 11473 - RNA, 3222 nt, synthetic construct
  misc_feature 1..3222: note = derived and/or modified CDS sequence (opt3) from SFTSV(JS2014-39)__KR230784.1__GP
  source 1..3222: mol_type = other RNA
atgatgaaggtgatctggttcagctccctgacctgctttgtcattcagtgttctggcgactcagggcccataatctgcgccggacctattcacagtaacaaaagcgctgatatcccacatctccttggttactccgagaagatttgtcaaatcgacagactgatacacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgatcgtgcctggcccaagttataagggcaaggttttcttcgagcgtcccacatttgacgggtacgtgggatggggttgtggcagcgggaaatctagaactgaatccggagagctgtgctcaagcgatagtggcacgtcttccggtcttctgcctagcgacagggtcttgtggattggggatgtggcttgtcagccaatgacccccatccctgaagagacattcctcgagctgaagtcgttttctcagtccgaatttccagacatttgcaaaatcgatggaatagtatttaatcagtgtgagggcgaatcactgccgcaacccttcgacgttgcctggatggatgtgggccacagtcataagattatcatgcgggagcacaaaactaagtgggtccaggagagctcctctaaggactttgtgtgctataaagaagggaccggaccttgtagcgagtcagaagagaagacatgcaaaaccagtggttcctgccgcggcgacatgcagttctgtaaggtggcagggtgcgaacacggagaggagactagcgaagccaaatgtagatgctctctcgtccataagccaggcgaggttgtggtatcatacggtgggatgaggattcggcccaaatgttacggctttagtcgcatgatggctacattagaagtgaaccagcctgagcaacgactgggacagtgcaccggctgtcaccttgaatgcatcaatgggggagtcagattgatcacgctgactagcgagctaaagtccgcaaccgtgtgtgcctctcatttctgctcgagcgctacatccggtaagaaatcaactgagattcagttccacagtggctctctcgttgggaagaccgccatacacgtgaaaggagcgctggtcgatggcacagaatttaccttcgagggtagctgtatgtttccagacgggtgcgatgcagtggactgcacgttctgtagggaatttcttaagaacccccaatgctatccggccaaaaagtggctgttcatcattatcgtaatattgctcggctacgctggactgatgttactgactaatgttctcaaggccattggcatctgggggtcctgggtgatcgcacctgtcaaacttatgtttgctattatcaagaaactgatgcggacagtgtcatgtttgatgcgtaagctaatggatcgcggaagacaggtcattcatgaggaaataggtgagaacagggagggcaatcaggacgatgtgcggatcgaaatggcccgaccccgcagagttaggcactggatgtatagcccagtgattctgaccatcctcgcgatcgggctggccgagtcttgcgacgaaatggtacatgcagattccaaacttgtcagttgtcggcagggaagcggcaacatgaaggagtgcgtgactacaggtcgcgctctgttgcctgccgttaatcccgggcaagaggcttgtctccacttcaccgccccaggctctcccgactccaagtgcctgaaaattaaggtgaaaagaataaacttaaagtgtaaaaagtcaagtagctactttgtccctgatgcaaggtcgcgttgcacgtccgtgcggcgatgtagatgggccggagactgccagtctggctgcccaccgcatttcaccagcaattcatttagtgacgattgggctgggaagatggacagggcgggactgggcttctccggttgttctgatgggtgcggaggcgcagcctgtggttgctttaacgctgcccccagctgtatcttctggcgcaaatgggtagaaaatcctcacggcattatctggaaggtgtccccatgcgcagcctgggttccctcagctgtcattgagctaacaatgcctagcggggaagtgcggactttccacccaatgagtggaatccccacccaggtgtttaaaggcgtctctgttacatatctcgggtccgacatggaggtgagcggactgactgatctttgtgaaatagaggagttgaagtcgaaaaagctggccctcgcaccgtgcaaccaggcgggcatgggtgtggtagggaaagtcggagaaatccaatgttcatctgaggaaagtgctagaaccattaagaaggacggctgcatctggaacgccgatctggtgggtattgagcttagggttgacgatgcagtgtgttactccaaaatcacaagcgtcgaagccgtggctaattattctgccatacctaccactattggcgggctgcgcttcgagcgaagccatgactcccagggaaagatctcaggcagtccattggatattagcgcaatccgggggtctttttccgttaactaccgtggactcagactgtcattaagtgagataacggctacatgcaccggcgaagtgactaatgtaagcggttgctactcctgtatgaccggggccaaagtctctatcaagctgcactcgagcaaaaactcaacagcgcatgtgaggtgcaagggagacgagaccgccttctccgtgctagaaggcgtccacagttatattgtttctctcagctttgatcacgctgtggtagacgagcagtgtcagctgaattgcggtggccatgaatcccaagtgactcttaaggggaacttgatcttcctggacgtccccaaatttgtggatggatcatacatgcagacatatcactctacggttcctaccggcgcaaatattcccagcccaactgactggctcaacgccctgttcgggaatggattaagtcgctggatcctgggcgtgataggtgtccttctcgggggattggctctgttttccatgattatgagcctattcaagctgggcacaaaacaggtgtttcggtctagaaccaagctcgcctga

SEQ ID NO: 11474 - RNA, 3222 nt, synthetic construct
  misc_feature 1..3222: note = derived and/or modified CDS sequence (opt3) from SFTSV(JS2014-H.longicornis-02)__KR230786.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggtgtttttcgagcgtcccacctttgacgggtacgttggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgtagaagccttcctcgagctgaagtcgttttctcagtccgagttcccagacatctgcaaaatagatggaattgtttttaatcagtgtgaaggcgagtcactgccgcaacccttcgacgtggcatggatggatgtcggccacagtcataagatcattatgcgggaacacaaaaccaagtgggtgcaggagagctcctctaaggactttgtgtgctataaagaggggacaggaccttgtccagaaagcgaggaaaagacttgcaaaacctcaggtagttgccgcggcgacatgcagttctgtaaggtcgccgggtgcgagcacggagaagaggcttccgaggcaaaatgtagatgcagcctcgttcataagcccggcgaagtggtagtgtcttacggtgggatgaggatccggcctaaatgttacggcttttcacgcatgatggccacattagaggtcaaccagccagaacaacgactgggacagtgcaccggctgtcaccttgagtgcatcaatgggggagtgagattgattactctgacaagtgaactaaagagcgctaccgtttgtgcctcccatttctgcagctcggcgacgagcggtaagaaatccactgagatacagttccactcaggcagtctcgtggggaagaccgcaatccacgtcaaaggagccctggtggatggcacagagtttactttcgaaggttcttgtatgtttcccgacgggtgcgatgctgtagactgcaccttctgtagggagtttcttaagaacccgcaatgctatcctgccaaaaagtggctgttcattatcatagttattttgctcggctacgcaggactgatgttactgacaaatgtgctcaaggctatcggcatctgggggagctgggtcattgcccccgtgaaacttatgtttgcgatcattaagaaactgatgcggaccgtctcctgtttgatgcgtaagctaatggatcgcggaagacaggtgatacatgaagagatcggtgaaaacagggagggcaatcaggacgatgttcggattgagatggcccgaccacgcagagtgaggcactggatgtattcacctgtaatcctgacgatcctcgcaattgggctggctgaaagctgcgacgagatggtccatgccgattctaaacttgtgtcctgtcggcagggaagtggcaacatgaaggaatgcgttactacaggtcgcgctctgttgcccgccgtgaatccagggcaagaggcatgtctccacttcaccgcccccggcagccctgactctaagtgcctgaaaataaaggtcaaaagaatcaacttaaagtgtaaaaagtcctcaagttactttgtgccagatgctaggagccgttgcacttcggtacggcgatgtagatgggcgggagactgccagtccggctgcccgccccatttcacatctaatagcttttcagacgattgggcagggaagatggacagggccggactgggcttcagtggttgttccgatgggtgcggaggcgctgcctgtggttgctttaacgcagccccttcttgtattttctggcgcaaatgggtggagaatccacacggcatcatttggaaggttagcccctgcgctgcctgggtcccttccgcagtgatcgaactaaccatgccatcaggggaggtgcggacgttccaccccatgagcggaataccgacccaggtctttaaaggcgttagtgtgacatatctcgggtctgacatggaagtgtccggactgactgatctttgtgagatcgaagagttgaagtctaaaaagctggcgctcgctccttgcaaccaggccggcatgggtgtagtcgggaaagtgggagagattcaatgttcgtcagaagagtctgcaagaaccatcaagaaggacggctgcatttggaacgccgatctggttggtatcgaacttagggtggacgatgctgtctgttacagtaaaataacatccgtggaggccgttgcaaattatagcgctattccaactaccatcggcgggctgcgcttcgaacgatctcatgacagccagggaaagatttccggctcacccttggatatcacagccatacgggggagttttagcgtgaactaccgtggactcagactgtctttatccgagatcaccgcgacttgcacgggcgaggtaacaaatgtctcaggttgctacagttgtatgaccggggccaaagtgagcattaagctgcactcctctaaaaactcgactgctcatgtgaggtgcaagggagacgaaaccgcattcagcgtcctagagggcgttcactcatatacagtgtccctcagttttgatcacgccgtagtggacgaacagtgtcagctgaattgcggtggccatgagtctcaagtcacccttaaggggaacttgatcttcctggacgtgcctaaatttgttgatggaagctacatgcagacttatcactccacagtgcccacgggcgctaatattccatcacctaccgactggctcaacgccctgttcgggaatggattatctcgctggatcctgggcgtcataggtgtgcttctcgggggattggcactgtttttcatgattatgagcctatttaagctgggcactaaacaggttttccggagtagaacaaagctcgcgtga

SEQ ID NO: 11475 - RNA, 3222 nt, synthetic construct
  misc_feature 1..3222: note = derived and/or modified CDS sequence (opt3) from SFTSV(JS2014-H.longicornis-03)__KR230787.1__GP
  source 1..3222: mol_type = other RNA
atgatgaaggtgatctggttcagctccctgacctgctttgtcattcagtgttctggcgactcagggcccataatctgcgccggacctattcacagtaacaaaagcgctgatatcccacatctccttggttactccgagaagatttgtcaaatcgacagactgatacacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgatcgtgcctggcccaagttataagggcaaggttttcttcgagcgtcccacatttgacgggtacgtgggatggggttgtggcagcgggaaatctagaactgaatccggagagctgtgctcaagcgatagtggcacgtcttccggtcttctgcctagcgacagggtcttgtggattggggatgtggcttgtcagccaatgacccccatccctgaagagacattcctcgagctgaagtcgttttctcagtccgaatttccagacatttgcaaaatcgatggaatagtatttaatcagtgtgagggcgaatcactgccgcaacccttcgacgttgcctggatggatgtgggccacagtcataagattatcatgcgggagcacaaaactaagtgggtccaggagagctcctctaaggactttgtgtgctataaagaagggaccggaccttgtagcgagtcagaagagaagacatgcaaaaccagtggttcctgccgcggcgacatgcagttctgtaaggtggcagggtgcgaacacggagaggaggccagcgaagctaaatgtagatgctctctcgtccataagccaggcgaggttgtggtatcatacggtgggatgaggattcggcccaaatgttacggctttagtcgcatgatggcaactttagaagtgaaccagcctgagcaacgaatcggacagtgcacaggctgtcacctggaatgcatcaatgggggagtcagacttattaccttgacgagcgagctgaagtccgccactgtgtgtgcttctcatttctgctcgagcgccacctccggtaagaaatcaacagagatacagttccacagtggctctctagttgggaagactgcgatccacgtgaaaggagcactcgtcgatggcaccgaatttacattcgagggtagctgtatgtttccagacgggtgcgatgccgtggactgcaccttctgtagggaatttctgaagaacccccaatgctatccggctaaaaagtggcttttcattatcatagtaattctgttgggctacgccggactcatgctgttaacgaatgttctgaaggcaatcggcatctgggggtcctgggtgattgctcctgtcaaactcatgtttgccatcattaagaaacttatgcggactgtgtcatgtctgatgggaaagttgatggatcgtggtcgccaggtcatacatgaggaaatcggcgagaacagagaggggaatcaggacgatgtgaggattgaaatggcgcggccccgacgcgttagacactggatgtatagcccagtgatcctaacattcctggccatcggactcgcagagtcttgcgacgaaatggtacatgctgattccaaactggtcagttgtaggcagggcagcggtaacatgaaggagtgcgtgaccactgggcgggcccttctgcctgctgttaatcccggccaagaggcctgtttgcactttacagcaccaggatctcccgactccaagtgcctcaaaattaaggtgaaacgcataaacctgaagtgtaaaaagtcaagtagctacttcgtccctgatgccagatcgaggtgcacctccgtgcgtcggtgtcgatgggctggcgactgccagtctgggtgcccaccgcattttacgagcaattcattcagtgacgattgggcgggaaagatggacagagcaggcttaggtttttccgggtgttctgatggatgcggcggtgccgcttgtggctgcttcaacgccgcacccagctgtatcttctggaggaaatgggtagaaaatcctcacgggattatctggaaggtgtccccatgcgccgcttgggttccctcagccgtcattgagctgaccatgcctagcggagaagtgcgcacatttcacccaatgagtggcatccccactcaggtgttcaaaggggtctctgttacctatctaggatccgacatggaggtgagcggcctcacagatctgtgtgaaatagaggagcttaagtcgaaaaagttggcactggcgccgtgcaaccaggctggtatgggggtggtaggaaaagtcggcgaaatccaatgttcatctgaggaaagtgcccggactattaagaaggacggttgcatctggaacgcagatctcgtgggcattgagctgagagttgacgatgccgtgtgttactccaaaatcaccagcgtcgaagctgtggccaattattctgcaatacctacaaccattgggggacttaggtttgagcgcagccatgactcccagggcaagatctcagggagtccactggatattactgctatccgaggcagcttctctgttaactaccggggattgcgtctctccctgtcagagataacggccacatgcaccggtgaagtgactaatgtaagtgggtgctacagctgtatgaccggagcgaaagtctccatcaagttacactcttcgaaaaacagcacagcccatgtgagatgcaagggcgacgagaccgctttttcagtgctggaaggtgtccactcctatactgttagtctatctttcgatcacgcagtggtagacgagcagtgtcagctcaattgcggcgggcatgaaagccaagtgacactgaagggaaaccttatctttttggacgtccccaaattcgtggatggctcctacatgcagacgtatcactcaaccgttcctactggggccaatattccctctccaacagactggctgaacgctctctttggaaatggcctgagtaggtggattttaggtgtgatcggggtcctgcttggaggcttggccctcttctttatgataatgagcctgttcaagctaggcaccaaacaggtgtttcgctcccggacaaagctggcatga

SEQ ID NO: 11476 - RNA, 3222 nt, synthetic construct
  misc_feature 1..3222: note = derived and/or modified CDS sequence (opt3) from SFTSV(JS2014-Hedgehog-02)__KR230789.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgaggatccggcccaaatgttacggctttagtcgcatgatggcaaccttagaagtgaaccagcctgagcaacgaatcggacagtgcactggctgtcacctggaatgcattaatgggggagtcagacttataacattgaccagcgagctgaagtccgccacggtgtgtgcttctcatttctgctcgagcgccacttccggtaagaaatcaaccgagatccagttccacagtggctctctagttgggaagacagcgattcacgtgaaaggagcactcgtcgatggcactgaatttaccttcgagggtagctgtatgtttccagacgggtgcgatgccgtggactgcacattctgtagggaatttctgaagaacccccaatgctatccggctaaaaagtggcttttcatcataattgtaatcctgttgggctacgccggactcatgctgttaaccaatgttctgaaggcaatcggcatttgggggtcctgggtgatcgctcctgtcaaactcatgtttgccattataaagaaacttatgcggacggtgtcatgtctgatgggaaagttgatggatcgtggtcgccaggtcatccatgaggaaattggcgagaacagagaggggaatcaggacgatgtgaggatcgaaatggcgcggccccgacgcgttagacactggatgtatagcccagtgatcctaactattctggccataggactcgcagagtcttgcgacgaaatggtacatgctgattccaaactggtcagttgtaggcagggcagcggtaacatgaaggagtgcgtgacaaccgggcgggcccttctgcctgctgttaatcccggccaagaggcctgtttgcacttcactgcaccaggatctcccgactccaagtgcctcaaaatcaaggtgaaacgcattaacctgaagtgtaaaaagtcaagtagctactttgtccctgatgccagatcgaggtgcacatccgtgcgtcggtgtcgatgggctggcgactgccagtctgggtgcccaccgcatttcaccagcaattcatttagtgacgattgggcgggaaagatggacagagcaggcttaggtttctccgggtgttctgatggatgcggcggtgccgcttgtggctgctttaacgccgcacccagctgtatcttctggaggaaatgggtagaaaatcctcacgggattatctggaaggtgtccccatgcgccgcttgggttccctcagccgtcatagagctgacgatgcctagcggagaagtgcgcaccttccacccaatgagtggcatccccacacaggtgtttaaaggggtctctgttacttatctaggatccgacatggaggtgagcggcctcaccgatctgtgtgaaattgaggagcttaagtcgaaaaagttggcactggcgccgtgcaaccaggctggtatgggggtggtaggaaaagtcggcgaaatccaatgttcatctgaggaaagtgcccggacaattaagaaggacggttgcatctggaacgcagatctcgtgggcatagagctgagagttgacgatgccgtgtgttactccaaaattactagcgtcgaagctgtggccaattattctgcaatccctaccacaattgggggacttaggttcgagcgcagccatgactcccagggcaagatctcagggagtccactggatataaccgctatccgaggcagcttttctgttaactaccggggattgcgtctctccctgtcagagattactgccacgtgcacaggtgaagtgaccaatgtaagtgggtgctacagctgtatgactggagcgaaagtctccatcaagttacactcttcgaaaaacagcaccgcccatgtgagatgcaagggcgacgagacagctttctcagtgctggaaggtgtccactcctataccgttagtctatcttttgatcacgcagtggtagacgagcagtgtcagctcaattgcggcgggcatgaaagccaagtgactctgaagggaaaccttattttcttggacgtccccaaatttgtggatggctcctacatgcagacatatcactcaacggttcctaccggggccaatatcccctctccaactgactggctgaacgctctcttcggaaatggcctgagtaggtggatattaggtgtgattggggtcctgcttggaggcttggccctctttttcatgatcatgagcctgtttaagctaggcacaaaacaggtgttccgctcccggaccaagctggcatga

SEQ ID NO: 11477 - RNA, 3222 nt, synthetic construct
  misc_feature 1..3222: note = derived and/or modified CDS sequence (opt3) from SFTSV(KACNH)__KU507558.1__GP
  source 1..3222: mol_type = other RNA
atgatgaaggtgatctggttcagctccctgatttgcctcgtcatacagtgttctggcgactcagggcccatcatttgcgccggacctatccacagtaacaaaagcgcttccattccacatcttctgggttactctgagaagatctgtcaaatagatagattgatccacgtttcgtcatggttaaggaatcatagccagtttcagggctatgtggggcagcggggaggccgcagtcaagtatcctactatccggcagaaaactcttacagccgatggtccggtctgctatcaccctgcgacgccgattggctcgggatgctggtggtcaaaaaggcgaaaggaagtgacatgattgtgcctggcccaagctataagggcaaggttttctttgagcgtcccaccttcgatgggtacgtgggatggggttgtggctctgggaaatccagaacagaatcaggagagctttgcagcagtgactctggcacttccagcggtctgttgccttcggatagggtcctctggatcggggacgtggcttgtcagccaatgacgcccattcctgaagagacctttctggagctgaagtctttctcccagtcagaatttccagatatctgcaaaatagacggaattgtattcaatcagtgtgagggcgaaagtctcccgcaaccctttgatgttgcctggatggacgtgggccacagccataagatcattatgcgggagcacaaaacaaagtgggtccaggagtcctctagcaaggatttcgtgtgctataaagaagggactggaccttgttcagagagtgaagagaaggcatgcaaaacctccggtagctgccgcggcgacatgcagttttgtaaggtggccgggtgcgaacacggagaggaggcttctgacgcaaaatgtagatgctcattagtccataagccaggcgaagttgtggtaagttacggtgggatgagggtgcggcccaaatgttacggcttcagccgcatgatggccacactggaggtcaaccctccagaacagcgaatcggacaatgcaccggctgtcaccttgagtgcatcaatgggggagtgagattgattactctgacatccgaactaaagtctgctaccgtttgtgcctcgcatttttgcagctccgcgacgtcaggtaagaaaagtactgagatacagttccactctggcagcctcgtggggaagaccgcaatccacgtcaaaggagccctggtggatggcacagagttcacttttgaaggttcctgtatgttccccgacgggtgcgatgctgtagactgcaccttttgtagggagttccttaagaacccgcagtgctatcctgccaaaaagtggctgtttattttgatcgttatactcctgggctacgcaggattaatgctgattacaaatgtgctcaaggctatcggcgtctgggggtcatgggtgatcgcccccgtcaaacttatgttcgcgattatcaagaaactgatgcggaccgtgagctgtttgatgggaaagctaatggatcgtggtcgccaagttattcatgaagagataggcgaaaacggggagggaaatcaggacgatgtgagaatcgagatggccaggccacggcgagtacgccactggatgtattctcctgtcattctgacgatcctcgcaatcggcctggctgaaggttgcgacgagatggtgcatgccgattccaaacttgttagttgtagacaggggagcggcaacatgaaggaatgcgtgactacaggaagggctctgttgcccgccgtcaatccaggccaggaggcatgtctccactttaccgcccccgggtctcctgactccaagtgcctgaaaattaaggtgaaacggataaacttaaagtgtaaaaagtcaagtagctacttcgtaccagatgctcgctcgagatgcacttccgtgaggcgttgtcggtgggcgggagactgccaatctggctgcccgccccattttacaagcaattcattcagtgacgattgggcaggtaagatggaccgagccgggctgggattttccggctgttctgatggttgcggcggggctgcctgtggatgcttcaacgcagcccctagctgtatcttttggagaaaatgggttgagaatccacacggcattatctggaaggtctccccctgcgctgcctgggtgccttcagcagtgattgaactaaccatgccaagcggggaggtcaggacgttccaccccatgagtggaatcccgacccaggttttcaaaggcgtgtctgtgacatatctcggttccgacatggaagtaagcgggctgactgatctttgtgagatagaagagttgaagtcgaaaaagctggcgctcgctccttgcaaccaggccggaatgggcgtcgtgggtaaagttggcgagatccagtgttcatctgaagagagtgcacgcaccattaagaaggacgggtgcatctggaacgccgatctggtgggaattgaacttcgggtcgacgatgctgtgtgttactccaaaatcacaagcgttgaggccgtggcaaattattctgctataccaactaccattggcgggctgagatttgaaaggagccatgactcccaaggaaagatctcaggcagtcccttggatattacagccatccgcggtagcttctctgtaaactaccgagggctccggctgtccttatcagagataaccgcgacttgcacgggagaggtcacaaatgtgagtggctgctacagctgtatgaccggtgccaaagtgtccatcaagctgcactcttcgaaaaacagcactgctcatgtccgttgcaagggcgacgaaaccgcattttcagttctagagggggtgcactcctatacagtaagtctctctttcgatcacgccgtggtcgacgaacagtgtcagctgaattgcggaggccatgagagccaggtgacccttaaggggaacttgatttttctggacgttcctaaattcgtggatggatcctacatgcaaacttatcactcaacagtccccacgggcgctaatatcccatctcctaccgactggctcaacgccctgtttggtaatgggttaagcagatggattctgggagtgatcggcgttcttttgggcgggctcgcactgttctttctaataatgagtctgttcaagctcggaactaaacaggtgtttaggtcccgcacaaagctggcgtga

SEQ ID NO: 11478 - RNA, 3222 nt, synthetic construct
  misc_feature 1..3222: note = derived and/or modified CDS sequence (opt3) from SFTSV(KACNH2)__KU507559.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctactatccggcagaaaatagttactcccgatggtctggtctgctaagcccctgcgacgccgattggctcgggatgctggtggtcaaaaaggcgaaaggatccgacatgattgtgcctggcccatcatataagggcaaggttttctttgagcgtcccacattcgatgggtacgtgggatggggttgtggcagtgggaaaagcagaactgaatctggagagctttgctcctcagacagcggcacgagttctggtctgttgccttccaacagggtcctctggatcggggatgtggcttgtcagccaatgacccccattcctgaagagacatttctggagcttaagagcttctcgcagtctgaatttccagacatctgcaaaatagatggaattgtattcaatcagtgtgagtccgaatcactcccgcaaccctttgacgttgcctggatggatgtgggccacagtcataagatcattatgcgggagcacaaaactaagtgggtccaggagagctcctctaaggacttcgtgtgctataaagaaggcaccgggccttgtagcgagtcagaggaacgcacatgcaagaccagtggatcctgcagaggtgatatgcagttttgtaaagtggcaggctgcgaacacggggaggaggccagcgaagctaagtgtaggtgctctttagtccataaaccaggagaggttgtggtatcatacggcggtatgcgggtgcgccccaagtgttacgggttcagtcgaatgatggcaactctggaagtcaaccctccagagcagagaatcggccaatgcacaggatgtcacatcgaatgcattaatggcggggtgaggcttataaccttgacgagcgagctgaaatccgccactgtttgtgcttctcatttttgctcgagcgccacctccggaaagaagtcaacagagatccagttccacagtggttctctagtgggcaaagcggcaattcacgtcaagggggccctcgtggacggaactgaatttacctttgagggcagctgtatgttccccgacggttgcgatgctgtagactgcacattttgtcgggaatttctgaaaaacccgcagtgctatcctgccaagaaatggctttttatcataattgttatcctgttggggtacgcaggcctcatgctgttaaccaatgtgctgaaggctatcggagtctggggctcctgggtgattgcccccgtcaagctcatgttcgcgatcattaaaaagctgatgcgttcagtgagctgtctgatggggaaattgatggatcgcggaagacaagttatacatgaggaaatcggtgagaacagggagggcaatcaggacgatgtgcggattgaaatggcccgaccacgcagagtaaggcactggatgtattctcctgtcatcctaacgatcctggcaattgggctcgctgagggatgcgacgaaatggtgcatgccgattccaagctggttagttgtcggcagggcggtgggaacatgaaagagtgcgtgactacaggccgcgcccttctgcccgctgtcaatccaggacaggaggcatgtttgcactttaccgcccccggcagccctgactctaagtgcctcaagataaaagtgaagagaatcaacctgaaatgtaagaaatcctcaagttacttcgtaccagatgctaggagccgttgcacttcggtgcggcgatgtagatgggcgggggactgccaatccggatgcccgtctcattttacaagcaattcattcagtgatgactgggcaggcaagatggacagggccggtttagggttttccggatgttctgatggctgcggtggcgctgcctgtgggtgcttcaacgcagcccccagctgtattttctggcgcaagtgggttgaaaaccctcacggaatcatttggaaagtctccccatgcgctgcctgggtgccctcagcagtgatcgagctgaccatgcctagcggcgaagtccggacgttccacccaatgagtgggatacccacccaggttttcaagggagtgtctgtgacatatctaggctccgacatggaggtaagcggtctcactgatctgtgtgaaatcgaggagcttaaatcgaagaaattggcgctggctccgtgcaatcaggccgggatgggagtcgtgggcaaggttggtgaaattcagtgttcatctgaggaaagtgcaagaaccatcaaaaaggacggctgcatttggaacgccgatctcgtggggatcgagctgagggtcgacgatgctgtgtgttactccaagataacaagcgttgaagccgtggcaaattattctgctattcctactaccatcggaggccttcgctttgagcgaagccatgactcccaagggaaaatttcaggaagtccactggatatcacagccatacggggcagcttctctgtaaactaccgtggtttgagactctccctgtcagagatcaccgcgacttgcacgggggaagtcacaaatgtgagtggatgctacagctgtatgaccggcgccaaggtgtccattaaattacactcttcgaagaacagcactgctcatgtcaggtgcaaaggtgacgagaccgcattttcagttctggaaggcatccactcctatacagtgagtctatctttcgatcacgccgtagtggacgagcagtgtcagctcaattgcgggggacatgaaagccaggtcaccctgaagggcaaccttattttcttggatgtgcccaagttcgttgacgggtcctacatgcaaacttatcactcatctgtgcctacaggagctaatatccccagcccaacggactggctgaacgccctctttggcaatggtctgagtcgctggatattaggggtcattggagtgctgcttggcggcttggcactcttctttctgatcatgtccctattcaaactggggaccaagcaggtttttcggagcagaactaaactcgcgtga

SEQ ID NO: 11479 - RNA, 3222 nt, synthetic construct
  misc_feature 1..3222: note = derived and/or modified CDS sequence (opt3) from SFTSV(KACNH3)__KP663744.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctactatccggcagaaaatagttactcccgatggtctggtctgctaagcccctgcgacgccgattggctcgggatgctggtggtcaaaaaggcgaaaggatccgacatgattgtgcctggcccatcatataagggcaaggttttctttgagcgtcccacattcgatgggtacgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacatttctggagctgaagtcattctcgcagtctgaatttccagatatctgcaaaatagacggaattgtattcaaccagtgtgagtccgaatcactcccgcaaccctttgatgttgcctggatggacgtgggccacagtcataagatcattatgcgggagcacaaaactaagtgggtccaggagagctcctctaaggatttcgtgtgctataaagaaggcaccgggccttgtagcgagtcagaagagaagacatgcaaaaccagtggatcctgccgcggtgacatgcagttttgtaaggtggcaggctgcgaacacggggaggaggccagcggagctaaatgtagatgctctttagtccataagccaggcgaagttgtggtatcatacggtgggatgagggtgcggcccaaatgttacggcttcagtcgcatgatggcaactctggaggtcaatcctccagaacagcgaatcggacaatgcacaggctgtcaccttgagtgcatcaacgggggagtgagattgattaccctgacgagcgaactaaagtccgccactgtttgtgcttctcatttttgctcgagcgccacctccggtaagaaatcaacagagatacagttccacagtggctctctcgtggggaagactgcgatccacgtcaaaggagcactggtggacggcaccgagttcacatttgaaggtagctgtatgttccccgatgggtgcgacgccgtagattgcaccttttgtagggagttccttaagaatccgcagtgctatcctgctaaaaagtggctgtttattatcatagttattttgctcggctacgccggactgatgttactgacgaacgtgctcaaggcaatcggcgtctgggggtcctgggtgatcgctcccgtcaaacttatgttcgccattatcaagaaactgatgcggtcagtgagctgtttgatgggaaagctaatggaccgtggtcgccaagttattcatgaagagataggcgaaaatagagaggggaaccaggatgacgtgaggatcgagatggcgcggccacgacgcgtaagacactggatgtattctcctgtcattctgactatcctcgccatcggactggcagaaggctgcgatgagatggtgcatgctgactccaaacttgttagttgtaagcagggtagcgggaatatgaaggaatgcgtgacaaccggcagggccctgttgcccgctgtcaacccaggacaggaggcctgtctccactttactgcacccggctctcctgattccaaatgcctgaagattaaagtgaagcggataaatttaaaatgtaagaagtcaagtagctacttcgtaccagacgcccgctcgagatgcacatccgtgaggcgttgtcggtgggctggggattgccaatctggatgcccgagccattttacctcaaacagtttctccgacgactgggcgggcaaaatggatcgagcaggtctggggttttctggatgtagcgacggctgcggtggcgccgcttgtgggtgcttcaatgccgcaccctcctgtatcttttggagaaagtgggttgagaaccctcacggaattatctggaaagtctcaccatgcgccgcttgggtgcccagcgccgtgattgaactaacgatgcctagtggcgaggtcaggaccttccacccaatgtctgggatccccacacaggttttcaagggagtgtccgtgacttatctcggcagcgatatggaagtatcgggtctgaccgacctttgtgagatagaagagttgaaatcaaagaaactggcactcgcgccgtgcaaccaggctgggatgggagtcgtgggcaaggttggtgagatccagtgttctagtgaagagtccgcccgcacaattaagaaagatggctgcatctggaatgcagacctggtggggattgaacttcgggtcgatgacgccgtgtgttacagcaagatcacttctgttgaggctgtggccaactatagcgcaatacctaccacaattggaggcctgagatttgaaaggtcccatgattcacaagggaaaatcagtggaagcccattggacattaccgctatccgcggctctttctccgtaaattaccgaggtctccggctgtcattaagtgaggtcactgccacgtgcacaggggaggtgaccaacgtgagcggatgctactcctgtatgactggcgcgaaggtctctataaaactgcactcgagcaagaatagcaccgcccatgttcgttgcaagggtgatgaaacagctttttccgtgctagagggcgtacacagttataccgtgtctctcagcttcgaccacgcagtcgtggatgaacagtgtcagctgaactgcgggggacatgagtcccaggttactcttaaaggcaatttgatctttctggacgtgcccaagttcgtcgacgggtcatacatgcaaacatatcactctagcgtgcctacgggagccaacattcccagtccaaccgattggctcaatgctctgtttggcaacggtttatccagatggatcctgggggttattggagtgcttttgggcggcctcgccctgttctttctaatcatgagcctgttcaaactcgggactaagcaggtctttaggtctcgcacaaaactggcatga

SEQ ID NO: 11480 - RNA, 3222 nt, synthetic construct
  misc_feature 1..3222: note = derived and/or modified CDS sequence (opt3) from SFTSV(KADGH)__KU507548.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctactatccggcagaaaatagttactcccgatggtctggtctgctaagcccctgcgacgccgattggctcgggatgctggtggtcaaaaaggcgaaaggatccgacatgattgtgcctggcccatcatataagggcaaggttttctttgagcgtcccacattcgatgggtacgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacatttctggagctcaagagcttctcgcagtctgaatttccagatatctgcaaaatagacggaattgtattcaaccagtgtgagtccgaatcactggcccaaccgtttgatgttgcatggatggacgtgggccacagtcataagatcattatgcgggagcacaaaactaagtgggtccaggagagctcctctaaggatttcgtgtgctataaagaaggcaccgggccctgtagcgagtcagaagagaagacatgcaaaaccagtggatcctgccgcggtgacatgcagttttgtaaggtggccggctgcgaacacggggaggagactagcgtcgctaaatgtagatgctctttagttcataagcctggagaagtggtagtgtcatacggcggtatgagggtccggccaaaatgttacgggttcagtcgcatgatggcaacactggaggtgaatccccctgaacagcgaatcggccaatgcaccggatgtcaccttgagtgcatcagcggcggggttagattgattacgctgacttccgaactaaagtctgccaccgtgtgtgcttcgcatttttgcagctccgccacatcaggaaagaaaagtactgagatacagttccactctggtagcctcgtcggcaaggcggcaatccacgtgaaaggggtactggttgacggaaccgagttcacatttgaaggctcctgtatgttcccagatggttgcgacgccgtggattgcaccttttgtagggagttccttaagaacccccagtgctatccggctaaaaagtggctgtttattatcatagtcattttgctcgggtacgccggcctgatgttactgacgaatgtgctcaaggcaatcggagtctggggctcatgggtgatcgctcctgttaaacttatgttcgccattatcaagaaactgatgcggagcgtgtcttgtttgatggggaagctaatggaccgtggacgccaagtaattcatgaagagataggtgaaaacagagagggcaatcaggatgacgtcaggatcgagatggcgcggccccgacgcgtgagacactggatgtattccccagttattctgactatcctcgccatcgggctggcagaaggatgcgatgagatggtgcatgctgacagtaaacttgtcagctgtaggcagggctctggtaacatgaaggaatgcgtgacaaccgggcgggccctgttgcctgctgtaaatcccggccaggaggcctgtctccactttactgcaccaggatcccccgattcaaagtgcctgaaaattaaggtgaaacgcataaacttaaagtgtaaaaagagtagctcgtacttcgttcctgacgccagatccaggtgcacatctgtccgtcggtgtcgatgggctggcgattgccaaagcgggtgcccatcacattttaccagtaattccttctctgacgactgggcgggaaagatggatagagcaggcctgggttttagcgggtgttccgacggatgcggcggtgccgcttgtggctgcttcaacgccgcaccgtcatgtatcttttggaggaaatgggtggagaatccccacgggattatctggaaggtgagcccttgcgccgcttgggtcccaagtgccgttattgaactaacgatgccctctggagaggtgcgcaccttccaccctatgtccggcatcccaacacaggtgttcaaaggggtaagcgtcacttatctcggatcggatatggaagtgtcaggcctgaccgacctttgtgagatagaagagttgaagtctaaaaagctggcactcgcgccctgcaaccaggctggtatgggggttgtgggaaaagtcggcgagatccagtgtagttccgaagagagcgcccggacaattaagaaggatggttgcatctggaacgcagacctggtgggcattgaacttagagttgatgacgccgtgtgttactctaaaatcactagcgtagaggctgtcgccaattattccgcaataccgaccacaattgggggactgaggtttgaacgctcacatgatagtcaaggcaagatcagcgggtctcctttggacattaccgctatccgaggatccttctcagtgaactaccggggcctccgtctgagtttaagcgagataactgccacgtgcacaggtgaggtgaccaatgtctccgggtgctactcttgtatgactggagcgaaagtttcgatcagactgcacagctcaaagaactccaccgcccatgtgaggtgcaaagaagatgagacagcttttagtgtactagaaggcgtgcactcttataccgtcagcctctccttcgaccacgcagtggttgatgagcagtgtcagctgaattgcggtggccatgaatcacaggtgactcttaaggggaacttgatttttctggacgtcccaaagttcgtggacggatcttacatgcaaacatatcacagcagtgttcccacgggcgccaatatcccttcccccaccgattggctcaacgctctgtttgggaatggattaagccgctggattctgggcgtgatcggtgtccttttgggagggctcgccctgttctttctaataatgtctctgttcaaactcggcactaagcaggtatttcggtcaagaacaaaactggcatga

SEQ ID NO: 11481 - RNA, 3222 nt, synthetic construct
  misc_feature 1..3222: note = derived and/or modified CDS sequence (opt3) from SFTSV(KAGBH)__KU507560.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctacttcccggcagaaaatagttattcccgatggtctggtctgctaagcccctgcgacgccgattggctcgggatgctggtggtcaaaaaggcgaaaggatccgacatgattgtgcctggcccatcatacaagggcaaggttttcttcgagcgtcccacatttgatgggtatgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacattcctggagctgaagtcattttcgcagtctgaatttccagatatctgcaaaatagacggaattgtatttaaccagtgtgagtccgaatcactcccgcaacccttcgatgttgcctggatggacgtgggccacagtcataagatcattatgcgggagcacaaaactaagtgggtccaggagagctcctctaaggattttgtgtgctacaaagaaggcaccgggccttgtagcgagtcagaagagaagacatgcaaaaccagtggatcctgccgcggtgacatgcagttctgtaaggtggcaggctgcgaacacggggaggaggccagcgaagctaaatgtagatgctctttagtccataagccaggagaggttgtggtatcatatggcggtatgagggtgcggcccaaatgttacgggtttagtcgcatgatggcaactctggaagtcaatcctccagagcagcgaatcggccaatgcacaggatgtcaccttgaatgcatcaacggcggggtgagattgattaccctgacgagcgagctaaagtccgccactgtttgtgcttctcatttctgctcgagcgccacctccggaaagaaatcaacagagatacagttccacagtggttctctcgtgggcaagactgcgatccacgtcaaaggggcactggtggacggaaccgaatttacattcgagggcagctgtatgtttcccgatggttgcgacgccgtagattgcaccttctgtagggaatttcttaagaatccgcagtgctaccctgctaaaaagtggctgttcattatcatagttattttgctcgggtatgccggcctgatgttactgacgaacgtgctcaaggcaatcggagtctggggctcctgggtgatcgctcccgtcaaacttatgtttgccattatcaagaaactgattcggtcagtgagctgtttgatggggaagctaatggaccgtggacgccaagttatacatgaggaaatcggtgagaatagagagggcaaccaggatgacgtgaggattgaaatggcgcggccacgacgcgtaagacactggatgtactctcctgtcatcctgactatcctcgccattgggctggcagagggatgcgatgaaatggtgcatgctgactccaaacttgttagttgtaagcagggcagcggtaatatgaaggagtgcgtgacaaccgggagggccctgttgcccgctgtcaacccaggccaggaggcctgtctccacttcactgcacccggatctcctgattccaaatgcctgaagataaaagtgaagcggatcaatttaaaatgtaagaagtcaagtagctattttgtaccagacgcccgctcgagatgcacatccgtgaggcgttgtcggtgggctggcgattgccaatctgggtgcccgagccatttcacctcaaacagtttttccgacgactgggcgggaaaaatggatcgagcaggcctgggtttctctgggtgtagcgacggatgcggcggtgccgcttgtggctgctttaatgccgcaccctcctgtattttctggagaaagtgggttgaaaaccctcacgggatcatttggaaagtctcaccatgcgccgcttgggtgcccagcgccgtgatcgagctaacgatgcctagtggagaagtcaggaccttccacccaatgtctggcatacccacacaggtttttaagggggtgtccgtgacttacctcggaagcgatatggaggtatcgggcctgaccgacctttgtgaaatcgaggagttgaaatcaaagaaactggcactcgcgccgtgcaaccaggctggtatgggggtcgtgggaaaggttggcgaaattcagtgttctagtgaggaatccgcccgcacaatcaagaaagatggttgcatttggaatgcagacctggtgggcatcgagcttcgggtcgatgacgccgtgtgttatagcaagataacttctgttgaagctgtggccaactacagcgcaattcctaccacaatcgggggactgagattcgagaggtcccatgattcacaaggcaaaattagtgggagcccattggacatcaccgctatacgcggatctttttccgtaaattatcgaggcctccggctgtcattaagtgagatcactgccacgtgcacaggtgaagtcaccaacgtgagcgggtgctactcctgtatgactggagcgaaggtgtctattaaactgcactcgagcaagaatagcaccgcccatgtccgttgcaagggcgatgagacagctttctccgttctagaaggtgtgcacagttacaccgtatctctcagctttgaccacgcagtggtcgatgagcagtgtcagctgaactgcggcgggcatgaatcccaggtgactcttaaaggaaatttgatcttcctggacgttcccaagtttgtggacggctcatatatgcaaacataccactctagcgtccctacgggggccaacattcccagtccaaccgattggctcaatgctctgttcggaaacggcttatccagatggatcctgggtgtgataggggttcttttgggaggcctcgccctgtttttcctaattatgagcctgtttaaactcggcactaaacaggtgttcaggtctcgcacaaagctggcatga

SEQ ID NO: 11482 - RNA, 3222 nt, synthetic construct
  misc_feature 1..3222: note = derived and/or modified CDS sequence (opt3) from SFTSV(KAGBH3)__KU507561.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctacttcccggcagaaaatagttattcccgatggtctggtctgctaagcccctgcgacgccgattggctcgggatgctggtggtcaaaaaggcgaaaggatccgacatgattgtgcctggcccatcatacaagggcaaggttttcttcgagcgtcccacatttgatgggtatgtgggatggggttgtggcagtgggaaaagcagaactgaatctggagagctttgctcctcagacagcggcacgagttctggtctgttgccttccaacagggtcctctggatcggggatgtggcttgtcagccaatgacccccattcctgaagagacattcctggagctcaagagcttttcgcagtctgaatttccagacatctgcaaaatagatggaattgtatttaatcagtgtgagtccgaatcactgccgcaacccttcgacgttgcctggatggatgtgggccacagtcataagatcattatgcgggagcacaaaactaagtgggtccaggagagctcctctaaggactttgtgtgctacaaagaaggcaccgggccttgtagcgagtcagaagagaagacatgcaaaaccagtggatcctgccgcggtgatatgcagttctgtaaggtggcaggctgcgaacacggggaggagactagcgaagccaaatgtagatgctctttagtccataagccaggagaggttgtggtatcatatggcggtatgagggtgcggcccaaatgttacgggtttagtcgcatgatggctacactggaagtcaaccctccagagcagcgaatcggccaatgcaccggatgtcaccttgaatgcatcaatggcggggtgagaattataacgttgactagcgagctgaagtccgcaaccgtttgtgcctctcatttctgctcgagcgctacatccggaaagaaatcaactgagatccagttccacagtggttctctagtgggcaagaccgccattcacgtcaaaggggcgctcgtggacggaacagaatttaccttcgagggcagctgtatgtttcccgacggttgcgatgcagtagactgcacgttctgtagggaatttctgaagaacccgcagtgctaccctgccaaaaagtggcttttcatcataattgttatcctgttggggtatgctggcctcatgctgttaactaatgtgctgaaggccatcggagtctggggctcctgggtgattgcacccgtcaaactcatgtttgctatcattaagaaacttatgcggtcagtgagctgtctgatggggaagttgatggatcgtggacgccaagttatacatgaggaaatcggtgagaacagagagggcaatcaggacgatgtgaggattgaaatggcccggccacgacgcgtaagacactggatgtactctcctgtcatcctaacaatcctggcgattgggctcgccgagggatgcgacgaaatggtgcatgcagattccaaactggttctttgtaagcagggcagtggtaacatgaaggagtgcgtgaccactgggagggctctgttgcccgccgtcaatccaggccaggaggcttgtctccacttcacagcccccggaagccctgactctaaatgcctgaagataaaagtgaagcggatcaacttaaaatgtaagaagtcctcaagttattttgtaccagatgcacgcagcagatgcacctcggtgaggcgttgtcggtgggccggcgactgccaatccgggtgcccgtctcatttcacgagcaattcatttagtgatgactgggctggaaaaatggaccgagcgggcctgggtttctccgggtgttctgatggatgcggcggtgcagcctgtggctgctttaacgctgcccccagctgtattttctggagaaagtgggttgaaaaccctcacgggatcatttggaaagtctccccatgcgcagcctgggtgccctcagctgtgatcgagctaaccatgcctagcggagaagtcaggacattccacccaatgagtggcatacccactcaggtttttaagggggtgtctgtgacctacctcggatccgacatggaggtaagcggcctgacagatctttgtgaaatcgaggagttgaaatcgaagaaactggccctcgcaccgtgcaatcaggcgggtatgggggtcgtgggaaaggttggcgaaattcagtgttcatctgaggaaagtgctcgcactatcaagaaagacggttgcatttggaacgccgatctggtgggcatcgagcttcgggtcgacgatgcagtgtgttattccaagataaccagcgttgaagccgtggctaattactctgccattcctacaaccatcgggggactgagattcgagaggagccatgactcccaaggcaaaatttcagggagtccattggatatcactgcaatacgcggcagcttttctgtaaactatcgaggactccggctgtccttatcagagatcacggctacatgcaccggtgaagtcactaatgtgagtgggtgctacagctgtatgaccggagccaaggtgtccattaaactgcactcttcgaagaacagcacagcgcatgtccgttgcaagggcgacgagaccgccttctcagttctagaaggtgtgcactcctacgctgtaagtctctcttttgatcacgcagtggtcgacgagcagtgtcagctgaattgcggcgggcatgaaagccaggtgactcttaaaggaaacttgatcttcctggatgttcccaagtttgtggacggctcctatatgcaaacataccactcatctgtccctacgggggccaatattcccagcccaaccgactggctcaacgctctgttcggaaatggcttaagtagatggatcctgggtgtgataggggttcttttgggaggcctcgccctgtttttcctaattatgtccctgtttaaactcggcactaaacaggtgttcaggagccgcacaaagctggcatga

SEQ ID NO: 11483 - RNA, 3222 nt, synthetic construct
  misc_feature 1..3222: note = derived and/or modified CDS sequence (opt3) from SFTSV(KAGBH4)__KU507562.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctacttcccggcagaaaatagttattcccgatggtctggtctgctaagcccctgcgacgccgattggctcgggatgctggtggtcaaaaaggcgaaaggatccgacatgattgtgcctggcccatcatacaagggcaaggttttcttcgagcgtcccacatttgatgggtatgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacattcctggagctgaagtcattttcgcagtctgaatttccagatatctgcaaaatagacggaattgtatttaaccagtgtgagtccgaatcactcccgcaacccttcgatgttgcctggatggacgtgggccacagtcataagatcattatgcgggagcacaaaactaagtgggtccaggagagctcctctaaggattttgtgtgctacaaagaaggcaccgggccttgtagcgagtcagaagagaagacatgcaaaaccagtggatcctgccgcggtgacatgcagttctgtaaggtggcaggctgcgaacacggggaggaggccagcgaagctaaatgtagatgctctttagtccataagccaggagaggttgtggtatcatatggcggtatgagggtgcggcccaaatgttacgggtttagtcgcatgatggcaactctggaagtcaatcctccagagcagcgaatcggccaatgcacaggatgtcaccttgaatgcatcaacggcggggtgagattgattaccctgacgagcgagctaaagtccgccactgtttgtgcttctcatttctgctcgagcgccacctccggaaagaaatcaacagagatacagttccacagtggttctctcgtgggcaagactgcgatccacgtcaaaggggcactggtggacggaaccgaatttacattcgagggcagctgtatgtttcccgatggttgcgacgccgtagattgcaccttctgtagggaatttcttaagaatccgcagtgctaccctgctaaaaagtggctgttcattatcatagttattttgctcgggtatgccggcctgatgttactgacgaacgtgctcaaggcaatcggagtctggggctcctgggtgatcgctcccgtcaaacttatgtttgccattatcaagaaactgatgcggtcagtgagctgtttgatggggaagctaatggaccgtggacgccaagttattcatgaggaaataggtgagaatagagagggcaaccaggatgacgtgaggatcgaaatggcgcggccacgacgcgtaagacactggatgtactctcctgtcattctgactatcctcgccatcgggctggcagagggatgcgatgaaatggtgcatgctgactccaaacttgttagttgtaagcagggcagcggtaatatgaaggagtgcgtgacaaccgggagggccctgttgcccgctgtcaacccaggccaggaggcctgtctccacttcactgcacccggatctcctgattccaaatgcctgaagattaaagtgaagcggataaatttaaaatgtaagaagtcaagtagctattttgtaccagacgcccgctcgagatgcacatccgtgaggcgttgtcggtgggctggcgattgccaatctgggtgcccgagccatttcacctcaaacagtttttccgacgactgggcgggaaaaatggatcgagcaggcctgggtttctctgggtgtagcgacggatgcggcggtgccgcttgtggctgctttaatgccgcaccctcctgtatcttctggagaaagtgggttgaaaaccctcacgggattatctggaaagtctcaccatgcgccgcttgggtgcccagcgccgtgattgagctaacgatgcctagtggagaagtcaggaccttccacccaatgtctggcatccccacacaggtttttaagggggtgtccgtgacttacctcggaagcgatatggaggtatcgggcctgaccgacctttgtgaaatagaggagttgaaatcaaagaaactggcactcgcgccgtgcaaccaggctggtatgggggtcgtgggaaaggttggcgaaatccagtgttctagtgaggaatccgcccgcacaattaagaaagatggttgcatctggaatgcagacctggtgggcattgagcttcgggtcgatgacgccgtgtgttatagcaagatcacttctgttgaagctgtggccaactacagcgcaatacctaccacaattgggggactgagattcgagaggtcccatgattcacaaggcaaaatcagtgggagcccattggacattaccgctatccgcggatctttttccgtaaattatcgaggcctccggctgtcattaagtgagataactgccacgtgcacaggtgaagtcaccaacgtgagcgggtgctactcctgtatgactggagcgaaggtgtctatcaaactgcactcgagcaagaatagcaccgcccatgtccgttgcaagggcgatgagacagctttctccgttctagaaggtgtgcacagttacaccgtatctctcagctttgaccacgcagtggtcgatgagcagtgtcagctgaactgcggcgggcatgaatcccaggtgactcttaaaggaaatttgattttcctggacgttcccaagtttgtggacggctcatatatgcaaacataccactctagcgtccctacgggggccaacatccccagtccaaccgattggctcaatgctctgttcggaaacggcttatccagatggattctgggtgtgatcggggttcttttgggaggcctcgccctgtttttcctaataatgagcctgtttaaactcggcactaaacaggtgttcaggtctcgcacaaagctggcatga

SEQ ID NO: 11484 - RNA, 3222 nt, synthetic construct
  misc_feature 1..3222: note = derived and/or modified CDS sequence (opt3) from SFTSV(KAGBH5)__KP663738.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctacttcccggcagaaaatagttattcccgatggtctggtctgctaagcccctgcgacgccgattggctcgggatgctggtggtcaaaaaggcgaaaggatccgacatgattgtgcctggcccactttacaagggcaaggttttcttcgagcgtcccacatttgatgggtatgtgggatggggttgtggctcagggaaaagtagaactgaaagcggagagctgtgcagctccgactcaggcacgagcagtggtttgctcccttctgatagggtcctgtggatcggggacgtggcttgtcagccaatgacccccattcctgaagagacattcctggagctcaagtcctttagccagtcggaatttccagatatctgcaaaatagacggaattgtatttaaccagtgtgagtctgaatccttaccgcaacccttcgatgttgcctggatggacgtgggccactcacataagatcattatgcgggagcacaaaactaagtgggtccaggagagtagctccaaggattttgtgtgctacaaagaaggcaccgggccttgttctgagagcgaagagaagacatgcaaaacctcaggaagttgccgcggtgacatgcagttctgtaaggtggcaggctgcgaacacggggaggagacttccgaagccaaatgtagatgcagcctggtccataagccaggagaggttgtggtatcttatggcggtatgagggtgcggcccaaatgttacgggttttcacgcatgatggctacacttgaagtcaatcctccagagcagcgaatcggccaatgcaccggatgtcacttggaatgcatcaacggcggggtgagactgattacgctaacttcggagctcaagagcgcaaccgtttgtgcctcccatttctgttcttcggctacaagcggaaagaaatccactgagatacagttccactcaggtagtctggtgggcaagaccgccatccacgtcaaaggggcgcttgtggacggaacagaatttaccttcgagggtaggtgcatgtttcccgatggctgcgacgcagtagattgcacgttctgtcgggaatttctgaagaatccgcagtgctaccctgccaaaaagtggttgttcattatcatagttattctcctggggtatgctggcttaatgctgctcactaacgtgcttaaggccgtcggagtgtggggctcttgggtcatcgcacccgtgaaactgatgtttgctatcattaagaaattgatgcgtagcgtttcctgtctaatggggaagctgatggaccgcggaagacaagtgatccatgaggaaattggtgagaatagggagggcaaccaggatgacgtacggatagaaatggcccgaccacgcagagtcaggcactggatgtactcacctgtgatcctcgcgattctggccatcgggcttgcagagggatgcgatgaaatggttcatgctgacagcaaactggtgtcttgtaagcagggctccggtaatatgaaggagtgcgtcacaaccgggcgggccttgctccccgctgtgaacccaggccaggaggcctgtctgcacttcactgcacccggaagtcctgatagcaaatgcttaaagatcaaagtaaagcgcattaatctgaaatgtaagaagtcttcctcatattttgtgccagacgccagaagtaggtgcacaagcgttcgtcggtgtcgatgggctggcgattgccaatcggggtgcccgtcccatttcacctctaacagcttttcagacgactgggcgggaaaaatggatagagcaggcctaggtttcagtgggtgttccgacggatgcggcggtgccgcttgtggctgctttaatgccgcaccctcttgtatattctggaggaagtgggtcgaaaaccctcacgggatcatttggaaagtgagcccatgcgccgcttgggtgccctccgccgtcatcgagctcacgatgccttcaggagaagttcgcaccttccacccaatgagcggcattcccacacaggtgtttaagggggtgagtgtaacttacctgggatctgatatggaggtctccggccttaccgacttgtgtgaaatcgaggagctgaaaagcaagaaactcgcactggcgccgtgcaaccaggctggtatgggggtggttggaaaggtgggcgaaatacagtgttcgtcagaggaatctgcccggacaatcaagaaagatggttgcatttggaatgcagaccttgtcggcatcgagctgagagtggatgacgccgtttgttatagtaagattacttccgtggaagctgtagccaactacagcgcaatccctaccacaatagggggattgaggttcgagcgctctcatgatagccaaggcaaaatttccgggtcaccactcgacatcaccgctattcgaggaagttttagcgtcaattatcggggcctgcgtttatctctgtccgagatcactgccacgtgcacaggtgaagtgaccaacgtgtcagggtgctacagttgtatgactggagcgaaggtcagcataaaactacactcctctaagaatagtaccgcccatgttagatgcaagggcgatgagacagctttcagcgtgctcgaaggtgtacactcatacaccgtgtccctgagttttgaccacgcagtcgtggatgagcagtgtcagcttaactgcggcgggcatgaatctcaggttactttgaaaggaaatctgatcttcctcgacgtgcccaagtttgtcgacggcagctatatgcaaacataccactcctcagtgcctacgggggccaacattccctctccaaccgattggctgaatgctttattcggaaacggcctgtctaggtggatccttggtgttattggggtgttgctcggaggcctggccctatttttcctgatcatgagtctctttaaactgggcactaagcaggtcttccgctcccggacaaaacttgcatga

SEQ ID NO: 11485 - RNA, 3222 nt, synthetic construct
  misc_feature 1..3222: note = derived and/or modified CDS sequence (opt3) from SFTSV(KAGBH6)__KP663741.1__GP
  source 1..3222: mol_type = other RNA
atgatcaaggtgatttggttcagctccctgatatgcctcgtcatccagtgttctggcgacaccgggcccattatctgcgccggacctattcactcaaacaaaagtgctaatatcccacatcttctgggttacagcgagaagatatgtcaaatcgatagattgattcacgtttcctcttggttaaggaaccattcgcagtttcagggctatgtggggcagcggggaggccgctcacaagtaagctacttcccggcagaaaatagttattcccgatggtctggtctgctaagcccctgcgacgccgattggctcgggatgctggtggtcaaaaaggcgaaaggatccgacatgatcgtgcctggcccatcatacaagggcaaggttttcttcgagcgtcccacatttgatgggtatgtgggatggggttgtggcagtgggaaaagcagaactgaatctggagagctttgctcctcagacagcggcacgagttctggtctgttgccttccgatagggtcctctggattggggacgtggcttgtcagccaatgacccccatccctgaagagacattcctggagctgaagtccttttcgcagtctgaatttccagatatatgcaaaattgacggaatcgtatttaaccagtgtgagtccgaatcactcccgcaacccttcgatgttgcctggatggacgtgggccacagtcataagattatcatgcgggagcacaaaactaagtgggtccaggagagctcctctaaggattttgtgtgctacaaagaaggcaccgggccttgtagcgagtcagaagagaagacatgcaaaaccagtggatcctgccgcggtgacatgcagttctgtaaggtggcaggctgcgaacacggggaggaggccagcgaagctaaatgtagatgctctttagtccataagccaggagaggttgtggtatcatatggcggtatgagggtgcggcccaaatgttacgggtttagtcgcatgatggcaactctggaagtcaatcctccagagcagcgaatcggccaatgcacaggatgtcaccttgaatgcattaacggcggggtgagattgataaccctgacgagcgagctaaagtccgccactgtttgtgcttctcatttctgctcgagcgccacctccggaaagaaatcaacagagatccagttccacagtggttctctcgtgggcaagactgcgattcacgtcaaaggggcactggtggacggaaccgaatttacattcgagggcagctgtatgtttcccgatggttgcgacgccgtagattgcaccttctgtagggaatttcttaagaatccgcagtgctaccctgctaaaaagtggctgttcatcataattgttatcttgctcgggtatgccggcctgatgttactgacgaacgtgctcaaggcaatcggagtctggggctcctgggtgattgctcccgtcaaacttatgtttgccatcattaagaaactgatacggtcagtgagctgtttgatggggaagctaatggaccgtggacgccaagttatccatgaggaaattggtgagaatagagagggcaaccaggatgacgtgaggatcgaaatggcgcggccacgacgcgtaagacactggatgtactctcctgtcatcctgactattctcgccatagggctggcagagggatgcgatgaaatggtgcatgctgactccaaacttgttagttgtaagcagggcagcggtaatatgaaggagtgcgtgacaaccgggagggccctgttgcccgctgtcaacccaggccaggaggcctgtctccacttcactgcacccggatctcctgattccaaatgcctgaagatcaaagtgaagcggattaatttaaaatgtaagaagtcaagtagctattttgtaccagacgcccgctcgagatgcacatccgtgaggcgttgtcggtgggctggcgattgccaatctgggtgcccgagccatttcacctcaaacagtttttccgacgactgggcgggaaaaatggatcgagcaggcctgggtttctctgggtgtagcgacggatgcggcggtgccgcttgtggctgctttaatgccgcaccctcctgtatcttctggagaaagtgggttgaaaaccctcacgggattatctggaaagtctcaccatgcgccgcttgggtgcccagcgccgtgatagagctaacgatgcctagtggagaagtcaggaccttccacccaatgtctggcatccccacacaggtttttaagggggtgtccgtgacttacctcggaagcgatatggaggtatcgggcctgaccgacctttgtgaaattgaggagttgaaatcaaagaaactggcactcgcgccgtgcaaccaggctggtatgggggtcgtgggaaaggttggcgaaatccagtgttctagtgaggaatccgcccgcacaattaagaaagatggttgcatctggaatgcagacctggtgggcatagagcttcgggtcgatgacgccgtgtgttatagcaagattacttctgttgaagctgtggccaactacagcgcaatccctaccacaattgggggactgagattcgagaggtcccatgattcacaaggcaaaatcagtgggagcccattggacataaccgctatccgcggatctttttccgtaaattatcgaggcctccggctgtcattaagtgagattagcgccacttgcacgggtgaagtcacaaacgtgtccgggtgctactcttgtatgaccggagcgaaggtgtcgatcaaactgcacagctcaaagaatagcactgcccatgtccgttgcaagggcgatgagaccgctttcagtgttctagaaggtgtgcactcttacacagtaagcctctcctttgaccacgcagtggtcgatgagcagtgtcagctgaactgcggcgggcatgaatcacaggtgacccttaaaggaaatttgattttcctggacgttcccaagtttgtggacggctcttatatgcaaacttaccacagcagtgtccctacaggggccaacatcccctccccaacggattggctcaatgctctgttcggaaacggcttaagcagatggatactgggtgtgattggggttcttttgggaggcctcgccctgtttttcctaatcatgtctctgtttaaactcggcaccaagcaggcattcaggtcacgcactaaactggcgtga

SEQ ID NO: 11486 - RNA, 3222 nt, synthetic construct
  misc_feature 1..3222: note = derived and/or modified CDS sequence (opt3) from SFTSV(KAGNH)__KU507550.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcggcgcggaggccgatcacaggtaagctacttcccggcagaaaatagttattcccgttggtctggtctgctaagcccctgcgacgccgattggctcgggatgctggtggtcaaaaaggcgaaaggatccgacatgattgtgcctggcccatcatacaagggcaaggttttcttcgagagacccacatttgatgggtatgtgggatggggttgtggcagtgggaaaagcaggactgaatctggagagctttgctcctcagacagcggcacgagttctggtctgttgccttccgatcgggtcctctggatcggggacgtggcttgtcaaccaatgacccccattcctgaagagacattcctggagctgaagtcattttcgcagtctgaatttccagatatctgcaaaatagacggaattgtatttaaccagtgtgagtccgaatcactcccgcagcccttcgatgttgcctggatggacgtgggccacagtcataagatcattatgcgcgagcacaaaactaagtgggtccaagagagctcctctaaggattttgtgtgctacaaagaaggcaccgggccttgtagcgagtcagaagagaagacatgcaaaaccagtggatcctgcagaggtgacatgcagttctgtaaggtggcaggctgcgaacacggggaggaggccagcgaagctaaatgtaggtgctctttagtccataagccaggagaggttgtggtatcatatggcggtatgcgggtgcgccccaaatgttacgggtttagtcgaatgatggcaactctggaagtcaatcctccagagcagagaatcggccagtgcacaggatgtcaccttgaatgcatcaacggcggggtgaggttgattaccctgacgagcgagctaaagtccgccactgtttgtgcttctcatttctgctcgagcgccacctccggaaagaaatcaacagagatacaattccacagtggttctctcgtgggcaagactgcgatccacgtcaaaggggcactggtggacggaaccgaatttacattcgagggcagctgtatgtttcccgatggttgcgacgccgtagattgcaccttctgtcgggaatttcttaagaatccgcagtgctaccctgctaaaaagtggctgttcattatcatagttattttgctcgggtatgccggcctgatgttactgacgaacgtgctcaaggcaatcggagtctggggctcctgggtgatcgctcccgtcaaacttatgtttgccattatcaagaaactgattcgttcagtgagctgtttgatggggaagctaatggaccgcggaagacaggttatacatgaggaaatcggtgagaatagggagggcaaccaagatgacgtgcggattgaaatggcgcgaccacgcagagtaaggcactggatgtactctcctgtcatcctgactatcctcgccattgggctggcagagggatgcgatgaaatggtgcatgctgactccaaacttgttagttgtaagcagggcagcggtaatatgaaggagtgcgtgacaaccgggcgggccctgttgcccgctgtcaacccaggccaggaggcctgtctccacttcactgcacccggatctcctgattccaaatgcctgaagataaaagtgaagcgcatcaatttaaaatgtaagaagtcaagtagctattttgtaccagacgccagatcgaggtgcacatccgtgcgtcggtgtcgatgggctggcgattgccagtctgggtgcccgagccatttcacctcaaacagtttttccgacgactgggcgggaaaaatggatagagcaggcctgggtttctctgggtgtagcgacggatgcggcggtgccgcttgtggctgctttaatgccgcaccctcctgtattttctggaggaagtgggttgaaaaccctcacgggatcatttggaaagtctcaccatgcgccgcttgggtgcccagcgccgtgatcgagctaacgatgcctagtggagaagtccgcaccttccacccaatgtctggcatacccacacaagtttttaagggggtgtccgtgacttacctcggaagcgatatggaggtatcgggcctgaccgacctttgtgaaatcgaggagttgaaatcaaagaaactggcactcgcgccgtgcaaccaggctggtatgggggtcgtgggaaaggttggcgaaattcagtgttctagtgaggaatccgcccggacaatcaagaaagatggttgcatttggaatgcagacctggtgggcatcgagcttagagtcgatgacgccgtgtgttatagcaagataacttctgttgaagctgtggccaactacagcgcaattcctaccacaatcgggggactgaggttcgagcgctcccatgattcacagggcaaaattagtgggagcccattggacatcaccgctatacgaggatctttttccgtaaattatcggggcctccgtctgtcattaagtgagatcactgccacgtgcacaggtgaagtcaccaacgtgagcgggtgctactcctgtatgactggagcgaagatttctatcaaactgcactcgagcaagaatagcaccgcccatgtgagatgcaagggcgatgagacagctttctccgtcctagaaggtgttcacagttacaccgtgtctctcagctttgaccacgcagtagtggatgagcaatgtcagctgaactgcggcgggcatgaatcccaggtcactcttaaaggaaatttgattttcctggacgtgcccaagtttgttgacggctcatatatgcagacataccactctagcgtgcctacgggggccaacatccccagtccaaccgattggctcaatgctctgttcggaaacggcttatccaggtggatactgggtgtcattggggtgcttttgggaggcctcgccctgtttttcctaatcatgagcctgtttaaactcggcactaatcaagttttccgctctcggacaaagctggcatga

SEQ ID NO: 11487 - RNA, 3222 nt, synthetic construct
  misc_feature 1..3222: note = derived and/or modified CDS sequence (opt3) from SFTSV(KAGNH4)__KU507551.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctacttcccggcagaaaatagttattcccgatggtctggtctgctaagcccctgcgacgccgattggctcgggatgctggtggtcaaaaaggcgaaaggatccgacatgattgtgcctggcccatcatacaagggcaaggttttcttcgagcgtcccacatttgatgggtatgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacattcctggagcttaagagcttttcgcagtctgaatttccagatatctgcaaaatagacggaattgtatttaaccagtgtgagtccgaatcactcccgcaacccttcgatgttgcctggatggacgtgggccacagtcataagatcattatgcgggagcacaaaactaagtgggtccaggagagctcctctaaggattttgtgtgctacaaagaaggcaccgggccttgtagcgagtcagaagagaagacatgcaaaaccagtggatcctgccgcggtgacatgcagttctgtaaggtggcaggctgcgaacacggggaggaggccagcgaagctaaatgtagatgctctttagtccataagccaggagaggttgtggtatcatatggcggtatgaggatccggcccaaatgttacgggtttagtcgcatgatggcaactctggaagtgaatcctccagagcagcgaatcggccaatgcacaggatgtcaccttgaatgcattaacggcggggtcagattgataaccctgacgagcgagctaaagtccgccactgtgtgtgcttctcatttctgctcgagcgccacctccggaaagaaatcaacagagatccagttccacagtggttctctcgttggcaagactgcgattcacgtgaaaggggcactggtcgacggaaccgaatttacattcgagggcagctgtatgtttcccgatggttgcgacgccgtggattgcaccttctgtagggaatttcttaagaatccgcagtgctaccctgctaaaaagtggctgttcatcataattgtaatcttgctcgggtatgccggcctgatgttactgacgaacgttctcaaggcaatcggagtgtggggctcctgggtcattgctcccgtgaaacttatgtttgccatcattaagaaactgatgcggtcagtcagctgtttgatggggaagctaatggaccgtggacgccaagtgatacatgaggaaatcggtgagaatagagagggcaaccaggatgacgttaggattgaaatggcgcggccacgacgcgtgagacactggatgtactctcctgtaatcctgactatcctcgccattgggctggcaggaggctgcgatgagatggtccatgctgactccaaacttgtgagttgtaggcagggtagcgggaatatgaaggaatgcgttacaaccggccgggccctgttgcccgctgtgaacccaggacaggaggcctgtctccacttcactgcacccggctctcctgattccaagtgcctgaaaatacgcgtcaagagaatcaatttaaaatgtaagaaatcaagtagctattttgtgccagacgccaggtcgcgttgcacatccgtacggcgatgtagatgggctggggattgccaatctggatgcccgagccatttcacctcaaacagtttttccgacgactgggcgggcaagatggatagggcaggtctggggttctctggatgtagcgacggctgcggtggcgccgcttgtgggtgctttaatgccgcaccctcctgtattttctggcgcaagtgggtggagaaccctcacggaatcatttggaaagtttcaccatgcgccgcttgggtccccagcgccgtgatcgaactaacgatgcctagtggcgaggtgcggaccttccacccaatgtctgggatacccacacaggtctttaagggagtttccgtgacttacctcggcagcgatatggaagtgtcgggtctgaccgacctttgtgagatcgaagagttgaaatcaagaaagctggcactcgcgccgtgcaaccaggctgggatgggagtagtcggcaaagtgggtgagattcagtgttctagtgaagagtccgccaggacaatcaagaaagatggctgcatttggaatgcagacctggttgggatcgaacttcgcgtggatgacgccgtctgttatagcaagataacttctgtggaggctgttgccaactacagcgcaattcctaccacaatcggaggcctgcgattcgaacggtcccatgattcacaagggaagattagtggaagcccattggacatcaccgctatacgtggctctttttccgtgaattatagaggtctcaggctgtcattaagtgagatcactgccacgtgcacaggggaggtaaccaacgtcagcggatgctactcctgtatgactggcgcgaaagtgtctattaagctgcactcgagcaaaaattcaaccgcccatgtgcgctgcaagggtgatgaaacagctttctccgtcctagagggcgttcacagttacaccgtgtctctcagctttgaccacgcagtagtggatgaacagtgtcagctgaactgcgggggacatgagtcccaggtcactcttaaaggcaatttgatcttcctggacgtgcccaagtttgttgacgggtcatatatgcaaacataccactctagcgtgcctacgggagccaacattcccagtccaaccgattggctcaatgctctgttcggcaacggtttatcccggtggatcctgggggtcataggagtgcttttgggcggcctcgccctgtttctactgattatgagcctcttcaagctggggactaaacaggtttttagatctaggacaaagctggcatga

SEQ ID NO: 11488 - RNA, 3222 nt, synthetic construct
  misc_feature 1..3222: note = derived and/or modified CDS sequence (opt3) from SFTSV(KAGWH2)__KU507564.1__GP
  source 1..3222: mol_type = other RNA
atgatgaaggtgatctggttcagctccctgatttgcctcgtcatacagtgtggcggggacaccggacccatcatttgcgccggtcctatccactctaacaaatcagctggcattccacatcttctggggtacagtgagaagatctgtcaaatagatagattgatccacgttagctcctggttaaggaatcattctcagtttcagggatatgtgggccagcggggtgggcgctcgcaagtatcatactatccggcagaaaacagctacagtcgatggtccggactgctatctccctgcgacgccgattggctcggcatgctggtggtcaaaaaggcgaaaggcagcgacatgattgtgcctgggccatcctataagggaaaggttttctttgagcgtcccacattcgatggttacgtgggctgggggtgtggatcaggcaaaagtagaactgaaagcggtgagctttgttcttccgactcagggacgagcagtggactgttgccttctgatagggtcctctggatcggcgacgtggcttgccagccaatgacccccattcctgaagagacatttctggagctgaagtccttcagccagtcggaatttccagatgtatgcaaaatcgacggcatagttttcaatcagtgtgagggggaatctctcccgcaaccctttgatgtggcctggatggacgtcggacactcccataagattatcatgcgggagcacaaaactaagtgggtgcaggagtcaagtagcaaggatttcgtgtgctataaagaaggtaccggcccttgttccgagtctgaagagaagacatgcaaaaccagcgggtcatgccgcggagacatgcagttttgtaaggtcgcaggctgcgaacacggtgaggaggccagtgaagctaaatgtagatgctccttagttcataagccaggggaggtggtagtgagctacggcggaatgagggtccggcccaaatgttacggcttctctcgcatgatggcaactctggaagtgaaccctccagagcagcgaattgggcaatgcacaggatgtcaccttgaatgcatcaatggtggcgttagattgatcaccctgacgtcagagctaaagagtgccactgtgtgtgctagccatttttgctcctctgccacctcggggaagaaaagcacagagattcagttccactccggatcactcgtcggcaagactgcgatacacgtgaaaggtgcactggtagacgggaccgagttcacatttgaaggcagttgtatgttccccgatggatgcgacgccgttgattgcaccttttgtagggagttccttaagaacccgcagtgctatcctgctaaaaagtggctgtttatcattatcgtgatattgctcggctacgccgggctgatgttactgacgaatgtcctcaaggcaattggagtgtggggttcttgggtcatcgctcccgtgaaacttgttttcgccatcattaagaaactgatgcgggcggtgagctgtttgatgggcaagctaatggaccgtgggcgccaagtaatccatgaagaaattggagagaacagagagggcaatcaggatgacgtcaggatagaaatggcccggccacgacgcgtgagacactggatgtattcccctgttatcctgactattctcgcaatcggtctggctgaggggtgcgatgaaatggtgcatgccgactcaaaacttgtcagctgtaggcagggctctggaaacatgaaggagtgcgtgacaaccggccgggctctgttgcccgccgtaaatccagggcaggaggcatgtctccactttactgcccccggatcccctgatagtaagtgcctgaaaatcaaggtgaaacgcattaacttaaagtgtaaaaagtcgtcttcctacttcgttccagacgctagatcaaggtgcacaagtgtccgtcggtgtcgatgggcgggcgattgccaaagcggttgcccgccccattttaccagcaattccttctctgacgactgggcagggaagatggatagagccggactgggctttagcggttgttcagacggctgcgggggagctgcctgtggctgcttcaacgcagcccctagttgtatattttggaggaaatgggtggaaaatccacacgggatcatttggaaggtgtccccctgcgctgcctgggtcccttctgcagttatcgagctaacgatgccaagcggagaagtgcgcaccttccaccccatgtccggcattccgacacaggtgttcaaaggtgtatcagtcacttatctcgggagcgatatggaggtgagtggactgaccgacctttgtgaaatcgaggagttgaagtctaaaaagctggcgctcgctccttgcaaccaggccggcatgggtgttgtgggcaaagtcggggaaatacagtgttccagcgaggaatcggcacggacaatcaagaaggatggatgcatttggaacgccgacctggtgggcatcgagcttagagttgatgacgctgtgtgttactcaaaaattacttctgtagaagccgtcgcaaattatagtgctatcccaaccacaatagggggactgaggtttgagcgctcccatgatagccaaggcaagatttctggtagccccttggacatcaccgccattcgagggtccttctcagtgaactaccggggactccgtctgagtttaagcgagatcactgcgacgtgcacaggcgaagtgaccaatgtctctggttgctactcctgtatgactggcgccaaagtttcaataaagctgcacagtagcaaaaactccaccgctcatgtgagatgcaagggggatgagacagcattttctgtactagaaggagtgcactcgtatagcgtctcactctccttcgaccacgccgtggttgatgagcagtgtcagctgaattgcggcgggcatgaaagtcaggtgacccttaggggaaacttgatctttctggacgtccctaagttcgtggacggctcttacatgcaaacttatcacagcacagttcccacgggtgctaatattccatcccctaccgattggctcaacgccctgtttgggaatggattatcacgctggatcctgggcgtgattggcgtccttctcgggggattggcactgttctttctaatcatgtctctgttcaaactcggtactaagcaggtatttcggagcagaacaaaactggcgtga

SEQ ID NO: 11489 - RNA, 3222 nt, synthetic construct
  misc_feature 1..3222: note = derived and/or modified CDS sequence (opt3) from SFTSV(KAGWH3)__KP663735.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctacttcccggcagaaaatagttattcccgatggtctggtctgctaagcccctgcgacgccgattggctcgggatgctgattgtgaaaaaggcgaaaggatccgacatgatcgtccctggcccatcatacaagggcaaggtgtttttcgagcgtcccacatttgatgggtatgttggatggggttgtggcagtgggaaaagcagaactgaatctggagagctttgctcctcagacagcggcacgagttctggtctgttgccttccgatagggtgctctggattggggacgtcgcttgtcagccaatgacccccatccctgaagagacattcctggagctcaagagcttttcgcagtctgagttcccagatatatgcaaaattgacggaatcgtgtttaaccagtgtgaatccgaatcactgccgcaacccttcgatgtagcctggatggacgttggccacagtcataagattatcatgcgggagcacaaaactaagtgggtgcaggagagctcctctaaggattttgtctgctacaaagaaggcaccgggccttgtagcgagtcagaagagaagacatgcaaaaccagtggatcctgccgcggtgacatgcagttctgtaaggtggcaggctgcgaacacggggaggaggccagcgaagctaaatgtagatgctctttagtgcataagccaggagaggtcgttgtgtcatatggcggtatgagggtacggcccaaatgttacgggtttagtcgcatgatggcaactctggaagtgaatcctccagagcagcgaatcggccaatgcacaggatgtcaccttgaatgcattaacggcggggtcagattgataaccctgacgagcgagctaaagtccgccactgtgtgtgcttctcatttctgctcgagcgccacctccggaaagaaatcaacagagatccagttccacagtggttctctcgttggcaagactgcgattcacgtgaaaggggcactggtcgacggaaccgaatttacattcgagggcagctgtatgtttcccgatggttgcgacgccgtggattgcaccttctgtagggaatttcttaagaatccgcagtgctaccctgctaaaaagtggctgttcatcataattgtaatcttgctcgggtatgccggcctgatgttactgacgaacgttctcaaggcaatcggagtgtggggctcctgggtcattgctcccgtgaaacttatgtttgccatcattaagaaactgatgcggtcagtcagctgtttgatggggaagctaatggaccgtggacgccaagtgatacatgaggaaatcggtgaggttagagagggcaatcaggatgacgtgaggattgaaatggcgcggccacgacgcgtaagacactggatgtactctcctgtcatcctgactatcctcgccattgggctggcagagggatgcgatgaaatggtgcatgctgactccaaacttgttagttgtaagcagggcagcggtaacatgaaggagtgcgtgacaaccgggagggccctgttgcccgctgtcaatccaggccaggaggcctgtctccacttcactgcacccggatctcctgattccaaatgcctgaagataaaagtgaagcggatcaacttaaaatgtaagaagtcaagtagctattttgtaccagacgcccgctcgagatgcacatccgtgaggcgttgtcggtgggctggcgattgccaatctgggtgcccgagccatttcacctcaaatagtttttccgacgactgggcgggaaaaatggatcgagcaggcctgggtttctctgggtgtagcgacggatgcggcggtgccgcttgtggctgctttaacgccgcaccctcctgtattttctggagaaagtgggttgaaaatcctcacgggatcatttggaaagtctcaccatgcgccgcttgggtgcccagcgccgtgatcgagctaacgatgcctagtggagaagtcaggaccttccacccaatgtctggcatacccacacaggtttttaagggggtgtccgtgacttacctcggaagcgatatggaggtatcgggcctgaccgacctttgtgaaatcgaggagttgaaatcaaagaaactggcactcgcgccgtgcaaccaggctggtatgggggtcgtgggaaaggttggcgaaattcagtgttctagtgaggaatccgcccgcacaatcaagaaagatggttgcatttggaacgcagacctggtgggcatcgagcttcgggtcgatgacgccgtgtgttatagcaagataacttctgttgaagctgtggccaattacagcgcaattcctaccacaatcgggggactgagattcgagaggtcccatgattcacaaggcaaaattagtgggagcccattggacatcaccgctatacgcggatctttttccgtaaactatcgaggcctccggctgtcattaagtgagatcactgccacgtgcacaggtgaagtcaccaatgtgagcgggtgctactcctgtatgactggagcgaaggtgtctattaaactgcactcgagcaagaactcaaccgcccatgtccgttgcaagggcgatgagacagctttctccgttctagaaggtgtgcacagttacaccgtatctctcagctttgaccacgcagtggtcgatgagcagtgtcagctgaattgcggcgggcatgaatcccaggtgactcttaaaggaaacttgatcttcctggacgttcccaagtttgtggacggctcatatatgcaaacataccactctagcgtccctacgggggccaatattcccagtccaaccgattggctcaacgctctgttcggaaatggcttatccagatggatcctgggtgtgataggggttcttttgggaggcctcgccctgtttttcctaattatgagcctgtttaggctcggcactaaacaggtgttccgctctcggacaaagctggcatga

SEQ ID NO: 11490 - RNA, 3222 nt, synthetic construct
  misc_feature 1..3222: note = derived and/or modified CDS sequence (opt3) from SFTSV(KAICH)__KU507565.1__GP
  source 1..3222: mol_type = other RNA
atgatgaaggtgatctggttcagctccctgatttgcctcgtcatacagtgtggcggggacacctctcccatcatttgcgccggacctatccactcaaacaaaagtgctgatattccacatcttctgggttacagcgagaagatctgtcaaatagacagattgatccacgtttcctcttggttaaggaatcattcgcagtttcagggctatgtggggcagcggggaggccgctcacaagtaagctactatccggcagaaaacagttactcccgatggtctggtctgctaagcccctgcgatgccgactggctcgggatgctggtggtcaaaaaggcgaaaggatccgatatgattgtgcctggcccatcatataagggcaaggttttctttgagcgtcccacattcgacgggtacgtgggatggggttgtggcagtgggaaaagcagaactgaatctggagagctttgctcctcagatagcggcacgagttctggtctgttgccttccgacagggtcctctggatcggggatgtggcttgtcagccaatgacccccattcctgaagagacatttctggagctcaagagcttctcgcagtctgaatttccagacatctgcaaaatagatggaattgtattcaatcagtgtgagggcgaatccctgccgcaaccctttgacgttgcctggatggatgtgggccactcacataagatcattatgcgggagcacaaaactaagtgggtccaggagagtagctccaaggacttcgtgtgctataaagaagggaccggaccttgttctgagagcgaagagaagacatgcaaaacctcaggtagttgccgcggcgacatgcagttttgtaaggtggcagggtgcgaacacggagaggaggcctccgaagctaaatgtagatgcagcttagtccataagccaggcgaggttgtggtatcttacggtgggatgagggtgcggcccaaatgttacggcttctcacgcatgatggcaactctggaagtcaaccagcctgagcaacgaatcggacagtgcacaggctgtcaccttgaatgcatcagtgggggagtgagattgattaccctgacgagcgagctaaagtccgccactgtttgtgcttctcatttttgctcgagcgccacctccggtaagaaatcaacagagatacagttccacagtggctctctcgtggggaagactgcgatccacgtcaaaggagcactggtggatggcaccgagttcacatttgaaggtagctgtatgttcccagacgggtgcgatgccgtagactgcaccttttgtagggagttccttaagaatccccaatgctatccggctaaaaagtggctgtttattatcatagttattttgctcggctacgccggactgatgttactgacgaacgtgctcaaggcaatcggcgtctgggggtcctgggtgatcgctcctgtcaaacttgtgttcgccattatcaagaaactgatgcgggcggtttcatgtttgatgggaaagctaatggatcgtggtcgccaggtgattcatgaagaaataggcgagaatagagaggggaaccaggacgatgtaaggatcgaaatggcccggccccgacgcgtcagacactggatgtatagcccagtgattctgactatcctcgcaatcggactggctgagggctgcgacgaaatggttcatgccgattctaaacttgtgtcctgtaggcagggtagtgggaatatgaaggagtgcgtcacaaccggccgggctctgttgcctgccgtgaaccccggacaagaggcatgtctccactttactgccccaggcagccccgactctaagtgcctgaaaattaaggtaaaacgcataaatttaaagtgtaaaaagtcctcaagttacttcgtgcctgatgctagatcgaggtgcacaagcgttcgtcggtgtcgatgggcgggggactgccagtccggatgcccaccgcattttacctctaacagcttctcagacgattgggcaggcaagatggacagagccggtctggggtttagtggatgttccgatggctgcggtggcgctgcctgtgggtgcttcaatgcagccccctcttgtatcttttggaggaaatgggtcgaaaaccctcacggaattatctggaaggtgagcccatgcgctgcctgggtgccctccgcagtcattgagctaacgatgccttcaggcgaagttcgcaccttccacccaatgagcgggatccccacacaggtgttcaaaggagtgagtgtaacttatctcggctctgacatggaggtctccggtctgaccgatctttgtgaaatggaggagttgaaaagcaagaagctggcgctcgctccgtgcaatcaggccgggatgggagtggttggcaaagtgggtgaaatacaatgttcgtcagaggaatctgcacggacaatcaagaaggacggctgcatttggaacgccgatctggtcgggatcgagcttagagtggacgatgctgtttgttacagtaaaattacttccgtggaagccgtaaccaactatagcgcaatccctacaaccataggaggcctgaggtttgagcgctctcatgacagccaggggaagatttccggatcaccattggatatcactgctattcgaggcagtttcagcgtcaattaccggggtctccgtctgtctttatccgagatcacggccacatgcaccggggaagtgactaacgtgtcaggatgctacagttgtatgaccggcgcgaaagtcagcataaagctgcactcctctaaaaattcgacagcccatgttagatgcaagggtgacgagaccgcttttagcgtgctagaaggcgtacactcatattccgtgagtctctctttcgatcacgcagtcgtggacgagcagtgtcagctgaactgcgggggacatgaaagcaaggttactcttaggggcaatttgatctttctggacgtgcccaaattcgtcgatgggtcctacatgcaaacatatcactcaacggtgcctaccggagccaacattccctctccaactgactggctcaatgctctgtttggcaacggtttaagccgctggttcctgggggttatcggagtgcttttgggcggcctcgccctgtttttcctaattatgagtctgtttaagctcgggacaaaacaggtcttccggtccagaagcaagctggcatga

SEQ ID NO: 11491 - RNA, 3222 nt, synthetic construct
  misc_feature 1..3222: note = derived and/or modified CDS sequence (opt3) from SFTSV(KAJJH)__KU507566.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctactatccggcagaaaatagttactcccgatggtctggtctgctaagcccctgcgacgccgattggctcgggatgctggtggtcaaaaaggcgaaaggatccgacatgattgtgcctggcccatcatataagggcaaggttttctttgagcgtcccacattcgatgggtacgtgggatggggttgtggcagtgggaaaagcagaactgaatctggagagctttgctcctcagacagcggcacgagttctggtctgttgccttccaacagggtcctctggatcggggatgtggcttgtcagccaatgacccccattcctgaagagacatttctggagcttaagagcttctcgcagtctgaatttccagacatctgcaaaatagatggaattgtattcaatcagtgtgagtccgaatcactcccgcaaccctttgacgttgcctggatggatgtgggccacagtcataagatcattatgcgggagcacaaaactaagtgggtccaggagagctcctctaaggacttcgtgtgctataaagaaggcaccgggccttgtagcgagtcagaagaacgcacatgcaagaccagtggatcctgcagaggtgatatgcagttttgtaaagtggcaggctgcgaacacggggaggaggccagcgaagctaagtgtaggtgctctttagtccataaaccaggagaggttgtggtatcatacggcggtatgcgggtgcgccccaagtgttacgggttcagtcgaatgatggcaactctggaagtcaaccctccagagcagagaatcggccaatgcacaggatgtcacatcgaatgcattaatggcggggtgaggcttataaccttgacgagcgagctgaaatccgccactgtttgtgcttctcatttttgctcgagcgccacctccggaaagaagtcaacagagatccagttccacagtggttctctagtgggcaaagcggcaattcacgtcaagggggccctcgtggacggaactgaatttacctttgagggcagctgtatgttccccgacggttgcgatgctgtagactgcacattttgtcgggagttcctgaaaaacccgcagtgctatcctgccaagaaatggctttttatcataattgttatcctgttggggtacgcaggcctcatgctgttaaccaatgtgctgaaggctatcggagtctggggctcctgggtgattgcccccgtcaagctcatgttcgcgatcattaaaaagctgatgcgttcagtgagctgtctgatggggaaattgatggatcgcggaagacaagttatacatgaggaaatcggtgagaacagggagggcaatcaggacgatgtgcggattgaaatggcccgaccacgcagagtaaggcactggatgtattctcctgtcatcctaacgatcctggcaattgggctcgctgagggatgcgacgaaatggtgcatgccgattccaagctggttagttgtcggcagggcggtgggaacatgaaagagtgcgtgactacaggccgcgcccttctgcccgctgtcaatccaggacaggaggcatgtttgcactttaccgcccccggcagccctgactctaagtgcctcaagataaaagtgaagagaatcaacctgaaatgtaagaaatcctcaagttacttcgtaccagatgctaggagccgttgcacttcggtgcggcgatgtagatgggcgggggactgccaatccggatgcccgtctcattttacaagcaattcattcagtgatgactgggcaggcaagatggacagggccggtttagggttttccggatgttctgatggctgcggtggcgctgcctgtgggtgcttcaacgcagcccccagctgtattttctggcgcaagtgggttgaaaaccctcacggaatcatttggaaagtctccccatgcgctgcctgggtgccctcagcagtgatcgagctgaccatgcctagcggcgaagtccggacgttccacccaatgagtgggatacccacccaggttttcaagggagtgtctgtgacatatctaggctccgacatggaggtaagcggtctcactgatctgtgtgaaatcgaggagcttaaatcgaagaaattggcgctggctccgtgcaatcaggccgggatgggagtcgtgggcaaggttggtgaaattcagtgttcatctgaggaaagtgcaagaaccatcaaaaaggacggctgcatttggaacgccgatctcgtggggatcgagctgagggtcgacgatgctgtgtgttactccaagataacaagcgttgaagccgtggcaaattattctgctattcctactaccatcggaggccttcgctttgagcgaagccatgactcccaagggaaaatttcaggaagtccactggatatcacagccatacggggcagcttctctgtaaactaccgtggtttgagactctccctgtcagagatcaccgcgacttgcacgggggaagtcacaaatgtgagtggatgctacagctgtatgaccggcgccaaggtgtccattaaattacactcttcgaagaacagcactgctcatgtcaggtgcaaaggtgacgagaccgcattttcagttctggaaggcgtgcactcctatacagtaagtctatctttcgatcacgccgtggtcgacgagcagtgtcagctcaattgcgggggacatgaaagccaggtgaccctgaagggcaaccttatctttttggatgttcccaagttcgtggacgggtcctacatgcaaacttatcactcatctgtccctacaggagctaatattcccagcccaacggactggctgaacgccctctttggcaatggtctgagtcgctggatcttaggggtgataggagttctgcttggcggcttggcactcttctttctgattatgtccctattcaaactggggaccaaacaggtgtttcggagcagaactaagctcgcgtga

SEQ ID NO: 11492 - RNA, 3222 nt, synthetic construct
  misc_feature 1..3222: note = derived and/or modified CDS sequence (opt3) from SFTSV(KAJNH2)__KU507552.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctactatccggcagaaaatagttactcccgatggtctggtctgctaagcccctgcgacgccgattggctcgggatgctggtgcttaaaaaggcgaaagagtccgacatgattgtccctggaccatcatataagggcaaggtgttctttgaacgtcccacattcgatggctacgttgggtggggatgtggtagtggcaaaagcagaactgagtctggggaactgtgctcctcagacagcggaacgagttctggcttgctcccttccgatagggtgctgtggatcggtgacgtcgcttgtcagccaatgacccccattcctgaggagacatttctggaactcaagagcttctcgcagtctgagtttccagatatctgcaaaatagacgggattgtgttcaaccagtgtgaatccgagtcattaccgcaaccctttgatgtagcctggatggacgttggacacagtcataagatcattatgcgggagcacaaaactaagtgggtgcaggaaagctcctctaaggatttcgtctgctataaagagggcaccggcccttgtagcgaatcagaggaaaagacatgcaaaaccagtgggtcctgccgcggagacatgcagttttgtaaggtggcaggttgcgagcacggcgaggaagccagcgaggctaaatgtagatgctctctggtgcataagccaggggaagtcgttgtgtcatacggaggcatgagggtacggcccaaatgttacggtttcagtcgcatgatggcaactcttgaggtgaatcctccagaacagcgaatcgggcaatgcacaggctgtcacttggagtgcatcaacggaggcgtcagactgattaccctaacgagcgagctcaagtccgccactgtgtgtgcttctcatttttgctcgagcgccacctccgggaagaaatcaacagaaatacagttccacagtggatctctggttggtaaggcggcaatccacgtgaaaggcgcccttgtcgacgggactgagttcacctttgaaggaagctgtatgttccccgatggctgcgacgctgtggattgcacattttgtagggagttcctgaagaatccgcagtgctatcctgccaaaaagtggttgtttattatcatagtaattctcctgggttacgcagggttaatgctgctcaccaacgttcttaaggctatcggcgtgtggggatcctgggtcatcgcccccgtgaaactgatgttcgcgattatcaagaaattgatgcggtcagtcagctgtctaatgggcaagctgatggaccgtgggcgccaagtgattcatgaagagataggagagaatagagaaggtaacagggatgacgttcggatcgagatggcccgaccacgcagagtgaggcactggatgtattctcctgtaattctcacgatcctggcaatcggccttgctgaagggtgcgatgagatggtccatgccgactccaaactggtgagttgtcggcagggaagcggcaatatgaaggagtgcgttactacaggtcgcgctttgctccccgccgtgaacccagggcaggaagcatgtctgcactttaccgcccccggctctcctgattccaagtgcttaaaaattaaggtcaaaagaataaatctgaagtgtaaaaagtcaagtagctacttcgtgccagacgctaggtcgcgttgcacttccgtacggcgatgtagatgggcgggagattgccagtctggctgcccgagccattttacatcaaacagtttctccgacgactgggcagggaagatggatagggccggactaggcttttctggttgtagcgacgggtgcggaggcgctgcctgtggttgcttcaatgcagccccctcctgtatcttttggcgcaaatgggtggagaaccctcacggcattatctggaaggtttcaccatgcgctgcctgggtccccagcgcagtgattgaactcaccatgcctagtggggaggtgcggacgttccacccaatgtctggaatccccacccaagtcttcaaaggcgtttccgtgacatatctggggagcgatatggaagtgtcgggacttactgacttgtgtgagatagaggaactgaagtcaaagaagctcgcgctggctccgtgcaaccaggccggcatgggtgtagtcgggaaagtgggagagatccagtgttctagtgaagagtccgcaagaaccattaagaaggatggctgcatctggaatgccgaccttgttggtattgaactgagggtggatgacgctgtctgttacagcaaaatcacatctgtggaggccgttgcaaactatagcgctatacctactaccattggcgggttgcgctttgagcgatcccatgattcacagggaaagatcagtggcagcccactcgacattacagccatccgggggtctttctccgtgaattaccgtggactgagattatcactgagtgaaataaccgcgacttgcacgggcgaggtaacaaacgtcagcggttgctactcctgtatgaccggggccaaagtgtctatcaagctacactcgagcaaaaattcaactgctcatgtgaggtgcaagggagatgaaaccgcattttccgtcctcgagggcgttcacagttatacagtgtctctgagcttcgaccacgccgtagtggatgaacaatgtcagcttaactgcggtggccatgagtcccaggtcaccttgaaggggaatctgatttttctcgacgtgcccaaattcgttgacggatcatacatgcagacttatcactctagcgtgcctacaggcgctaacatccccagtccaacggattggctgaatgccttatttgggaacggactgtcccgctggattcttggcgtcatcggtgtgttgctcgggggactggcactattctttctgataatgagcctcttcaagctgggcaccaaacaagtttttcggtctagagcgaaacttgcctga

SEQ ID NO: 11493 - RNA, 3222 nt, synthetic construct
  misc_feature 1..3222: note = derived and/or modified CDS sequence (opt3) from SFTSV(ZL13-32)__KU361342.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaaccagcctgagcaacgaatcggacagtgcactggctgtcacctggaatgcatcaatgggggagtgagacttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggatggcactgaatttaccttcgagggtagctgtatgtttccagacgggtgcgatgccgtagactgcacattctgtagggaatttctgaagaacccccaatgctatccggctaaaaagtggcttttcattatcatagttattctgttgggctacgccggactcatgctgttaaccaatgtgctgaaggcaatcggcatctgggggtcctgggtcattgctcctgtgaaactcatctttgccattataaagaaacttatgcggacggtctcatgtctgatgggaaagttgatggatcgtggtcgccaggtgatccatgaggaaattggcgagaacagagaggggaatcaggacgatgttaggatcgaaatggcgcggccccgacgcgtgagacactggatgtatagcccagtaatcctaactattctggccataggactcgcagagtcttgcgacgaaatggtccatgctgattccaaactggtgagttgtaggcagggcagcggtaacatgaaggagtgcgttacaaccgggcgggcccttctgcctgctgtgaatcccggccaagaggcctgtttgcacttcactgcaccaggatctcccgactccaagtgcctcaaaatcaaggtcaaacgcattaacctgaagtgtaaaaagtcaagtagctactttgtgcctgatgccagatcgaggtgcacatccgtacgtcggtgtcgatgggctggcgactgccagtctgggtgcccaccgcatttcaccagcaattcatttagtgacgattgggcgggaaagatggacagagcaggcttaggtttctccgggtgttctgatggatgcggcggtgccgcttgtggctgctttaacgccgcacccagctgtatcttctggaggaaatgggtggaaaatcctcacgggattatctggaaggtttccccatgcgccgcttgggtcccctcagccgtgatagagctgacgatgcctagcggagaagtgcgcaccttccacccaatgagtggcatccccacacaggtctttaaaggggtttctgtgacttatctaggatccgacatggaggtgagcggcctcaccgatctgtgtgaaattgaggagcttaagtcgaaaaagttggcactggcgccgtgcaaccaggctggtatgggggtagtcggaaaagtgggcgaaatccaatgttcatctgaggaaagtgcccggacaattaagaaggacggttgcatctggaacgcagatctcgttggcatagagctgagagtggacgatgccgtctgttactccaaaattactagcgtggaagctgttgccaattattctgcaatccctaccacaattgggggacttaggttcgagcgcagccatgactcccagggcaagatctcagggagtccactggatataaccgctatccgaggcagcttttctgtgaactaccggggattgcgtctctccctgtcagagattactgccacgtgcacaggtgaagtaaccaatgtcagtgggtgctacagctgtatgactggagcgaaagtgtccatcaagttacactcttcgaaaaacagcaccgcccatgtgagatgcaagggcgacgagacagctttctcagtcctggaaggtgttcactcctataccgtgagtctatcttttgatcacgcagtagtggacgagcagtgtcagctcaattgcggcgggcatgaaagccaagtcactctgaagggaaaccttattttcttggacgtgcccaaatttgttgatggctcctacatgcagacatatcactcaacggtgcctaccggggccaatatcccctctccaactgactggctgaacgctctcttcggaaatggcctgagtaggtggatattaggtgtcattggggtgctgcttggaggcttggccctctttttcatgatcatgagcctgtttaagctaggcacaaaacaggttttccgctcccggaccaagctggcatga

SEQ ID NO: 11494 - RNA, 3222 nt, synthetic construct
  misc_feature 1..3222: note = derived and/or modified CDS sequence (opt3) from SFTSV(AHL/China/2011)__JQ670930.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctgatattccacatcttctgggttacagcgagaagatctgtcaaatagacagattgatccacgtttcctcttggttaaggaatcattcgcagtttcagggctatgtggggcagcggggaggccgctcacaagtaagctactatccggcagaaaacagttactcccgatggtctggtctgctaagcccctgcgatgccgactggctcgggatgctggtggtcaaaaaggcgaaaggatccgatatgattgtgcctggcccatcatataagggcaaggttttctttgagcgtcccacattcgacgggtacgtgggatggggttgtggcagtgggaaaagcagaactgaatctggagagctttgctcctcagatagcggcacgagttctggtctgttgccttccgacagggtcctctggatcggggatgtggcttgtcagccaatgacccccattcctgaagagacatttctggagctgaagtctttctcgcagtctgaatttccagacatctgcaaaatagatggaattgtattcaatcagtgtgagggcgaatccctcccgcaaccctttgacgttgcctggatggatgtgggccactcacataagatcattatgcgggagcacaaaactaagtgggtccaggagagtagctccaaggacttcgtgtgctataaagaagggaccggaccttgttctgagagcgaagagaagacatgcaaaacctcaggtagttgccgcggcgacatgcagttttgtaaggtggcagggtgcgaacacggagaggaggcctccgaagctaaatgtagatgcagcttagtccataagccaggcgaggttgtggtatcttacggtgggatgaggatccggcccaaatgttacggcttctcacgcatgatggcaactctggaagtgaaccctccagagcagcgaatcggacaatgcacaggctgtcaccttgaatgcattaatgggggagtcagattgataaccctgacgagtgagctaaagagcgccactgtgtgtgcttcccatttttgcagctcggccaccagcggtaagaaaaacacagagatccagttccactccggctcactcgttgggaagactgcgattcacgtgaaaggagcactggtcgatggcaccgacttcacatttgaaggtagttgtatgttccccgatgggtgcgacgccgtggattgcaccttttgtagggagttccttaagaatccgcagtgctatcctgctaaaaagtggctgtttatcataattgtaatcttgctcggctacgccggactgatgttactgacgaacgttctcaaggcaatcggcgtgtgggggtcttgggtcattgctcccgtgaaacttatgttcgccatcatgaagaaactgatgcggagcgtctcctgtttgatgggaaagctaatggaccgtggtcgccaagtgattcatgaagagataggcgaaaatagagaggggaaccaggatgacgttaggatcgagatggcgcggccacgacgcgtgagacactggatgtattcacctgtaattctgactatcctcgccacaggactggcagaaggctgcgatgagatggtccatgctgacagcaaacttgtgtcttgtaggcagggttccgggaatatgaaggaatgcgttaccactggccgggccctgttgcccgctgtgaacccaggacaggaggcctgtctccactttacagcacccggcagtcctgatagcaagtgcctgaaaatcaaggtcaaacgcattaatttaaagtgtaaaaagtcttcctcatacttcgtgccagacgccagaagtaggtgcaccagcgtacgtcggtgtcgatgggctggggactgccaatcgggatgcccgccccattttacgtccaactctttcagcgatgactgggcgggcaagatggatagagcaggtctggggttttcaggatgtagtgacggctgcggtggcgccgcttgtgggtgcttcaatgccgcaccttcctgtatattttggaggaaatgggtggagaacccacacggaatcatttggaaggtttctccctgcgccgcttgggtccctagcgccgtgatcgaactaaccatgccatccggcgaggtgcgcacattccaccccatgtcagggattccgactcaggtcttcaaaggagttagcgtgacctatctcggcagtgatatggaagtgtctggtctgacagacctttgtgagatcgaagagttgaagtccaaaaagctggcactcgcgccttgcaaccaggctgggatgggagtagtcggcaaagtgggtgagatacagtgtagctcggaagagtcagcccggactatcaagaaggatggctgcatttggaatgcagacctggttgggatcgaacttagagtggatgacgccgtctgttactctaaaattaccagtgtggaggctgttgccaactattccgcaatcccaacaaccataggaggcctgaggtttgaacgcagccatgattctcaagggaagattagcggatcccccttggacatcactgctattcgaggctcattcagtgtgaattaccggggtctccgtctgagcttatctgagatcacggccacatgcaccggggaggtaactaacgtctccggatgctactcatgtatgaccggcgcgaaagtgagtgtgaagctgcacagctccaaaaattctacagcccatgtcagatgcaagggtgatgaaaccgctttttcggttctagagggcgtgcacagctatactgtatcactctccttcgaccacgcagtggtcgacgaacagtgtcagctgaactgcgggggacatgagagtcaggtgacacttaagggcaatttgatatttctggatgttcctaaattcgtggacgggtcttacatgcaaacgtatcacagcaccgtccccactggagccaacatcccatcccctacagattggctcaatgctctgtttggcaacggtttatcaaggtggattctgggggtgatcggagttcttttgggcggcctcgccctgttctttctaattatgtctctgttcaagctcgggaccaaacaggtgtttcgcagccggacaaagctggcatga

SEQ ID NO: 11495 - RNA, 3222 nt, synthetic construct
  misc_feature 1..3222: note = derived and/or modified CDS sequence (opt3) from SFTSV(AH-YTY/China/05/2012)__KR017849.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaaccagcctgagcaacgaatcggacagtgcactggctgtcacctggaatgcatcaatgggggagtgagacttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggatggcactgaatttaccttcgagggtagctgtatgtttccagacgggtgcgatgccgtagactgcacattctgtagggaatttctgaagaacccccaatgctatccggctaaaaagtggcttttcattatcatagttattctgttgggctacgccggactcatgctgttaaccaatgtgctgaaggcaatcggcatctgggggtcctgggtcattgctcctgtgaaactcatctttgccattataaagaaacttatgcgggcggtctcatgtctgatgggaaagttgatggatcgtggtcgccaggtgatccatgaggaaattggcgagaacagagaggggaatcaggacgatgttaggatcgaaatggcccggccccgacgcgtgagacactggatgtatagcccagtaatcctaacgattctggcaataggactcgctgagtcttgcgacgaaatggtccatgccgattccaaactggtgagttgtaggcagggcagcggtaacatgaaggagtgcgttactacagggcgggcccttctgcctgctgtgaatcccggccaagaggcatgtttgcacttcaccgccccaggatctcccgactccaagtgcctcaaaatcaaggtcaaacgcattaacctgaagtgtaaaaagtcaagtagctactttgtgcctgatgctagatcgaggtgcacttccgtacgtcggtgtcgatgggcgggcgactgccagtctgggtgcccaccgcatttcacaagcaattcatttagtgacgattgggcaggaaagatggacagagccggcttaggtttctccgggtgttctgatggatgcggcggtgctgcctgtggctgctttaacgcagcccccagctgtatcttctggaggaaatgggtggaaaatcctcacgggattatctggaaggtttccccatgcgctgcctgggtcccctcagcagtgatagagctgaccatgcctagcggagaagtgcgcacgttccacccaatgagtggcatccccacccaggtctttaaaggggtttctgtgacatatctaggatccgacatggaggtgagcggcctcactgatctgtgtgaaattgaggagcttaagtcgaaaaagttggcgctggctccgtgcaaccaggccggtatgggggtagtcggaaaagtgggcgaaatccaatgttcatctgaggaaagtgcacggaccattaagaaggacggttgcatctggaacgccgatctcgttggcatagagctgagagtggacgatgctgtctgttactccaaaattacaagcgtggaagccgttgcaaattattctgctatccctactaccattgggggacttaggttcgagcgcagccatgactcccagggcaagatctcagggagtccactggatataacagccatccgaggcagcttttctgtgaactaccggggattgcgtctctccctgtcagagattaccgcgacttgcacgggtgaagtaacaaatgtcagtgggtgctacagctgtatgaccggagccaaagtgtccatcaagttacactcttcgaaaaacagcactgctcatgtgagatgcaagggcgacgagaccgcattctcagtcctggaaggtgttcactcctatacagtgagtctatcttttgatcacgccgtagtggacgagcagtgtcagctcaattgcggcgggcatgaaagccaagtcaccctgaagggaaaccttattttcttggacgtgcccaaatttgttgatggctcctacatgcagacttatcactcaacagtgcctacgggggctaatatcccctctccaaccgactggctgaacgccctcttcggaaatggcctgagtaggtggatattaggtgtcattggggtgctgcttggaggcttggcactctttttcatgatcatgagcctgtttaagctaggcactaaacaggttttccgctcccggacaaagctggcgtga

SEQ ID NO: 11496 - RNA, 3222 nt, synthetic construct
  misc_feature 1..3222: note = derived and/or modified CDS sequence (opt3) from SFTSV(AHZ/China/2011)__JQ670931.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggattctcgtggtcaaaaaggcgaaaggatcagatatgatcgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggattggggatgtggcttgtcagccaatgacgcccatccctgaagagaccttcctcgagctgaagtcgttttctcagtccgaatttccagacatatgcaaaattgatggaatcgtatttaatcagtgtgagggcgaatcactgccgcaacccttcgacgttgcctggatggatgtgggccacagtcataagattatcatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaagatcgcagggtgcgaacacggagaggaggccagcgaagctaaatgtagatgctctctcgtgcataagccaggcgaggtcgttgtgtcatacggtgggatgagggtacggcccaaatgttacggctttagtcgcatgatggcaaccttagaagtgaaccagcctgagcaacgaattggacagtgcactggctgtcacctggaatgcataaatgggggagtcagacttatcacattgaccagcgagctgaagtccgccacggtgtgtgcttctcatttctgctcgagcgccacttccggtaagaaatcaaccgagattcagttccacagtggctctctagttgggaagacagcgatccacgtgaaaggagcactcgtcgatggcactgaatttaccttcgagggtagctgtatgtttccagacgggtgcgatgccgtggactgcacattctgtagggaatttctgaagaacccccaatgctatccggctaaaaagtggcttttcataattatcgtaatcctgttgggctacgccggactcatgctgttaaccaatgttctgaaggcaattggcatctgggggtcctgggtgattgctcctgtcaaactcatatttgccatcattaagaaacttatgcggacggtgtcatgtctgatgggaaagttgatggatcgtggtcgccaggtcatccatgaggaaatcggcgagaacagagaggggaatcaggacgatgtgaggattgaaatggcgcggccccgacgcgttagacactggatgtatagcccagtgatactaactatcctggccattggactcgcagagtcttgcgacgaaatggtacatgctgattccaaactggtcagttgtaggcagggcagcggtaacatgaaggagtgcgtgacaaccgggcgggcccttctgcctgctgttaatcccggccaagaggcctgtttgcacttcactgcaccaggatctcccgactccaagtgcctcaaaatcaaggtgaaatggattaacctgaagtgtaaaaagtcaagtagctactttgtccctgatgcccgctcgagatgcacatccgtgaggcgttgtcggtgggctggcgactgccagtctgggtgcccaccgcatttcaccagcaattcatttagtgacgattgggcgggaaagatggaccgagcaggcttaggtttctccgggtgttctgatggatgcggcggtgccgcttgtggctgctttaacgccgcacccagctgtatcttctggagaaaatgggtagaaaatcctcacgggataatctggaaggtgtccccatgcgccgcttgggttccctcagccgtcattgagctgagcatgcctagtggagaagtgaggacgttccacccaatgtctggcatccccacccaggtgtttaaaggggtctccgttacatatctaggaagcgacatggaggtgtcgggcctcactggtctgtgtgaaattgaggagcttaagtctaaaaagttggcactggcgccgtgcaaccaggctgggatgggagtggtaggcaaagtcggtgaaatccaatgttcaagtgaggaatccgcccgcaccataaagaaggatggctgcatttggaacgcagacctcgtggggatcgagctgcgggttgatgacgccgtgtgttacagcaaaattacatctgtcgaaagcgtggctaattattccgccatccctactaccataggaggccttagattcgagaggtcacatgatagtcaggggaagatcagcggatctccactggacattacagcaatccgcggctccttttcagttaactaccgaggtttgcggctcagtctgagcgagattaccgctacttgcacgggggaagtgacaaatgtatccggatgctactcttgtatgaccggcgccaaagtctcgatcaagttacacagctccaaaaactcaactgcgcatgtgcgttgcaagggtgatgagaccgccttcagtgtgctggaaggcgtccactcttatacagttagcctatcctttgaccacgctgtggtagatgagcagtgtcagctcaattgcgggggacatgaatcacaagtgaccctgaagggcaaccttatattcttggacgtccccaaatttgtggacgggtcttacatgcagacttatcacagcacagttcctacgggagcaaatattcccagtccaaccgattggctgaacgccctcttcggcaatggtctgtccagatggatcttagggctgatcggagtgcttttgggcggcctcgctctgtttttcatgattatgagcctatttaagctggggactaaacaggtcttcaggtctcgcacaaagctcgcctga

SEQ ID NO: 11497 - RNA, 3222 nt, synthetic construct
  misc_feature 1..3222: note = derived and/or modified CDS sequence (opt3) from SFTSV(DS02/CHN/2013)__KR698332.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctactatccggcagaaaatagttactcccgatggtctggtctgctaagcccctgcgacgccgattggctcgggatgctggtggtcaaaaaggcgaaaggatccgacatgattgtgcctggcccatcatataagggcaaggttttctttgagcgtcccacattcgatgggtacgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacatttctggagctcaagagcttctcgcagtctgaatttccagatatctgcaaaatagacggaattgtattcaaccagtgtgagtccgaatcactgccgcaaccctttgatgttgcctggatggacgtgggccacagtcataagatcattatgcgggagcacaaaactaagtgggtccaggagagctcctctaaggatttcgtgtgctataaagaaggcaccgggccttgtagcgagtcagaagagaagacatgcaaaaccagtggatcctgccgcggtgacatgcagttttgtaaggtggcaggctgcgaacacggggaggaggccagcgaagctaaatgtagatgctctttagtccataagccaggagaggttgtggtatcatacggcggtatgagggtgcggcccaaatgttacgggttcagtcgcatgatggcaactctggaagtcaatcctccagagcagcgaatcggccaatgcacaggatgtcaccttgaatgcatcaacggcggggtgagattggttaccctgacgagcgagctaaagtccgccactgtgtgtgcttctcatttttgctcgagcgccacctccggaaagaaatcaacagagattcagttccacagtggttctctcgtcggcaaggcggcaatacacgtgaaaggggccctggtagacggaactgagttcacctttgaaggcagctgtatgttccccgatggttgcgacgctgttgattgcacattttgtagggagttccttaagaatctgcagtgctatccggccaaaaagtggttgtttatcattatcgtgatactcctggggtacgcaggcttaatgctgctcaccaacgtccttaaggctattggagtgtggggctcctgggtcatcgcccctgtgaaactgatgttcgcgatcattaagaaattgatgcggtcagttagctgtctaatggggaagctgatggaccgtggacgccaagtgatccatgaagaaattggtgagaatagagagggcaaccaggatgacgtaaggatagaaatggtccggccccgacgcgtgagacactggatgtattctccagttatcctcacgattctggccatcgggcttactgagggatgcgatgaaatggtgcatgcagactccaaactggtcagttgtaggcagggcagcggtaatatgaaggagtgcgtgacaaccgggcgggctttgctccctgccgtaaaccccggccaggaggcttgtctgcactttactgccccaggatctcccgattccaagtgcttaaaaatcaaggtgaaacgcattaatctgaagtgtaaaaagtcaagtagctacttcgttcctgacgcaagatcgaggtgcacatccgtccgtcggtgtcgatgggccggcgattgccaatctgggtgcccaagccattttacctcaaacagtttctccgacgactgggctggaaagatggatagagcgggcctaggtttttctgggtgtagcgacggatgcggcggtgcagcctgtggctgcttcaatgctgccccgtcctgtatattttggaggaaatgggtggaaaacccccacgggatcatttggaaggtgtcaccttgcgcagcctgggtcccaagcgctgttatcgagctcacgatgcccagtggagaagtgcgcaccttccaccctatgtctggcattccaacacaggtgttcaaaggggtatccgtcacttatctgggaagcgatatggaggtgtcgggccttaccgacttgtgtgaaatcgaggagctgaagtcaaagaagctcgccctggcaccctgcaaccaggcgggtatgggggttgtgggaaaagtcggcgaaatacagtgttctagtgaggaatccgctcggacaatcaagaaggatggttgcatttggaatgccgaccttgtgggcatcgagctgagagttgatgacgcagtgtgttacagcaaaattacttctgtagaagccgtcgctaactatagcgccatcccgaccacaatagggggattgaggtttgagcgctcccatgattcacaaggcaagattagtgggagccctctcgacatcaccgcaattcgaggatctttctccgtgaattaccggggcctgcgtttatcactgagtgagatcactgctacgtgcacaggtgaagtgaccaacgtcagcgggtgctactcctgtatgactggagccaaagtttctataaagctacactcgagcaaaaattcaaccgcgcatgtgagatgcaagggcgatgagacagccttttccgtactcgaaggtgtgcacagttataccgtctctctgagcttcgaccacgctgtggttgatgagcagtgtcagcttaactgcggcgggcatgaatcccaggtgactttgaagggaaatctgatctttctcgacgtcccaaaattcgtggacggctcatacatgcaaacatatcactctagcgttcccacgggggcaaacattcctagtcccaccgattggctgaatgccttatttggaaacggcctgtccaggtggatccttggtgtgattggggtcttgctcggaggcctggctctattctttctgatcatgagcctcttcaagctgggcactaaacaggtatttcgctctcggacaaaacttgcctga

SEQ ID NO: 11498 - RNA, 3222 nt, synthetic construct
  misc_feature 1..3222: note = derived and/or modified CDS sequence (opt3) from SFTSV(DS03/CHN/2013)__KR698333.1__GP
  source 1..3222: mol_type = other RNA
atgatgaaggtgatctggttcagctccctgatttacctcgtcatacagtgctctggcgactcagggcccatcatttgtgccggacctatccacagtaacaaaagcgctaatattccacatcttctgggttattccgagaagatctgccaaatagatagattgatccacgtttcttcgtggttaaggaaccattcacagtttcagggctacgtggggcagcggggaggccgcagccaagtaagttattacccggcagaaaattcctattctcgatggagcggtctgctatccccctgtgacgccgattggctcgggatgctggtggtcaaaaaggcgaaaggatcagacatgattgtgcctggcccaagttacaagggcaaggttttctttgagcgtcccaccttcgatgggtatgtgggatggggttgcggcagcgggaaatctagaacagaatccggagagctttgttcaagcgacagtggcacttcttccggtctgttgcctagcgatagggtcctctggatcggggacgtggcttgccagccaatgacgcccattcctgaagagacctttctggagctgaagtcgttctctcagtccgaatttccagatatctgtaaaatagacggaattgtattcaaccagtgcgagcgggaatcactcccgcaaccctttgatgttgcctggatggacgtgggccacagtcataagatcattatgcgcgagcacaaaacaaagtgggtccaggagagctcctctaaggatttcgtgtgttacaaagaaggcactgggccttgcagcgagtcagaagagaagacctgtaaaacaagtggatcctgcagaggtgacatgcagttttgcaaggtggcaggctgtgaacacggggaggaggccagcgaagctaaatgtaggtgctctttagtccataagccaggagaggttgtggtatcatacggcggtatgcgggtgcgccccaaatgctatgggttcagtcgaatgatggcaaccctggaagtcaatcctccagagcagagaatcggccaatgtactggatgccaccttgaatgtatcaacggcggggtgaggttgattacactgaccagcgagctaaagtccgccacggtttgcgcttctcatttttgttcgagcgccacttccggaaagaaatcaaccgagatacagttccacagtggttctctcgtgggccggacagcgatccacgtcaagggggcactggtggacggaactgagttcacctttgaaggcagctgcatgttccccgatggttgtgacgccgtagattgcacattttgccgtgagttccttaaaaatccgcagtgttaccctgctaagaaatggctgtttattatcatagttattttgctcgggtatgccggcctgatgttactgaccaacgtgctcaaggcaatcggagtctggggctcctgggtgatcgctcccgtcaaacttatgttcgccattatcaaaaagctgatgcgctcagtgagctgcttgatggggaaactaatggacagaggaaggcaagttattcatgaagaaataggtgagaatcgggagggcaaccaggatgacatccgaattgaaatggcgcgcccaagaagggtgcggcactggatgtactctcctgtaatcctgacgatcctcgccgtcgggctggcagagggatgtgatgaaatggtgcatgctgactccaaacttgttagttgcaagcagggcagcggtaatatgaaggagtgtgtgactacagggcgcgccctgttgcccgctgtcaacccaggccaggaggcctgcctccactttaccgcacccggatctcctgattccaagtgtctgaaaattaaggtgaaaagaataaatttaaagtgcaaaaagtcaagtagctatttcgtaccagacgccaggtcgcgttgtacttccgtgcggcgatgcagatgggctggcgattgtcaatctgggtgcccgagccattttacatcaaacagtttctccgacgactgggcgggaaagatggatagggcaggcctgggtttttctgggtgcagcgacggatgtggcggtgccgcttgcggctgtttcaatgccgcaccctcctgcatcttttggcgcaaatgggttgaaaaccctcacgggattatctggaaggtctcaccatgtgccgcttgggtgcccagcgccgtgattgagctaaccatgcctagtggagaagtccggacgttccacccaatgtctggcatccccacccaggttttcaaaggggtgtccgtgacatacctcggaagcgatatggaggtatcgggcctgactgacctttgcgaaatagaggagttgaagtcaaagaagctggcactcgcgccgtgtaaccaggctggtatgggggtcgtgggaaaagttggcgaaatccagtgctctagtgaggaatccgccagaaccattaagaaggatggttgtatctggaatgcagacctggtgggcattgagcttagggtcgatgacgccgtgtgctatagcaaaatcacatctgttgaagctgtggccaactacagcgcaatacctactaccattgggggactgcgctttgagcgatcccatgattcacaaggcaagatcagtgggagcccattggacattacagctatccggggatctttctccgtaaattaccgtggcctcagactgtcattaagtgagataaccgccacttgtacgggtgaagtcacaaacgtgagcgggtgctattcctgcatgaccggagcgaaagtgtctatcaagctgcactcgagcaaaaattcaactgcccatgtcaggtgtaagggcgatgagaccgctttttccgttctagaaggtgtgcacagttacacagtatctctcagcttcgaccacgcagtggtcgatgagcagtgccagctgaactgtggcgggcatgaatcccaggtgacccttaagggaaatttgatttttctggacgttcccaaattcgtggacggctcatatatgcaaacttaccactctagcgtccctacaggggccaacatccccagtccaacggattggctcaatgctctgtttggaaacggcttatcccgctggattctgggtgtgatcggggttcttttgggaggcctcgccctgttctttctaataatgagcctgttcaagctcggcaccaaacaggtgtttcggtctagaactaagctggcatga

SEQ ID NO: 11499 - RNA, 3222 nt, synthetic construct
  misc_feature 1..3222: note = derived and/or modified CDS sequence (opt3) from SFTSV(DS04/CHN/2013)__KR698334.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctactatccggcagaaaatagttactcccgatggtctggtctgctaagcccctgcgacgccgattggctcgggatgctggtggtcaaaaaggcgaaaggatccgacatgattgtgcctggcccatcatataagggcaaggttttctttgagcgtcccacattcgatgggtacgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacatttctggagctcaagagcttctcgcagtctgaatttccagatatctgcaaaatagacggaattgtattcaaccagtgtgagtccgaatcactgccgcaaccctttgatgttgcctggatggacgtgggccacagtcataagatcattatgcgggagcacaaaactaagtgggtccaggagagctcctctaaggatttcgtgtgctataaagaaggcaccgggccttgtagcgagtcagaagagaagacatgcaaaaccagtggatcctgccgcggtgacatgcagttttgtaaggtggcaggctgcgaacacggggaggaggccagcgaagctaaatgtagatgctctttagtccataagccaggagaggttgtggtatcatacggcggtatgagggtgcggcccaaatgttacgggttcagtcgcatgatggcaactctggaagtcaatcctccagagcagcgaatcggccaatgcacaggatgtcaccttgaatgcatcaacggcggggtgagattgattaccctgacgagcgagctaaagtccgccactgtttgtgcttctcatttttgctcgagcgccacctccggaaagaaatcaacagagatacagttccacagtggttctctcgtgggcaaggcggcaatccacgtcaaaggggccctggtggacggaactgagttcacctttgaaggcagctgtatgttccccgatggttgcgacgctgtagattgcacattttgtagggagttccttaagaatccgcagtgctatcctgccaaaaagtggctgtttattatcatagttattttgctcgggtacgcaggcctgatgttactgaccaacgtgctcaaggctatcggagtctggggctcctgggtgatcgcccccgtcaaacttatgttcgcgattatcaagaaactgatgcggtcagtgagctgtttgatggggaagctaatggaccgtggacgccaagttattcatgaagaaataggtgagaatagagagggcaaccaggatgacgtgaggatcgaaatggtacggccacgacgcgtcagacactggatgtattctcctgtgattctgacgatcctcgccatcgggctgactgagggatgcgatgaaatggttcatgcagactccaaacttgtgagttgtaggcagggcagcggtaatatgaaggagtgcgtcacaaccgggcgggctctgttgcccgccgtgaacccaggccaggaggcttgtctccactttactgcccccggatctcctgattccaagtgcctgaaaattaaggtaaaacgcataaatttaaagtgtaaaaagtcaagtagctacttcgtgccagacgcaagatcgaggtgcacatccgttcgtcggtgtcgatgggccggcgattgccaatctgggtgcccgagccattttacctcaaacagtttctccgacgactgggctggaaagatggatagagcgggcctgggtttttctgggtgtagcgacggatgcggcggtgcagcctgtggctgcttcaatgctgccccctcctgtatcttttggaggaaatgggtcgaaaaccctcacgggattatctggaaggtgtcaccatgcgcagcctgggtgcccagcgctgtcattgagctaacgatgcctagtggagaagttcgcaccttccggccaatgtctggcatccccacacaggtgttcaaaggggtgtccgtaacttatctcggaagcgatatggaggtctcgggcctgaccgacctttgtgaaatagaggagttgaagtctaaaaagctggccctcgcaccgtgcaaccaggcgggtatgggggtggttggaaaagtgggcgaaatccagtgttcaagtgaggaatccgctagaacaattaagaaggatggttgcatctggaatgccgacctggtcggcattgagcttagggtggatgacgcagtttgttacagcaaaatcacttctgtggaagccgtagtcaactatagcgctatacctaccacaattgggggactgcgctttgagcgatcccacgattcacaaggcaagatcagtgggagcccattggacattaccgccatccggggatctttctccgtgaattaccgtggcctcagactgtcattaagtgagataactgcaacgtgcacaggtgaagtgaccaacgtcagcgggtgctactcctgtatgactggagctaaagtttctatcaagctgcattcgagcaaaaattcaaccgcccacgtgaggtgcaagggcgatgagacagcgttttccgtactagaaggtgtgcatagttataccgtctctctcagcttcgaccacgccgtggttgatgagcagtgtcagctgaactgcggcgggcacgaatcccaggtgactcttaagggaaatttgatttttctggacgtccccaaattcgtggacggctcatacatgcaaacatatcattctagcgttcctacgggggctaacatccccagtccaaccgattggctcaatgcactgtttggaaacggcttatcccgctggattctgggtgtgatcggggtccttttgggaggcctcgccctgttctttctaataatgagcctgttcaagctcggcactaaacaggtatttcggtctagaacaaagctggcttga

SEQ ID NO: 11500 - RNA, 3222 nt, synthetic construct
  misc_feature 1..3222: note = derived and/or modified CDS sequence (opt3) from SFTSV(DS05/CHN/2013)__KR698335.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctactatccggcagaaaatagttactcccgatggtctggtctgctaagcccctgcgacgccgattggctcgggatgctggtggtcaaaaaggcgaaaggatccgacatgattgtgcctggcccatcatataagggcaaggttttctttgagcgtcccacattcgatgggtacgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacatttctggagctcaagagcttctcgcagtctgaatttccagatatctgcaaaatagacggaattgtattcaaccagtgtgagtccgaatcactgccgcaaccctttgatgttgcctggatggacgtgggccacagtcataagatcattatgcgggagcacaaaactaagtgggtccaggagagctcctctaaggatttcgtgtgctataaagaaggcaccgggccttgtagcgagtcagaagagaagacatgcaaaaccagtggatcctgccgcggtgacatgcagttttgtaaggtggcaggctgcgaacacggggaggaggccagcgaagctaaatgtagatgctctttagtccataagccaggagaggttgtggtatcatacggcggtatgagggtgcggcccaaatgtcacgggttcagtcgcatgatggcaactctggaagtcaatcctccagagcagcgaatcggccaatgcacaggatgtcatcttgaatgcatcaacggcggggtgagattgattaccctgacgagcgagctaaagtccgccactgtttgtgcttctcacttttgctcgagcgccacctccggaaagaaatcaacagagatacagttccacagtggttctctcgtgggcaaggcggcaatccatgtcaaaggggccctggtggacggaactgagttcacctttgaaggcagctgtatgttccccgatggttgcgacgctgtagattgcacattttgtagggagttccttaagaatccgcagtgctaccctgccaaaaagtggctgtttattatcatagttattttgctcgggtatgcaggcctgatgttactgaccaacgtgctcaaggctatcggagtctggggctcctgggtgatcgcccccgtcaaacttatgttcgcgattatcaagaaactgatgcggtcagtgagctgtttgatggggaagctaatggaccgtggacgccaagttattcacgaagaaataggtgagaatagagagggcaaccaggatgacgtgaggatcgaaatggtacggccacgacgcgtcagacattggatgtactctcctgtgattctgacgatcctcgccatcgggctgactgagggatgcgatgaaatggttcacgcagactccaaacttgtgagttgtaggcagggcagcggtaatatgaaggagtgcgtcacaaccgggcgggctctgttgcccgccgtgaacccaggccaggaggcttgtctccattttactgcccccggatctcctgattccaagtgcctgaaaattaaggtaaaacgcataaatttaaagtgtaaaaagtcaagtagctatttcgtgccagacgcaagatcgaggtgcacatccgttcgtcggtgtcgatgggccggcgattgccaatctgggtgcccgagccactttacctcaaacagtttctccgacgactgggctggaaagatggatagagcgggcctgggtttttctgggtgtagcgacggatgcggcggtgcagcctgtggctgcttcaatgctgccccctcctgtatcttttggaggaaatgggtcgaaaaccctcacgggattatctggaaggtgtcaccatgcgcagcctgggtgcccagcgctgtcattgagctaacgatgcctagtggagaagttcgcaccttccatccaatgtctggcatccccacacaggtgttcaaaggggtgtccgtaacttacctcggaagcgatatggaggtctcgggcctgaccgacctttgtgaaatagaggagttgaagtctaaaaagctggccctcgcaccgtgcaaccaggcgggtatgggggtggttggaaaagtgggcgaaatccagtgttcaagtgaggaatccgctcggacaattaagaaggatggttgcatctggaatgccgacctggtcggcattgagcttagagtggatgacgcagtttgttatagcaaaatcacttctgtggaagccgtagctaactacagcgccatacctaccacaattgggggactgaggtttgagcgctcccacgattcacaaggcaagatcagtgggagcccattggacattaccgcaatccgaggatctttctccgtcaattatcggggcctccgtctgtcattaagtgagataactgctacgtgcacaggtgaagtgaccaacgtgagcgggtgctactcctgtatgactggagccaaagtctctatcaagctgcattcgagcaaaaattcaaccgcgcacgttagatgcaagggcgatgagacagccttttccgtgctagaaggtgtacacagttacaccgtgtctctcagcttcgaccatgctgtcgtggatgagcagtgtcagctgaactgcggcgggcacgaatcccaggttactcttaagggaaatttgatttttctggacgtgcccaaattcgtcgacggctcatatatgcaaacataccattctagcgtgcctacgggggcaaacatccccagtccaaccgattggctcaatgccctgtttggaaacggcttatccaggtggattctgggtgttatcggggtgcttttgggaggcctcgctctgttctttctaataatgagcctgttcaagctcggcactaaacaggtctttcgctctcggacaaagctggcctga

SEQ ID NO: 11501 - RNA, 3222 nt, synthetic construct
  misc_feature 1..3222: note = derived and/or modified CDS sequence (opt3) from SFTSV(HB154/China/2011)__JQ733560.1__GP
  source 1..3222: mol_type = other RNA
atgatgaaggtgatctggttcagctccctgatttgcctcgtcatacagtgttctggcgactcagggcccatcatttgcgccggacctatccacagtaacaaaagcgctggtattccacatcttctgggctactccgagaagatctgtcaaatagatagattgatccacgtttcttcgtggttaaggaatcattcacagtttcaggggtatgtgggacagcggggcggtcgcagccaagtaagttactatccggcagaaaactcctactctcgatggagcgggctgctatccccctgcgacgccgattggctcggaatgctggtggtcaaaaaggcgaaagagtcagacatgattgtgcctggcccaagttataagggcaaggttttctttgaacgtcccaccttcgatgggtacgtgggatggggttgtggcagcgggaaatctagaacagagtccggagaactttgctcaagcgacagtggcacttcttccggtctgttgcctagcgatagggtcctctggatcggggacgtggcttgtcagccaatgacgcccattcctgaggagacctttctggaactgaagtcgttctctcagtccgagtttccagatatctgcaaaatagacggaattgtattcaatcagtgtgaaggcgagtcactcccgcaaccctttgatgttgcctggatggacgtgggccacagtcataagatcattatgcgggagcacaaaacaaagtgggtccaggaaagctcctctaaggatttcgtgtgctataaagaggggactggaccttgtagcgaatcagaggaaaaggcatgcaaaaccagtggttcctgccgcggcgacatgcagttttgtaaggtggccgggtgcgagcacggagaggaagctagcgaggcaaaatgtagatgctctttagtccataagccaggcgaagttgtggtatcatacggtgggatgagggtgcggcccaaatgttacggcttcagtcgcatgatggccacactggaggtcaaccctccagaacagcgaatcggacaatgcaccggctgtcaccttgagtgcatcaatgggggagtgagattgattactctgacaagcgagctaaggtccgctaccgtttgtgcctctcatttttgctcgagcgcgacgtccggtaagaagtcaactgaaatacacttccacagtggctctctcgtggggaaaaccgcaatccatgtcaagggagccctggtggacggcacagagttcacttttgaaggtagctgtatgttccccgatgggtgcgacgctgtagattgcaccttttgtcgggagttccttaaaaacccgcagtgctatcctgccaagaaatggctgtttattatcatagttattttgctcggctacgcaggactgatgttactgacaaatgtgctcaaggctatcggcgtctgggggtcctgggtgatcgcccccgtcaaacttatgttcgcgattatcaagaagctgatgcgtaccgtgtcatgtttggttggaaaactaatggaccgcggtagacaggtgattaacgaagagataggcgagaatggggaaggaaaccaagatgacgtaaggatcgagatggcccggccacgacgcgtcagacactggatgtatagccctgtgattctgacgatcctcgcaatcggcctggctgaaggttgcgatgagatggttcatgccgactctaaacttgtgtcctgtaggcaggggagtggcaatatgaaggagtgcattactacaggacgggctctgttgcccgccgtcaacccaggccaggaagcatgtctccactttaccgcccccgggagccctgattctaagtgcctgaagataaaagtgaagcgcatcaatttaaaatgtaagaaatcctcaagttacttcgtaccagacgctagatcgaggtgcacttcggtgcgtcggtgtcgatgggcgggagattgccagtccggctgcccgccccattttacatctaacagcttctcagacgactgggcaggtaagatggatagagccgggctgggatttagtggctgttccgacggttgcggcggggctgcctgtggatgcttcaatgcagccccttcttgtatcttttggaggaagtgggttgagaacccacacggcattatttggaaagtcagcccctgcgctgcctgggtgccttccgcagtgatcgaactaaccatgccatcaggggaggtccgcacgttccaccccatgagcggaataccgacccaagttttcaagggcgtgagtgtgacatatctcggttctgatatggaagtatccgggctgactgacctttgtgagatcgaggaattgaaaagcaagaaactggcgctcgctccttgcaaccaggccggaatgggcgtcgtgggtaaggttggcgagattcagtgttcgtcagaagagtctgcacggaccatcaaaaaggatgggtgcatttggaatgccgacctggtgggaatcgaacttagagtcgatgacgctgtgtgttacagtaagataacatccgttgaggccgtggcaaactatagcgctattccaactaccatcggcgggctgaggtttgagcgctctcatgatagccagggaaaaatttccggctcacccttggacatcacagccatacgaggtagtttcagcgtaaattaccgggggctccgtctgtctttatccgaaatcaccgcgacttgcacgggagaggtcacaaacgtgtcaggctgctacagttgtatgaccggtgccaaggtgagcattaaactgcactcctctaagaatagcactgctcatgtcagatgcaaaggcgatgaaaccgcatttagcgttctagagggggtgcactcatatatcgtatccctcagtttcgaccacgccgtggtcgatgaacaatgtcagctgaactgcggaggccatgagtctcaggtgacacttaaggggaatttgatttttctggacgttcctaagttcgtggacggaagctacatgcagacctatcactccactgtccccacaggcgctaacatcccatcacctacggattggctcaatgccctgtttggtaacgggttatctaggtggatactgggagtgattggcgttcttttgggcgggctcgcactgttcagcctaatcatgtttctgctcaaactgggaaccaagcaagtgttccgcagtcggactaaacttgcgtga

SEQ ID NO: 11502 - RNA, 3222 nt, synthetic construct
  misc_feature 1..3222: note = derived and/or modified CDS sequence (opt3) from SFTSV(HB155/China/2011)__JQ733563.1__GP
  source 1..3222: mol_type = other RNA
atgatgaaggtgatctggttcagctccctgatttgcctcgtcatacagtgttctggcgactcagggcccatcatttgcgccggacctatccacagtaacaagagcgctggtattccacatcttctgggctactccgagaagatctgtcaaatagatagattgatccacgtttcttcgtggttaaggaatcattcacagtttcaggggtatgtgggacagcggggcggtcgcagccaagtaagttactatccggcagaaaactcctactctcgatggagcgggctgctatccccctgcgacgccgattggctcggaatgctggtggtcaaaaaggcgaaagagtcagacatgattgtgcctggcccaagttataagggcaaggttttctttgaacgtcccaccttcgatgggtacgtgggatggggttgtggcagcgggaaatctagaacagagtccggagaactttgctcaagcgacagtggcacttcttccggtctgttgcctagcgatagggtcctctggatcggggacgtggcttgtcagccaatgacgcccattcctgaggagacctttctggaactgaagtcgttctctcagtccgagtttccagatatctgcaaaatagacggaattgtattcaatcagtgtgaaggcgagtcactcccgcaaccctttgatgttgcctggatggacgtgggccacagtcataagatcattatgcgggagcacaaaacaaagtgggtccaggaaagctcctctaaggatttcgtgtgctataaagaggggactggaccttgtagcgaatcagaggaaaaggcatgcaaaaccagtggttcctgccgcggcgacatgcagttttgtaaggtggccgggtgcgagcacggagaggaagctagcgaggcaaaatgtagatgctctttagtccataagccaggcgaagttgtggtatcatacggtgggatgagggtgcggcccaaatgttacggcttcagtcgcatgatggccacactggaggtcaaccctccagaacagcgaatcggacaatgcaccggctgtcaccttgagtgcatcaatgggggagtgagattgattactctgacaagcgagctaaggtccgctaccgtttgtgcctctcatttttgctcgagcgcgacgtccggtaagaagtcaactgaaatacacttccacagtggctctctcgtggggaaaaccgcaatccatgtcaagggagccctggtggacggcacagagttcacttttgaaggtagctgtatgttccccgatgggtgcgacgctgtagattgcaccttttgtcgggagttccttaaaaacccgcagtgctatcctgccaagaaatggctgtttattatcatagttattttgctcggctacgcaggactgatgttactgacaaatgtgctcaaggctatcggcgtctgggggtcctgggtgatcgcccccgtcaaacttatgttcgcgattatcaagaagctgatgcgtaccgtgtcatgtttggttggaaaactaatggaccgcggtagacaggtgattcacgaagagataggcgagaacggggaaggaaatcaagatgacgtaaggatcgagatggcccggccacgacgcgtcagacattggatgtatagccctgtgattctgacgatcctcgcaatcggcctggctgaaggttgcgatgagatggttcacgccgactctaaacttgtgtcctgtaggcaggggagtggcaacatgaaggagtgcattactacaggacgggctctgttgcccgccgtcaatccaggccaggaagcatgtctccattttaccgcccccgggagccctgattctaagtgcctgaagataaaagtgaagcgcatcaacttaaaatgtaagaaatcctcaagttacttcgtaccagacgctagatcgaggtgcactagcgtgcgtcggtgtcgatgggcgggagattgccagtccggctgcccgccccactttacatctaatagcttctcagacgactgggcaggtaagatggatagagccgggctgggatttagtggctgttccgacggttgcggcggggctgcctgtggatgcttcaacgcagccccttcttgtatcttttggaggaagtgggttgagaatccacacggcattatttggaaagtcagcccctgcgctgcctgggtgccttccgcagtgatcgaactaaccatgccatcaggggaggtccgcacgttccatcccatgagcggaataccgacccaagttttcaagggcgtgagtgtgacatatctcggttctgatatggaagtatccgggctgactgacctttgtgagatcgaggaattgaaaagcaagaaactggcgctcgctccttgcaaccaggccggaatgggcgtcgtgggtaaggttggcgagattcagtgttcgtcagaagagtctgcacggaccatcaaaaaggatgggtgcatttggaacgccgacctggtgggaatcgaacttagagtcgatgacgctgtgtgttacagtaagataacatccgttgaggccgtggcaaattatagcgctattccaactaccatcggcgggctgaggtttgagcgctctcacgatagccagggaaaaatttccggctcacccttggacatcacagccatacgaggtagtttcagcgtaaactaccgggggctccgtctgtctttatccgaaatcaccgcgacttgcacgggagaggtcacaaatgtgtcaggctgctacagttgtatgaccggtgccaaggtgagcattaaactgcattcctctaagaactcgactgctcacgtcagatgcaaaggcgatgaaaccgcatttagcgttctagagggggtgcactcatatatcgtatccctcagtttcgaccatgccgtggtcgatgaacaatgtcagctgaattgcggaggccacgagtctcaggtgacacttaaggggaacttgatttttctggacgttcctaggttcgtggacggaagctacatgcagacctatcattccactgtccccacaggcgctaatatcccatcacctacggattggctcaacgccctgtttggtaatgggttatctcgctggatactgggagtgattggcgttcttttgggcgggctcgcactgttctttctaatcatgttcctgctcaagctgggaaccaaacaagtgtttcggagcagaactaaacttgcgtga

SEQ ID NO: 11503 - RNA, 3222 nt, synthetic construct
  misc_feature 1..3222: note = derived and/or modified CDS sequence (opt3) from SFTSV(HB156/China/2011)__JQ733566.1__GP
  source 1..3222: mol_type = other RNA
atgatgaaggtgatctggttcagctccctgatttgcctcgtcatacagtgttctggcgactcagggcccatcatttgcgccggacctatccacagtaacaaaagcgctggtattccacatcttctgggctactccgagaagatctgtcaaatagatagattgatccacgtttcttcgtggttaaggaatcattcacagtttcaggggtatgtgggacagcggggcggtcgcagccaagtaagttactatccggcagaaaactcctactctcgatggagcgggctgctatccccctgcgacgccgattggctcggaatgctggtggtcaaaaaggcgaaagagtcagacatgattgtgcctggcccaagttataagggcaaggttttctttgaacgtcccaccttcgatgggtacgtgggatggggttgtggcagcgggaaatctagaacagagtccggagaactttgctcaagcgacagtggcacttcttccggtctgttgcctagcgatagggtcctctggatcggggacgtggcttgtcagccaatgacgcccattcctgaggagacctttctggaactgaagtcgttctctcagtccgagtttccagatatctgcaaaatagacggaattgtattcaatcagtgtgaaggcgagtcactcccgcaaccctttgatgttgcctggatggacgtgggccacagtcataagatcattatgcgggagcacaaaacaaagtgggtccaggaaagctcctctaaggatttcgtgtgctataaagaggggactggaccttgtagcgaatcagaggaaaaggcatgcaaaaccagtggttcctgccgcggcgacatgcagttttgtaaggtggccgggtgcgagcacggagaggaagctagcgaggcaaaatgtagatgctctttagtccataagccaggcgaagttgtggtatcatacggtgggatgagggtgcggcccaaatgttacggcttcagtcgcatgatggccacactggaggtcaaccctccagaacagcgaatcggacaatgcaccggctgtcaccttgagtgcatcaatgggggagtgagattgattactctgacaagcgagctaaggtccgctaccgtttgtgcctctcatttttgctcgagcgcgacgtccggtaagaagtcaactgaaatacacttccacagtggctctctcgtggggaaaaccgcaatccatgtcaagggagccctggtggacggcacagagttcacttttgaaggtagctgtatgttccccgatgggtgcgacgctgtagattgcaccttttgtcgggagttccttaaaaacccgcagtgctatcctgccaagaaatggctgtttattatcatagttattttgctcggctacgcaggactgatgttactgacaaatgtgctcaaggctatcggcgtctgggggtcctgggtgatcgcccccgtcaaacttatgttcgcgattatcaagaagctgatgcgtaccgtgtcatgtttggttggaaaactaatggaccgcggtagacaggtgattcacgaagagataggcgagaacggggaaggaaatcaagatgacgtaaggatcgagatggcccggccacgacgcgtcagacattggatgtatagccctgtgattctgacgatcctcgcaatcggcctggctgaaggttgcgatgagatggttcacgccgactctaaacttgtgtcctgtaggcaggggagtggcaacatgaaggagtgcattactacaggacgggctctgttgcccgccgtcaatccaggccaggaagcatgtctccattttaccgcccccgggagccctgattctaagtgcctgaagataaaagtgaagcgcatcaacttaaaatgtaagaaatcctcaagttacttcgtaccagacgctagatcgaggtgcactagcgtgcgtcggtgtcgatgggcgggagattgccagtccggctgcccgccccactttacatctaatagcttctcagacgactgggcaggtaagatggatagagccgggctgggatttagtggctgttccgacggttgcggcggggctgcctgtggatgcttcaacgcagccccttcttgtatcttttggaggaagtgggttgagaatccacacggcattatttggaaagtcagcccctgcgctgcctgggtgccttccgcagtgatcgaactaaccatgccatcaggggaggtccgcacgttccatcccatgagcggaataccgacccaagttttcaagggcgtgagtgtgacatatctcggttctgatatggaagtatccgggctgactgacctttgtgagatcgaggaattgaaaagcaagaaactggcgctcgctccttgcaaccaggccggaatgggcgtcgtgggtaaggttggcgagattcagtgttcgtcagaagagtctgcacggaccatcaaaaaggatgggtgcatttggaacgccgacctggtgggaatcgaacttagagtcgatgacgctgtgtgttacagtaagataacatccgttgaggccgtggcaaattatagcgctattccaactaccatcggcgggctgaggtttgagcgcattcacgattctcagggaaaaatcagcggctcccccttggacataacagccatccgaggttcattcagtgtaaactaccgggggctccgtctgagcttatctgaaattaccgcgacttgcacgggagaggtcacaaatgtgtccggctgctactcatgtatgaccggtgccaaggtgagtatcaaactgcatagctccaagaactctactgctcacgtcagatgcaaaggcgatgaaaccgcattttcggttctagagggggtgcacagctatattgtatcactctccttcgaccatgccgtggtcgatgaacaatgtcagctgaattgcggaggccacgagagtcaggtgacacttaaggggaacttgatctttctggacgttcctaagttcgtggacggatcttacatgcagacctatcatagcactgtccccacaggcgctaatataccatcccctacggattggctcaacgccctgtttggtaatgggttatcaaggtggattctgggagtgatcggcgttcttttgggcgggctcgcactgttctttctaatcatgttcctgctcaaactgggaaccaagcaagtgtttcgctctcggactaaacttgcgtga

SEQ ID NO: 11504 - RNA, 3222 nt, synthetic construct
  misc_feature 1..3222: note = derived and/or modified CDS sequence (opt3) from SFTSV(HB2014-04)__KR080475.1__GP
  source 1..3222: mol_type = other RNA
atgatgaaggtgatctggttccccagcctgatttgctttgtcatacagtgttccggcgactctgggcctatcatttgcgccggaccaatccactcaaacaaaagtgctgatattccgcatctccttggttacagcgagaagatctgtcaaatagacagactgatccacgtttcctcttggttgaggaatcattcgcagttccagggctatgtggggcagcggggaggccgctcacacgtaagctactatcccgcagaaaacagttactcccgatggtctggtttactgagcccttgcgatgccgactggctagggatgctcgtggtcaaaaaggcgaaaggatccgatatgattgtgccaggcccctcatataagggcaaggttttcttcgagcgtcctacctttgacgggtacgtgggatggggttgtggcagtgggaaaagcagaacagaatctggagagctgtgctcctcagatagcggcactagctctggtcttctgccatccgacagggtcttgtggatcggggatgtggcttgtcaacccatgacgcctattccagaagagaccttcctcgagctgaagagtttttcgcagtctgaatttccggacatctgcaaaatagatggaattgtatttaatcagtgtgagggcgaatccctgccccagcctttcgacgttgcctggatggatgtgggccattcacacaagatcattatgcgggagcacaaaacaaagtgggtccaagagagtagctccaaggactttgtgtgctataaagaagggactggaccatgttctgagagcgaagagaagacctgcaaaacatcaggtagttgccgcggcgacatgcagttctgtaaggtggcagggtgcgaacatggagaggaggcctccgaagctaaatgtagatgcagcctcgtccacaagcccggcgaggttgtggtatcttacggtgggatgagggtgcggcctaaatgttacggcttttcacgcatgatggcaaccttagaagtcaaccagccagagcagcgaatcggacaatgcactggctgtcatctggaatgcatcaatgggggagtgagacttattacattgaccagtgagctaaagagcgccacggtttgtgcttcccacttctgcagctcggccactagcggtaagaaatccaccgagatacagttccactcaggcagtctggtggggaagacagcgatccatgtcaaaggagcactcgtggatggcactgaatttaccttcgagggttcttgtatgtttcccgacgggtgcgatgccgtagactgcacattctgtagggaatttctgaagaacccgcagtgctatcctgctaaaaagtggcttttcattatcatagttattctgttgggctacgccggactcatgctgttaaccaatgtgctgaaggcaatcggcatctgggggagctgggtcattgctcccgtgaaactcatctttgccattataaagaaacttatgcggacggtctcctgtctgatgggaaagttgatggatcgtggtcgccaagtgatccacgaggaaattggcgagaacagagaggggaatcaggacgatgttaggatcgaaatggcgcggccacgacgcgtgagacattggatgtattcacctgtaatcctaactattctggccataggactcgcagagagctgcgacgaaatggtccacgctgattctaaactggtgtcctgtaggcagggcagtggtaacatgaaggagtgcgttacaaccgggcgggcccttctgcccgctgtgaatccaggccaggaggcctgtttgcatttcactgcacccggaagccctgactctaagtgcctcaaaatcaaggtcaaacgcattaacctgaagtgtaaaaagtcctcaagttactttgtgccagatgccagatctaggtgcacatcggtacgtcggtgtcgatgggctggcgactgccaatccgggtgcccgccccacttcacctctaatagcttttcagacgattgggcgggaaagatggacagagcaggcttaggtttcagtgggtgttccgatggatgcggcggtgccgcttgtggctgctttaacgccgcaccttcttgtatcttctggaggaaatgggtggaaaatccacacgggattatctggaaggttagcccctgcgccgcttgggtcccttccgccgtgatagagctgacgatgccatcaggagaagtgcgcaccttccatcccatgagcggcatcccgacacaggtctttaaaggggttagtgtgacttatctaggatctgacatggaggtgtccggcctcaccgatctgtgtgaaattgaggagcttaagagcaaaaagttggcactggcgccttgcaaccaggctggtatgggggtagtcggaaaagtgggcgaaatccagtgttcgtcagaggaatctgcccggacaattaagaaggacggttgcatctggaacgcagatctcgttggcatagagctgagagtggacgatgccgtctgttacagtaaaattacttccgtggaagctgttgccaattatagcgcaatcccaaccacaattgggggacttaggttcgagcgctctcacgacagccaaggcaagatctccgggtcacccctggatataaccgctatccgaggaagttttagcgtgaactaccggggcttgcgtctctctctgtccgagattactgccacgtgcacaggtgaagtaaccaatgtctcagggtgctacagttgtatgactggagcgaaagtgagcatcaagttacattcctctaaaaactcgaccgcccacgtgagatgcaagggcgacgagacagctttcagcgtcctggaaggtgttcactcatataccgtgtccctaagttttgatcatgcagtagtggacgagcagtgtcagctcaattgcggcgggcacgaatctcaggtcactctgaagggaaaccttattttcttggacgtgcctaaatttgttgatggcagctacatgcaaacatatcattccacggtgcccaccggggccaatatcccatcacctactgactggctgaacgctctcttcggaaatggcctgtctaggtggatattaggtgtcattggggtgctgcttggaggcttggccctctttttcatgatcatgagcctgtttaagctaggcacaaaacaggttttccgcagtcggtccaagctggcatga

SEQ ID NO: 11505 - RNA, 3222 nt, synthetic construct
  misc_feature 1..3222: note = derived and/or modified CDS sequence (opt3) from SFTSV(HNXH)__KT254590.1__GP
  source 1..3222: mol_type = other RNA
atgatgaaggtgatctggttcagctccctgatttgcctcgtcatacagtgtggcggggacaccggacccatcatttgcgccggtcctatccactctaacaaatcagctgatattccacatcttctgggctacagtgagaagatctgtcaaatagacagattgatccacgttagctcctggttaaggaatcattctcagtttcaggggtatgtgggacagcggggcggtcgctcgcaagtatcatactatccggcagaaaacagctacagtcgatggtccgggctgctatctccctgcgatgccgactggctcggaatgctggtggtcaaaaaggcgaaaggcagcgatatgattgtgcctggcccatcctataaggggaaggttttctttgagcgtcccacattcgacggatacgtgggttggggctgtgggtcaggaaaaagtagaactgaaagcggcgagctttgcagttccgattcaggtacgagcagtgggctgttgccttctgacagggtcctctggatcggagatgtggcttgtcagccaatgacccccattcctgaagagacatttctggagctgaagtccttcagccagtcggaatttccagacatctgcaaaatagatggcattgtattcaatcagtgtgagggcgaatctctcccgcaaccctttgacgttgcctggatggatgtggggcactcccataagatcattatgcgggagcacaaaactaagtgggtccaggagtcaagtagcaaggacttcgtgtgctataaagaaggaaccggtccttgttccgagtctgaagagaagacatgcaaaaccagcggctcatgccgcggggacatgcagttttgtaaggtggcaggatgcgaacacggcgaggaggccagtgaagctaaatgtagatgctccttagtccataagccaggtgaggttgtggtaagctacgggggcatgagggtgcggcccaaatgttacggattctctcgcatgatggcaactctggaagtctcacagcctgagcaacgaatcggccagtgcacagggtgtcaccttgaatgcatcaacggaggtgtgagattgattaccctgacgagtgagctaaagagcgccactgtttgtgcttcccatttttgttcttcggccaccagcggcaagaaatccacagagatacagttccactcagggagtctcgtgggaaagactgcgatccacgtcaaaggcgcactggtggatggtaccgagttcacatttgaagggtcttgcatgttcccagacggctgcgatgccgtagactgcaccttttgtagggagttccttaagaatccccaatgctatccggctaaaaagtggctgtttattatcatagttattttgctcggatacgccggcctgatgttactgacgaacgtgctcaaggcaatcggggtctggggaagctgggtgatcgctcctgtcaaacttgtgttcgccctgattaagaaattgatgcgggcggtttcctgtctaatgggtaagctgatggatcgtggccgccaggtgatccatgaagaaattggggagaatagagagggaaaccaggacgatgtaaggatagaaatggcccggccccgacgcgtcagacactggatgtattcaccagtgatcctcactattctggcaatcggccttgctgagggttgcgacgaaatggttcatgccgatagcaaactggtgtcttgtaggcaggggtccggcaatatgaaggagtgcgtcacaaccggacgggctttgctccctgccgtgaaccccggccaagaggcatgtctgcactttactgccccagggagtcccgacagcaagtgcttaaaaatcaaggtaaaacgcattaatctgaagtgtaaaaagtcttcctcatacttcgtgcctgatgctagaagtaggtgcacaagcgttcgtcggtgtcgatgggcgggagactgccagtcgggctgcccaccgcattttacctccaactctttcagcgacgattgggcaggtaagatggacagagccgggctaggattttcaggctgtagtgatggttgcggcggggctgcctgtggatgcttcaatgcagccccctcctgtatattttggaggaaatgggtcgaaaaccctcacggcatcatttggaaggtgtctccatgcgctgcctgggtgcccagcgcagtcatcgagctcacgatgccttccggggaagttcgcaccttccacccaatgtcaggcattcccacacaggtgttcaaaggagtgagcgtaacttatctgggtagtgacatggaggtctctgggcttaccgatttgtgtgaaatcgaggagctgaagtccaaaaagctcgcgctggctccgtgcaatcaggccggaatgggcgtggttggtaaagtgggcgaaatacaatgtagctcggaggaatcagcacggacaatcaagaaggacgggtgcatttggaacgccgatcttgtcggaatcgagctgagagtggacgatgctgtttgttactctaaaattacttctgtggaagccgtagcaaactattccgctatccctaccacaataggcgggttgaggtttgagcgcagccatgactctcagggaaagattagcggctccccactcgatatcaccgccattcgaggttcattcagtgtcaattaccgggggctgcgtttaagcctgtctgagatcactgcgacgtgcacaggagaagtgaccaacgtgtccggctgctactcatgtatgactggtgccaaagtcagtataaagctacacagctccaaaaattctaccgctcatgttagatgcaagggcgacgagacagcattttcggtgctcgaaggggtacacagctattcagtgtccctgagtttcgatcacgccgtcgtggacgagcagtgtcagcttaactgcggaggccatgaatctcaagttaccttgagggggaatctgatctttctcgacgtgcccaagttcgtcgatggaagctacatgcagacttatcactccacagtgcctacgggcgctaacattccctcaccaaccgactggctgaatgccttatttggtaacgggctgtctcgctggatccttggagttactggcgtgttgctcggcgggctggcactattctttctgattatgagcctcttcaaactgggaacaaagcagatctttcggagtagaaccaaacttgcgtga

SEQ ID NO: 11506 - RNA, 3222 nt, synthetic construct
  misc_feature 1..3222: note = derived and/or modified CDS sequence (opt3) from SFTSV(JS2012-goat01)__KC473538.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgaggatccggcccaaatgttacggctttagtcgcatgatggcaaccttagaagtgaaccagcctgagcaacgactgggacagtgcactggctgtcaccttgaatgcatcaatgggggagtcagattgattacactgaccagcgagctaaagtccgccacggtgtgtgcttctcatttctgctcgagcgccacttccggtaagaaatcaaccgagatacagttccacagtggctctctcgttgggaagacagcgatccacgtgaaaggagcactggtcgatggcactgaatttaccttcgagggtagctgtatgtttccagacgggtgcgatgccgtggactgcacattctgtagggaatttcttaagaacccccaatgctatccggctaaaaagtggctgttcattatcatagtaattttgctcggctacgccggactgatgttactgaccaatgttctcaaggcaatcggcatctgggggtcctgggtgattgctcctgtcaaacttatgtttgccatcattaagaaactgatgcggacggtgtcatgtttgatgcgtaagctaatggatcgcggaagacaggtcatacatgaggaaatcggtgagaacagggagggcaatcaggacgatgtgcggattgaaatggcgcgaccccgcagagttaggcactggatgtatagcccagtgatcctgactatcctcgccattgggctggcagagtcttgcgacgaaatggtacatgctgattccaaacttgtcagttgtcggcagggaagcggcaacatgaaggagtgcgtgacaaccggtcgcgccctgttgcctgctgttaatcccgggcaagaggcctgtctccacttcactgcaccaggctctcccgactccaagtgcctgaaaataaaggtgaaaagaatcaacttaaagtgtaaaaagtcaagtagctactttgtccctgatgccaggtcgcgttgcacatccgtgcggcgatgtagatgggctggagactgccagtctggctgcccaccgcatttcaccagcaattcatttagtgacgattgggcggggaagatggacagggcaggactgggcttctccggttgttctgatgggtgcggaggcgccgcttgtggttgctttaacgccgcacccagctgtattttctggcgcaaatgggtagaaaatcctcacggcatcatttggaaggtgtccccatgcgccgcttgggttccctcagccgtcatcgagctaacgatgcctagcggggaagtgcggaccttccacccaatgagtggaatacccacacaggtgtttaaaggcgtctctgttacttatctcgggtccgacatggaggtgagcggactgaccgatctttgtgaaatcgaggagttgaagtcgaaaaagctggcactcgcgccgtgcaaccaggctggcatgggtgtggtagggaaagtcggagaaattcaatgttcatctgaggaaagtgccagaacaatcaagaaggacggctgcatttggaacgcagatctggtgggtatcgagcttagggttgacgatgccgtgtgttactccaaaataactagcgtcgaagctgtggccaattattctgcaattcctaccacaatcggcgggctgcgcttcgagcggagcttggactcccagggaaagatttcaggcagtccactcgatatcaccgctatacgagggagcttttctgttaactaccgtggactgagattatccctgtcagagatcactgccacgtgcacaggcgaagtgaccaatgtaagtggttgctacagctgtatgactggggcgaaagtctccattaagctacattcttcgaaaaacagcaccgcccacgtgaggtgcaagggagacgagacagctttctcagtgctcgaaggcgtccattcctataccgttagtctgtcttttgatcacgcagtggtagacgagcagtgtcagcttaattgcggtggccacgaaagccaagtgactttgaaggggaacctgatcttcctcgacgtccccaaatttgtggatggatcctacatgcagacatatcattcaacggttcctaccggcgccaatattccctctccaactgactggctgaacgctttattcgggaatggactgagccgctggatccttggcgtgataggtgtcttgctcgggggactggccctatttttcatgattatgagtctgtttaagctcggcacaaaacaggtgttccggtccagaaccaagctggcatga

SEQ ID NO: 11507 - RNA, 3222 nt, synthetic construct
  misc_feature 1..3222: note = derived and/or modified CDS sequence (opt3) from SFTSV(JS2012-tick01)__KC473541.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaaccagcctgagcaacgactgggacagtgcactggctgtcaccttgaatgcatcaatgggggagtgagattgatcacactgaccagcgagctaaagtccgccacggtttgtgcttctcatttctgctcgagcgccacttccggtaagaaatcaaccgagattcagttccacagtggctctctcgtggggaagacagcgatacacgtcaaaggagcactggtggatggcactgaatttaccttcgagggtagctgtatgtttccagacgggtgcgatgccgtagactgcacattctgtagggaatttcttaagaacccccaatgctatccggctaaaaagtggctgttcatcattatcgttatattgctcggctacgccggactgatgttactgaccaatgtgctcaaggcaattggcatctgggggtcctgggtcatcgctcctgtgaaacttatgtttgccattatcaagaaactgatgcggacggtctcatgtttgatgcgtaagctaatggatcgcggaagacaggtgattcatgaggaaataggtgagaacagggagggcaatcaggacgatgttcggatcgaaatggcgcgaccccgcagagtgaggcactggatgtatagcccagtaattctgactatcctcgccatcgggctggcagagtcttgcgacgaaatggtccatgctgattccaaacttgtgagttgtcggcagggaagcggcaacatgaaggagtgcgttacaaccggtcgcgccctgttgcctgctgtgaatcccgggcaagaggcctgtctccacttcactgcaccaggctctcccgactccaagtgcctgaaaattaaggtcaaaagaataaacttaaagtgtaaaaagtcaagtagctactttgtgcctgatgccaggtcgcgttgcacatccgtacggcgatgtagatgggctggagactgccagtctggctgcccaccgcatttcaccagcaattcatttagtgacgattgggcggggaagatggacagggcaggactgggcttctccggttgttctgatgggtgcggaggcgccgcttgtggttgctttaacgccgcacccagctgtatcttctggcgcaaatgggtggaaaatcctcacggcattatctggaaggtttccccatgcgccgcttgggtcccctcagccgtgattgagctaacgatgcctagcggggaagtgcggaccttccacccaatgagtggaatccccacacaggtctttaaaggcgtttctgtgacttatctcgggtccgacatggaggtgagcggactgaccgatctttgtgaaatagaggagttgaagtcgaaaaagctggcactcgcgccgtgcaaccaggctggcatgggtgtagtcgggaaagtgggagaaatccaatgttcatctgaggaaagtgccagaacaattaagaaggacggctgcatctggaacgcagatctggttggtattgagcttagggtggacgatgccgtctgttactccaaaatcactagcgtggaagctgttgccaattattctgcaatacctaccacaattggcgggctgcgcttcgagcgaagccatgactcccagggaaagatctcaggcagtccattggatattaccgctatccgggggagcttttctgtgaactaccgtggactcagactgtccttatcagagataactgccacgtgcacaggcgaagtaaccaatgtcagtggttgctacagctgtatgactggggcgaaagtgtccatcaagctgcactcttcgaaaaacagcaccgcccatgtgaggtgcaagggagacgagacagctttctcagtcctagaaggcgttcactcctataccgtgagtctctcttttgatcacgcagtagtggacgagcagtgtcagctgaattgcggtggccatgaaagccaagtcactcttaaggggaacttgattttcctggacgtgcccaaatttgttgatggatcctacatgcagacatatcactcaacggtgcctaccggcgccaatatcccctctccaactgactggctcaacgctctgttcgggaatggattaagccgctggattctgggcgtcatcggtgtgcttctcgggggattggccctgtttttcatgataatgagtctatttaagctgggcacaaaacaggttttccggtccagaaccaagctcgcatga

SEQ ID NO: 11508 - RNA, 3222 nt, synthetic construct
  misc_feature 1..3222: note = derived and/or modified CDS sequence (opt3) from SFTSV(LN2012-14)__KF887436.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaaccagcctgagcaacgaatcggacagtgcactggctgtcacctggaatgcatcaatgggggagtgagacttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggatggcactgaatttaccttcgagggtagctgtatgtttccagacgggtgcgatgccgtagactgcacattctgtagggaatttctgaagaacccccaatgctatccggctaaaaagtggcttttcattatcatagttattctgttgggctacgccggactcatgctgttaaccaatgtgctgaaggcaatcggcatctgggggtcctgggtcattgctcctgtgaaactcatctttgccattataaagaaacttatgcggacggtctcatgtctgatgggaaagttgatggatcgtggtcgccaggtgatccatgaggaaattggcgagaacagagaggggaatcaggacgatgtttggatcgaaatggcgaggccccggcgagtgcgctattggatgtacagcccagtaatcctaactattctggccgtcggactcgcagagtcttgcgacgaaatggtgcacgctgattccaaactggttagttgtagacagggcagcggtaacatgaaggagtgcgtgacaaccgggagggcccttctgcctgctgtcaatcccggccaagaggcctgtttgcatttcactgcaccaggatctcccgactccaagtgcctcaaaatacgggtgaagcgcatcaacctgaaatgtaagaaatcaagtagctattttgtacctgatgccagatcgaggtgcacatccgtgcgtcggtgtcgatgggctggcgactgccagtctgggtgcccaccgcacttcaccagcaattcatttagtgacgattgggttggaaagatggacagagcgggcttaggtttctccgggtgttctgatggatgcggcggtgcagcctgtggctgctttaacgctgcccccagctgtattttctggaggaagtgggtcgaaaatcctcatgggatcatttggaaagtgtccccatgcgcagcctgggtgccctcagctgtcatcgagctgacgatgcctagcggagaagttcgcaccttccacccaatgagtggcatacccacacaggtgtttaagggggtgtctgtaacttacctaggatccgacatggaggtcagcggcctcaccgatctgtgtgaaatcgaggagcttaaatcgaagaaattggccctggcaccgtgcaaccaggcgggtatgggggtggttggaaaggtgggcgaaattcaatgttcatctgaggaaagtgctcggacaatcaaaaaggacggttgcatttggaacgccgatctcgtcggcatcgagctgagagtggacgatgcagtttgttattccaagataactagcgtggaagccgtagctaattactctgccattcctaccacaatcgggggacttaggttcgagcgcagccacgactcccagggcaaaatttcagggagtccactggatatcaccgcaatacgaggatcgttttctgtcaactaccggggcttgcgtctctccctgtcagagatcactgctacgtgcacaggtgaagtgaccaatgtgagtgggtgctatagctgtatgactggagccaaggtctccattaaattacattctaacaagaatagcaccgcgcacgttagatgcaaaggcgacgagacagccttcagcgtgctggaaggtgtacattcatacaccgtgtccctaagttttgatcacgctgtcgtggacgagcagtgtcagctcaactgcggcgggcacgaatctcaagttactctgaagggaaatcttatcttcttggacgtgcccaagtttgtcgatggcagctatatgcagacataccattccacggtgcctaccggggcaaacattccctcaccaactgactggctgaatgccctcttcggaaacggcctgtctaggtggatcttaggtgttataggggtgctgcttggaggcttggctctctttttcatgattatgagcctgtttaaactaggcacaaagcaggtcttccgcagtcggaccaaactggcctga

SEQ ID NO: 11509 - RNA, 3222 nt, synthetic construct
  misc_feature 1..3222: note = derived and/or modified CDS sequence (opt3) from SFTSV(LN2012-34)__KF887437.1__GP
  source 1..3222: mol_type = other RNA
atgatgaaggtgatctggttctttagcctgatttgcttcgtcatacagtgttccggcgactctgggcccatcatttgcgccggacctatccactcaaacaaaagtgctgatattccacatctccttggttacagcgagaagatctgtcaaatagacagactgatccacgtttcctcttggttgaggaatcattcgcagtttcagggctatgtggggcagcggggaggccgctcacaagtaagctactatccggcagaaaacagttactcccgatggtctggtttactgagcccctgcgatgccgactggctagggatgctcgtggtcaaaaaggcgaaaggatccgatatgattgtgcctggcccatcatataagggcaaggttttctttgagcgtcccaccttcgacgggtacgtgggatggggttgtggcagtgggaaaagcagaacagaatctggagagctgtgctcctcagatagcggcacttcttctggtcttctgccttccgacagggtcttgtggatcggggatgtggcttgtcagccaatgacgcccattcctgaagagacctttctcgagctcaagagcttctcgcagtctgaatttccagacatctgcaaaatagatggaattgtattcaatcagtgtgagggcgaatccctgccgcaaccctttgacgttgcctggatggatgtgggccactcacataagatcattatgcgggagcacaaaacaaagtgggtccaggagagtagctccaaggacttcgtgtgctataaagaagggactggaccttgttctgagagcgaagagaagacctgcaaaacatcaggtagttgccgcggcgacatgcagttttgtaaggtggcagggtgcgaacacggagaggaggcctccgaagctaaatgtagatgcagcctggtccataagccaggcgaggttgtggtatcttacggtgggatgaggatccggcccaaatgttacggcttctcacgcatgatggcaaccttagaagtgaaccagcctgagcaacgaatcggacagtgcactggctgtcacctggaatgcattaatgggggagtcagacttataacattgaccagtgagctaaagagcgccacggtgtgtgcttcccatttctgttcttcggccactagcggtaagaaatccaccgagatccagtttcactcaggcagtctggttgggaagacagcgattcacgtgaaaggagcactcgtcgatggcactgagttcacctttgaaggttcttgcatgttcccagacgggtgcgatgccgtggactgcacattttgtagggagttcctgaagaacccccaatgctatccggctaaaaagtggctttttatcataattgtaatcctgttgggctacgccggactcatgctgttaaccaatgttctgaaggcaatcggcatttgggggagctgggtgatcgctcctgtcaaactcattttcgccataatcaagaaacttatgcggacggtgtcctgtctgatgggaaagttgatggatcgtggtcgccaggtcattcatgaagaaatcggcgagaacagagaggggaatcaggacgatgtgaggatcgaaatggcgcggccccgacgcgttagacactggatgtattcaccagtgattctaactatactggccatcggactcgcagagagctgcgacgaaatggtacatgctgattctaaactggtctcctgtaggcagggcagtggtaacgtgaaggagtgcgttacaaccgggcgggcccttctgcctgctgtgaatcccggccaagaggcctgtttgcactttactgcaccaggaagccccgactctaagtgcctcaaaattcgcgtcaagagaatcaacctgaaatgtaagaaatcctcaagttacttcgtgcctgatgccaggagccgttgcacatcggtacggcgatgtagatgggctggcgactgccagtccgggtgcccaccgcattttacctctaatagcttctcagacgattgggcgggaaagatggacagggcaggcttaggttttagtgggtgttccgatggatgcggcggtgccgcttgtggctgcttcaacgccgcaccctcttgtattttctggcgcaagtgggtggaaaatcctcacgggatcatatggaaagttagcccatgcgccgcttgggtcccctccgccgtgatcgagctgacgatgccttcaggagaagtgcggacctttcacccaatgagcggcattcccacacaggtcttcaagggggttagtatcacttatctaggatctgacatggaggtgtccggcctcaccgatctgtgtgaaattgaggagcttaaaagcaagaaattggcactggcgccgtgcaaccaggctggtatgggggtggtaggaaaggtcggcgaaatccaatgttcgtcagaggaatctgccagaacaataaagaaggacggttgcatttggaacgcagatctcgtgggcatcgagctgagggttgacgatgccgtgtgttacagtaagattacttccgtcgaagctgtggccaattatagcgcaatccctaccacaatagggggacttcgctttgagcgatctcatgacagccagggcaaaatctccgggtcaccactggatattaccgctatccggggaagtttcagcgttaactaccgtggcttgagactctctctgtccgagattactgccacgtgcacaggtgaagtgaccaatgtatcagggtgctacagttgtatgactggagcgaaggtcagcatcaaattacactccaacaagaatagtaccgcccatgtgaggtgcaaaggcgacgagacagctttttcggtgctggaaggtgtccacagctataccgtttcactatccttcgatcacgcagtggtagacgagcagtgtcagctcaactgcggcgggcatgaaagtcaagtgactctgaagggaaatcttatatttttggacgtccccaagttcgtggatggctcttacatgcagacatatcacagcacggttcctaccggggccaacattccctccccaactgactggctgaatgctctctttggaaacggcctgtcacgctggatcttaggtgtgatcggggtcctgcttggaggcttggccctcttctttatgattatgtctctgttcaaactaggcacaaaacaggtgtttcggagcagaaccaaactggcatga

SEQ ID NO: 11510 - RNA, 3222 nt, synthetic construct
  misc_feature 1..3222: note = derived and/or modified CDS sequence (opt3) from SFTSV(LN2012-41)__KF887438.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaaccagcctgagcaacgaatcggacagtgcactggctgtcacctggaatgcatcaatgggggagtgagacttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggatggcactgaatttaccttcgagggtagctgtatgtttccagacgggtgcgatgccgtagactgcacattctgtagggaatttctgaagaacccccaatgctatccggctaaaaagtggcttttcattatcatagttattctgttgggctacgccggactcatgctgttaaccaatgtgctgaaggcaatcggcatctgggggtcctgggtcattgctcctgtgaaactcatctttgccattataaagaaacttatgcggacggtctcatgtctgatgggaaagttgatggatcgtggtcgccaggtgatccatgaggaaattggcgagaacagagaggggaatcaggacgatgttaggatcgaaatggcgcggccccgacgcgtgagacactggatgtatagcccagtaatcctaactattctggccataggactcgcagagtcttgcgacgaaatggtccatgctgattccaaactggtgagttgtaggcagggcagcggtaacgttaaggagtgcgtgacaaccgggcgggcccttctgcctgctgtcaatcccggccaagaggcctgtttgcacttcactgcaccaggatctcccgactccaagtgcctcaaaatccgcgtgaagagaattaacctgaaatgtaagaaatcaagtagctactttgtacctgatgccaggtcgcgttgcacatccgtgcggcgatgtagatgggctggcgactgccagtctgggtgcccaccgcatttcaccagcaattcatttagtgacgattgggcgggaaagatggacagggcaggcttaggtttctccgggtgttctgatggatgcggcggtgccgcttgtggctgctttaacgccgcacccagctgtatcttctggcgcaagtgggttgaaaatcctcacgggattatctggaaagtctccccatgcgccgcttgggtgccctcagccgtgatagagctgacgatgcctagcggagaagtccggaccttccacccaatgagtggcatccccacacaggtttttaagggggtgtctgtgacttatctaggatccgacatggaggtaagcggcctcaccgatctgtgtgaaattgaggagcttaaatcgaagaaattggcactggcgccgtgcaaccaggctggtatgggggtcgtgggaaaggttggcgaaatccaatgttcatctgaggaaagtgccagaacaattaaaaaggacggttgcatctggaacgcagatctcgtgggcatagagctgagggtcgacgatgccgtgtgttactccaagattactagcgttgaagctgtggtaaattattctgccatccctaccacaattgggggacttcgcttcgagcgaagccatgactcccagggcaaaatctcagggagtccactggatataaccgcaatccggggatcgttttctgtcaactaccgtggcttgagactctccctgtcagagattactgctacgtgcacaggtgaagtgaccaatgtgagtgggtgctacagctgtatgactggagccaaggtctccatcaaattacactctaacaagaatagcaccgcgcatgttaggtgcaaaggcgacgagacagccttcagcgtgctggaaggtgtacactcatataccgtgtccctaagttttgatcacgctgtcgtggacgagcagtgtcagctcaactgcggcgggcatgaatctcaagttactctgaagggaaatcttattttcttggacgtgcccaagtttgtcgatggcagctacatgcagacatatcactccacggtgcctaccggggcaaacatcccctcaccaactgactggctgaatgccctcttcggaaacggcctgtctcgctggatattaggtgttattggggtgctgcttggaggcttggctctctttttcatgatcatgagcctgtttaaactaggcacaaagcaggtcttccggagtagaaccaaactggcctga

SEQ ID NO: 11511 - RNA, 3222 nt, synthetic construct
  misc_feature 1..3222: note = derived and/or modified CDS sequence (opt3) from SFTSV(LN2012-58)__KF887440.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaaccagcctgtgcaacgaatcggacagtgcactggctgtcacctggagtgcatcaatgggggagttagacttattacattgaccagcgaactgaagtccgccacggtgtgtgcttctcatttctgctcgagcgccacttccggtaagaaatcaaccgagatacagttccacagtggctctctagtcgggaagacagcgatccacgtgaaaggagcactcgtagatggcactgagtttaccttcgaaggtagctgtatgtttccagacgggtgcgatgccgttgactgcacattctgtagggagtttctgaagaacccccaatgctatccggctaaaaagtggcttttcattatcatagtgattctgttgggctacgccggactcatgctgttaaccaatgtcctgaaggcaatcggcatctgggggtcctgggtgattgctcctgtcaaactcatctttgccattataaagaaacttatgcggacggtgtcatgtctgatgggaaagttgatggatcgtggtcgccaggttatccatgaagagattggcgaaaacagagaggggaatcaggacgatgtgaggatcgagatggcgcggccccgacgcgtaagacactggatgtatagcccagtcatcctaactattctggtgatgggactcgccgaatcttgcgacgagatggttcatgcagattccaaactggtgagttgtaggcagggcagcggtaacatgaaggaatgcgtcacaaccgggcgggcccttctgcctgctgtgaatcccggccaagaggcttgtttgcacttcactgccccaggatctcccgactccaagtgcctcaaaataaaggtaaaacgcatcaacctgaagtgtaaaaagtcaagtagctactttgtgcctgatgcaagatcgaggtgcacatccgttcgtcggtgtcgatgggccggcgactgccagtctgggtgcccaccgcatttcaccagcaattcatttagtgacgattgggctggaaagatggacagagcgggcttaggtttctccgggtgttctgatggatgcggcggtgcagcctgtggctgctttaacgctgcccccagctgtattttctggaggaaatgggtcgagaatcctcacgggatcatttggaaggtgtccccatgcgcagcctgggtgccctcagctgtcatcgaactgacgatgcctagcggagaggttcgcaccttccacccaatgagtggcatacccacacaggtgtttaaaggggtgtctgtaacttatctaggatccgacatggaagtcagcggcctcaccgatctgtgtgagatcgaggaacttaagtcgaaaaagttggccctggcaccgtgcaaccaggcgggtatgggggtggttggaaaagtgggcgagattcaatgttcatctgaagagagtgctcggacaatcaagaaggacggttgcatttggaacgccgatctcgtcggcatcgaactgagagtggacgatgcagtttgttactccaaaataactagcgtggaggccgtagctaattattctgccattcctaccacaatcgggggacttaggttcgaacgcagccatgactcccagggcaagatttcagggagtccactggatatcaccgcaatacgaggcagcttttctgtcaactaccggggattgcgtctctccctgtcagagatcactgctacgtgcacaggtgaggtgaccaatgtgagtgggtgctacagctgtatgactggagccaaagtctccattaagttacactcttcgaaaaacagcaccgcgcatgttagatgcaagggcgacgaaacagccttctcagtgctggagggtgtacactcctataccgtgagtctatcttttgatcacgctgtcgtggacgaacagtgtcagctcaattgcggcgggcatgagagccaagttactctgaagggaaaccttatcttcttggacgtgcccaaatttgtcgatggctcctacatgcagacatatcactcaacggtgcctaccggggcaaatattccctctccaactgactggctgaacgccctcttcggaaatggcctgagtaggtggatcttaggtgttataggggtgctgcttggaggcttggctctctttttcatgattatgagcctgtttaagctaggcacaaaacaggtcttccgctcccggaccaagctggcctga

SEQ ID NO: 11512 - RNA, 3222 nt, synthetic construct
  misc_feature 1..3222: note = derived and/or modified CDS sequence (opt3) from SFTSV(NB24/CHN/2013)__KR698337.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctgatattccacatcttctgggttacagcgagaagatctgtcaaatagacagattgatccacgtttcctcttggttaaggaatcattcgcagtttcagggctatgtggggcagcggggaggccgctcacaagtaagctactatccggcagaaaacagttactcccgatggtctggtctgctaagcccctgcgatgccgactggctcgggatgctggtggtcaaaaaggcgaaaggatccgatatgattgtgcctggcccatcatataagggcaaggttttctttgagcgtcccacattcgacgggtacgtgggatggggttgtggcagtgggaaaagcagaactgaatctggagagctttgctcctcagatagcggcacgagttctggtctgttgccttccgacagggtcctctggatcggggatgtggcttgtcagccaatgacccccattcctgaagagacatttctggagctcaagagcttctcgcagtctgaatttccagacatctgcaaaatagatggaattgtattcaatcagtgtgagtccgaatcactgccgcaaccctttgacgttgcctggatggatgtgggccacagtcataagatcattatgcgggagcacaaaactaagtgggtccaggagagctcctctaaggacttcgtgtgctataaagaaggcaccgggccttgtagcgagtcagaagagaagacatgcaaaaccagtggatcctgccgcggtgacatgcagttttgtaaggtggcaggctgcgaacacggggaggaggccagcgaagctaaatgtagatgctctttagtccataagccaggagaggttgtggtatcatacggcggtatgagggtgcggcccaaatgttacgggttcagtcgcatgatggcaactctggaagtcaaccctccagagcagcgaatcggccaatgcacaggatgtcaccttgaatgcgtgaatggcggggttagattgatcaccctgacgagcgagctaaagtccgccactgtgtgtgcttctcatttttgctcgagcgccacctccggaaagaaatcaacagagattcagttccacagtggttctctcgtcggcaagactgcgatacacgtgaaaggggcactggtagatggaaccgagttcacatttgaaggcagctgtatgttccccgacggttgcgatgccgttgactgcaccttttgtagggagttccttaagaacccgcagtgctatcctgctaaaaagtggctgtttatcaatattgtgatcttgctcgggtacgccggcctgatgttactgacgaacgtcctcaaggcaataggagtgtggggctcctgggtcattgctcccgtgaaacttatgttcgccatcatcaagaaactgatgcggtcagttagctgtttgatggggaagctaatggatcgtggacgccaagtgattcatgaagaaatcggtgagaatagagagggcaaccaggacgatgtaaggattgaaatggcgcggccacgacgcgtcagacactggatgtattctcctgtgatactgactatcctcgccgttgggctggcagagggatgcgacgaaatggtgcatgctgattccaaacttgtcagttgtaagcagggcagcggtaatatgaaggagtgcgtgacaaccgggagggccctgttgcccgctgtaaacccaggccaggaggcctgtctccactttactgcacccggatctcctgactccaaatgcctgaagattaaagtgaagaaaatcaatttaaagtgtaagaaatcaagtagctacttcgttccagatgcccggtcgcgctgcacatccgtcagaaggtgtcgttgggctggcgactgccaatctgggtgcccgagccattttacctcaaacagtttctccgacgattgggcgggaaagatggaccgggcaggcctgggtttttctgggtgtagcgatggatgcggcggtgccgcttgtggctgcttcaatgccgcaccctcctgtatcttttggcgaaaatgggtggaaaaccctcacgggattatatggaaggtgtcaccatgcgccgcttgggtccccagcgccgttatcgagctaacgatgcctagtggagaagtgagaaccttccacccaatgtctggcattcccacacaggtgttcaaaggggtatccgtcacttatctcggaagcgacatggaggtgtcgggcctgaccgatctttgtgaaatcgaggagttgaagtctaaaaagctggcactcgcgccgtgcaaccaggctggtatgggggttgtgggaaaggtcggcgaaattcagtgttcaagtgaggaatccgccaggacaatcaaaaaggacggttgcatatggaatgcagatctggtgggcatcgagcttcgcgttgacgatgccgtgtgttacagcaaaattacttctgtagaagctgtcgccaactatagcgcaatccctaccacaattgggggactgcggtttgagagatcccatgactcacaaggcaagatcagtgggagcccattggatataaccgctattaggggatctttctccgtgaattaccgcggcctccgactgtcattaagtgagatcactgccacgtgcacaggtgaagtgaccaacgtcagcgggtgctactcctgtatgactggagcgaaagtttctattaagctgcactcgaataagaacagcaccgcccatgtgcggtgcaaaggcgacgagacagctttttcagtactagaaggtgtgcactcctataccgtcagtctctctttcgatcacgcagtggttgacgagcagtgtcagctgaattgcggcgggcatgaaagccaggtgactcttaagggaaacttgatctttctggacgtccccaaattcgtggatggctcctacatgcaaacatatcactcatctgttcctacgggggccaatatacccagcccaaccgactggctcaacgctctgtttggaaatggcttaagtcgttggatcctgggtgtgattggggtccttttgggaggcctcgccctgttctttctaatcatgtccctgttcaagctcggcactaaacaggtatttagaagcaggtctaagctggcatga

SEQ ID NO: 11513 - RNA, 3222 nt, synthetic construct
  misc_feature 1..3222: note = derived and/or modified CDS sequence (opt3) from SFTSV(NB31/CHN/2013)__KR698338.1__GP
  source 1..3222: mol_type = other RNA
atgatgaaggtgatctggttcagctccctgatttgctttgtcatacagtgttctggcgacaccgggcccatcatttgcgccggacctatccactcaaacaaaagtgctaatattccacatctccttggttacagcgagaagatctgtcaaatagatagactgatccacgtttcctcttggttgaggaaccattcgcagttccagggctatgtggggcagcggggaggccgctcacaagtaagctactatccgagtgaaaattccaactctcgatggagcggtttactgtccccctgcgacgcagattggctagggatgctcgtggtcaaaaaggccaaaggatcagacatgattgtgcctggcccaagttacaagggcaaggttttcttcgagcgtcccacatttgatgggtatgtgggatggggttgtggcagcgggaaatctagaactgaatccggagagctgtgctcaagcgacagtggcacgtcttccggtcttctgcctagcgatagggtcttgtggatcggggacgtggcgtgtcagccaatgacccccattcctgaagagacattcctcgagctgaagtcgttttctcagtccgaatttccagatatctgcaaaatagacggaattgtatttaatcagtgtgagtcagaaagtctgccgcaacccttcgatgttgcttggatggacgtgggccacagccataagatcattatgcgggagcacaaaactaagtgggtccaggagtcctctagcaaggattttgtgtgctacaaagaaggcaccgggccttgttcagagagtgaagagaagacatgcaaaacctccggaagctgccgcggtgacatgcagttctgtaaggtggccggctgcgaacacggggaggaggcatctgaagccaaatgtagatgctcactcgtccataagccaggagaggttgtggtaagttatggcggtatgagggtgcggcccaaatgttacgggtttagccgcatgatggctactttagaagtcaaccctccagagcagcgaatcggccaatgcacaggatgtcacctggaatgcatcaatggcggggtgagacttattaccttgacgtccgagctgaagtctgcaactgtttgtgcctcgcatttctgcagctccgctacctcaggaaagaaaaacacagagatacagttccacagtggttctctagtgggcaagactgtcatccacgtgaaaggggccctcgtagacggaaccgaatttacattcgagggcagctgtatgtttcccgatggttgcgaagcggttgactgcaccttctgtagggagtttctgaagaatccgcagtgctaccctgctaaaaagtggcttttcattatcatagtgattctgttggggtatgccggcctcatgctgttaacgaacgtcctgaaggctatcggagtgtggggctcctgggtcatcgcccccgtgaaactcatgtttgcaattatcaagaaacttatgcggtcagttagctgtctgatggggaagttgatggatcgtggacgccaagtgattcatgaagagataggtgagaatagagaaggcaacagggacgatgtacggatcgagatggctcgaccacgcagagtcaggcactggatgtactctcctgtgattctaactatcctggccatcgggctcgcggaaggatgcgacgagatggttcatgccgattccaaactggtgagttgtaagcagggcagcggtaatatgaaggagtgcgtcacaaccgggcgggtgcttctgcccgcagtaaacccaggccaggaagcatgtttgcacttcactgcccccggatctcctgactccaaatgcctcaagattaaagtgaagcgcataaatctgaaatgtaagaagtcaagtagctattttgttccagatgctagatcgaggtgcacatccgtccgtcggtgtcgatgggccggcgactgccagtctgggtgcccgagccatttcacctcaaacagtttttccgatgactgggcaggaaaaatggacagagccggcttaggtttctctgggtgtagcgatggatgcggcggtgctgcgtgtggctgctttaacgcagccccctcctgtatcttctggaggaagtgggtggagaatcctcacgggattatctggaaagtgtcaccatgcgctgcctgggtccccagcgcagttattgaactgacgatgcctagtggagaggtgcgcaccttccacccaatgtctggcatccccacacaagtgtttaagggggtatccgtcacttacctaggaagcgacatggaagtgtcgggcctcaccgatctgtgtgagatagaggaacttaaatcaaagaaattggccctggctccgtgcaaccaggccggtatgggggttgtgggaaaggtcggcgagatccagtgttctagtgaagagtccgcacggacaattaagaaagacggttgcatctggaatgcggatctcgtgggcattgaactgagagttgacgatgctgtgtgttatagcaagatcacttctgtagaggccgtcgcaaactacagcgccatacctaccacaattgggggacttaggttcgagcgctcccatgactcacagggcaaaatcagtgggagcccactggatattaccgctatccgaggatctttttccgtgaattatcggggcttgcgtctctcactgagtgaaataactgccacgtgcacaggtgaggtgaccaacgtcagcgggtgctactcctgtatgactggagcaaaggtttctatcaaattacactcgagcaagaatagcaccgctcatgtgagatgcaagggcgacgaaacagccttctccgtactggagggtgtgcacagttacaccgtctctctatcatttgatcacgcggtggttgacgaacaatgtcagctcaactgcggcgggcatgagtcccaggtgactctgaaaggaaatcttattttcttggatgtccccaagtttgtggacggctcatatatgcagacataccactctagcgttcctacgggggccaacatccccagtccaaccgactggctgaatgctctcttcggaaacggcctgtccaggtggattttaggtgtggtcggggtactgcttggaggcttggtgctctttttcctgatcatgagcctatttaaactgggcactaagcaagttttccgctctcggacaaaactcgcatga

SEQ ID NO: 11514 - RNA, 3222 nt, synthetic construct
  misc_feature 1..3222: note = derived and/or modified CDS sequence (opt3) from SFTSV(NB38/CHN/2013)__KR698341.1__GP
  source 1..3222: mol_type = other RNA
atgatgaaggtgatctggttcagctccctgatttgcctcgtcatacagtgtggcggggacacctctcccatcatttgcgccggacctatccactcaaacaaaagtgctgatattccacatcttctgggttacagcgagaagatctgtcaaatagacagattgatccacgtttcctcttggttaaggaatcattcgcagtttcagggctatgtggggcagcggggaggccgctcacaagtaagctactatccggcagaaaacagttactcccgatggtctggtctgctaagcccctgcgatgccgactggctcgggatgctggtggtcaaaaaggcgaaaggatccgatatgattgtgcctggcccatcatataagggcaaggttttctttgagcgtcccacattcgacgggtacgtgggatggggttgtggcagtgggaaaagcagaactgaatctggagagctttgctcctcagatagcggcacgagttctggtctgttgccttccgacagggtcctctggatcggggatgtggcttgtcagccaatgacccccattcctgaagagacatttctggagctcaagagcttctcgcagtctgaatttccagacatctgcaaaatagatggaattgtattcaatcagtgtgagggcgaatccctgccgcaaccctttgacgttgcctggatggatgtgggccactcacataagatcattatgcgggagcacaaaactaagtgggtccaggagagtagctccaaggacttcgtgtgctataaagaagggaccggaccttgttctgagagcgaagagaagacatgcaaaacctcaggtagttgccgcggcgacatgcagttttgtaaggtggcagggtgcgaacacgaggaggaagcctccgaggctaaatgtagatgcagcttagtccataagccaggagaagttgtggtatcttacggcggtatgagggtgcggcccaaatgttacgggttctcacgcatgatggcaactctggaggtcaaccagcctgaacaacgaatcggccagtgcacaggatgtcaccttgagtgcatcagtggcggggtgagattgattaccctgacgagcgagctaaagtccgccactgtttgtgcttctcatttttgctcgagcgccacctccggaaagaaatcaacagaaatacagttccacagtggttctctcgtgggcaagactgcgatccacgtcaaaggggcactggtggatggaaccgagttcacatttgaaggcagctgtatgttcccagacggttgcgatgccgtagactgcaccttttgtagggagttccttaagaatccccaatgctatccggctaaaaagtggctgtttattatcatagttattttgctcgggtacgccggcctgatgttactgacgaacgtgctcaaggcaatcggagtctggggctcctgggtgatcgctcctgtcaaacttgtgttcgccattatcaagaaactgatgcgggcggtttcatgtttgatggggaagctaatggatcgtggacgccaggtgattcatgaagagataggtgagaatagagaaggcaaccaggacgatgtaaggatcgagatggcccggccccgacgcgtcagacactggatgtatagcccagtgattctgactatcctcgcaatcgggctggctgaaggatgcgacgagatggttcatgccgattctaaacttgtgtcctgtaggcagggcagtggtaatatgaaggagtgcgtcacaaccgggcgggctctgttgcctgccgtgaaccccggccaagaagcatgtctccactttactgccccaggaagccccgactctaagtgcctgaaaattaaggtaaaacgcataaatttaaagtgtaaaaagtcctcaagttacttcgtgcctgatgctagatcgaggtgcacaagcgttcgtcggtgtcgatgggcgggcgactgccagtccgggtgcccaccgcattttacctctaacagcttctcagacgattgggcaggaaagatggacagagccggcctgggttttagtgggtgttccgatggatgcggcggtgctgcctgtggctgcttcaatgcagccccctcttgtatcttttggaggaaatgggtcgagaaccctcacgggattatctggaaggtgagcccatgcgctgcctgggtgccctccgcagtcattgaactaacgatgccttcaggagaggttcgcaccttccacccaatgagcggcatccccacacaggtgttcaaaggggtgagtgtaacttatctcggatctgacatggaagtctccggcctgaccgatctttgtgagatggaggaattgaaaagcaagaagctggcgctcgctccgtgcaatcaggccggtatgggggtggttggaaaagtgggcgagatacaatgttcgtcagaagagtctgcacggacaatcaagaaggacggttgcatttggaacgccgatctggtcggcatcgaacttagagtggacgatgctgtttgttacagtaaaattacttccgtggaggccgtagcaaaccatagcgctatccctaccacaatagggggactgaggtttgagcgctctcacgacagccagggcaagatttccgggtcaccattggatatcaccgccattcgaggaagtttcagcgtcaattatcggggcctccgtctgtctttatccgaaatcactgcgacgtgcacaggtgaggtgaccaacgtgtcagggtgctacagttgtatgactggagccaaagtcagcataaagctgcattcctctaaaaattcgaccgctcacgttagatgcaagggcgacgaaacagcatttagcgtgctagagggtgtacactcatactccgtgagtctctctttcgatcatgccgtcgtggacgaacagtgtcagctgaactgcggcgggcacgagagcaaggttacccttaggggaaatttgatctttctggacgtgcccaaattcgtcgatggctcctatatgcaaacttaccattcaacagtgcctacgggggctaacattccctctccaaccgactggctcaatgccctgtttggaaacggcttaagccgctggttcctgggtgttatcggggtgcttttgggaggcctcgcactgtttttcctaattatgagtctgtttaagctcggcactaaacaggtcttccggtccagaagcaagctggcgtga

SEQ ID NO: 11515 - RNA, 3222 nt, synthetic construct
  misc_feature 1..3222: note = derived and/or modified CDS sequence (opt3) from SFTSV(NB39/CHN/2014)__KR698342.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctgatattccacatcttctgggttacagcgagaagatctgtcaaatagacagattgatccacgtttcctcttggttaaggaatcattcgcagtttcagggctatgtggggcggcgcggaggccgatcacaggtaagctactatccggcagaaaacagttactcccgttggtctggtctgctaagcccctgcgatgccgactggctcgggatgctggtggtcaaaaaggcgaaaggatccgatatgattgtgcctggcccatcatataagggcaaggttttctttgagagacccacattcgacgggtacgtgggatggggttgtggcagtgggaaaagcaggactgaatctggagagctttgctcctcagatagcggcacgagttctggtctgttgccttccgaccgggtcctctggatcggggatgtggcttgtcaaccaatgacccccattcctgaagagacatttctggagcttaagagcttctcgcagtctgaatttccagacatctgcaaaatagatggaattgtattcaatcagtgtgagtccgaatcactcccgcagccctttgacgttgcctggatggatgtgggccacagtcataagatcattatgcgcgagcacaaaactaagtgggtccaagagagctcctctaaggacttcgtgtgctataaagaaggcaccgggccttgtagcgagtcagaagagaagacatgcaaaaccagtggatcctgcagaggtgacatgcagttttgtaaggtggcaggctgcgaacacggggaggaggccagcgaagctaaatgtaggtgctctttagtccataagccaggagaggttgtggtatcatacggcggtatgcgggtgcgccccaaatgttacgggttcagtcgaatgatggcaactctggaagtcaaccctccagagcagagaatcggccagtgcacaggatgtcaccttgaatgcgtgaatggcggggttaggttgatcaccctgacgagcgagctaaagtccgccactgtgtgtgcttctcatttttgctcgagcgccacctccggaaagaaatcaacagagattcaattccacagtggttctctcgtcggcaagactgcgatacacgtgaaaggggcactggtagatggaaccgaatttacatttgagggcagctgtatgttccccgacggttgcgatgccgttgactgcaccttttgtcgggagttccttaagaacccgcagtgctatcctgctaaaaagtggctgtttatcattatcgtgatattgctcgggtacgccggcctgatgttactgacgaatgtcctcaaggcaattggagtgtggggctcctgggtcatcgctcccgtgaaacttatgttcgccatcattaagaaactgatgcgttcagttagctgtttgatggggaagctaatggatcgcggaagacaggtgatccatgaagaaattggtgagaacagggagggcaatcaagacgatgtacggatagaaatggcgcgaccacgcagagtcaggcactggatgtattctcctgtgatcctgactattctcgccgttgggctggcagagggatgcgacgaaatggtgcatgctgattccaaacttgtcagttgtaagcagggcagcggtaacatgaaggagtgcgtgacaaccgggcgggccctgttgcccgctgtaaatccaggccaggaggcctgtctccactttactgcacccggatctcctgacctgaaatgcttaaagatcaaagtgaagaaaatcaacctgaagtgtaagaaatcctcaagttacttcgttccagatgcccgcagcagatgcacatcggtcaggcgttgtcggtgggctggcgactgccagtccgggtgcccgtctcattttaccagcaattcattcagtgacgattgggcgggaaagatggaccgagcaggcctaggtttttccgggtgttctgatggatgcggcggtgccgcttgtggctgcttcaacgccgcacccagctgtattttctggagaaaatgggtggaaaatcctcacgggataatctggaaggtgtccccatgcgccgcttgggtcccctcagccgttattgagctcacgatgcctagcggagaagtgaggaccttccacccaatgagtggcatccccacacaagtgttcaaaggggtatctgtcacttatctgggatccgacatggaggtgagcggccttaccgatttgtgtgaaattgaggagctgaagtcgaaaaagctcgcactggcgccgtgcaaccaggctggtatgggggttgtgggaaaggtcggcgaaatccagtgttcatctgaggaaagtgcccgcacaataaagaaggacggttgcatctggaacgcagatcttgtgggcattgagctgcgggttgacgatgccgtgtgttactccaaaatcactagcgtagaagctgtcgccaattattctgcaattcctaccacaatcgggggattgagatttgagaggagccatgactcccagggcaagatatcagggagtccactcgatattaccgctatccgcggcagcttctctgtgaactaccgaggactgcggttatccctgtcagagattactgccacgtgcacaggtgaagtgaccaatgtcagtgggtgctacagctgtatgactggagcgaaagtttccatcaagctacactctaacaaaaattcgaccgcccatgtgcgttgcaaaggcgacgagacagcttttagcgtactcgaaggtgtgcactcatataccgtctccctgagtttcgatcacgcagtggttgacgagcaatgtcagcttaactgcggcgggcatgaatctcaggtgactttgaagggaaatctgatatttctcgacgtccccaaattcgtggatggcagctacatgcagacatatcactcctcagttcctacgggggccaacatcccctctccaaccgactggctgaatgctttatttggaaacggcctgagcagatggattcttggtgtgatcggggtcttgctcggaggcctggccctattctttctgattatgagtctcttcaagctgggcactaaacaagtatttaggtcccgcacaaagctggcatga

SEQ ID NO: 11516 - RNA, 3222 nt, synthetic construct
  misc_feature 1..3222: note = derived and/or modified CDS sequence (opt3) from SFTSV(QD7)__KR706566.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgaggatccggcccaaatgttacggctttagtcgcatgatggcaaccttagaagtgaaccagcctgagcaacgaatcggacagtgcactggctgtcacctggaatgcattaatgggggagtcagacttataacattgaccagcgagctgaagtccgccacggtgtgtgcttctcatttctgctcgagcgccacttccggtaagaaatcaaccgagatccagttccacagtggctctctagttgggaagacagcgattcacgtgaaaggagcactcgtcgatggcactgaatttaccttcgagggtagctgtatgtttccagacgggtgcgatgccgtggactgcacattctgtagggaatttctgaagaacccccaatgctatccggctaaaaagtggcttttcatcataattgtaatcctgttgggctacgccggactcatgctgttaaccaatgttctgaaggcaatcggcatttgggggtcctgggtgatcgctcctgtcaaactcatgtttgccattataaagaaacttatgcggacgatgtcatgtctgatgggaaagttgatggatcgtggtcgccaggtgatccatgaggaaattggcgagaacagagaggggaatcaggacgatgtcaggatcgaaatggcgcggccccgacgcgtgagacactggatgtatagcccagttatcctaactttcctggccattggactcgcagagtcttgcgacgaaatggtgcatgctgattccaaactggccagttgtaggcagggcagcggtaacatgaaggagtgcgtaacaaccgggcgggcccttcaccctgctgtcaatcccggccaagaggcatgtctgcattttactgccccaggatctcccgactccaagtgcttgaaaataaaggtgaaacgcatcaacctcaagtgtaaaaagtcaagtagctacttcgttcctgatgctagatcgaggtgcacatccgtgcgtcggtgtcgatgggcgggcgactgccagtctgggtgcccaccgcactttaccagcaattcattcagtgacgattgggcaggaaagatggacagagccggcctgggtttttccgggtgttctgatggatgcggcggtgctgcctgtggctgcttcaacgcagcccccagctgtattttctggaggaaatgggtcgaaaatcctcacgggatcatttggaaggtgtccccatgcgctgcctgggtaccctcagcagtgatcgagttaacgatgcctagcggagaagttcgcacctttcatccaatgagtggcatacccacacaggtcttcaaaggggtgtctgtgacttatctgggatccgacatggaggtcagcggcctaaccgatctctgtgaaatcgaggagctgaagtcgaaaaagttggcgcttgctccgtgcaaccaggccggtatgggggttgtgggaaaagtgggcgaaattcaatgttcatctgaggaaagtgcacggacaatcaagaaggacggttgcatttggaacgccgatctggtaggcatcgagctcagagtcgacgatgctgtgtgttactccaaaataactagcgttgaagccgtggcaaattattctgctattcctaccacaatcgggggactgaggtttgagcgcagccacgactcccagggcaagatttcagggagtccacttgatatcaccgccatacgaggcagcttctctgtcaactaccggggactgcgtttgtccctctcagagatcactgcgacgtgcacaggtgaagtgaccaatgttagtgggtgctacagctgtatgactggagccaaagtgtccattaagctgcattcttcgaaaaacagcaccgctcacgtaagatgcaagggcgacgagacagcattttcagtcttagaaggtgtgcactcctataccgtgagtctgtctttcgatcatgccgtcgttgacgagcagtgtcagctaaattgcggcgggcacgaaagccaagtgactctcaagggaaacctgatctttcttgacgtacccaaattcgtggatggctcctacatgcagacatatcattcaacggtccctaccggggctaatattccctctccaactgactggttgaacgccctgtttggaaatggcctcagtaggtggatcctgggtgtgataggggttttactgggaggccttgcattgttctttatgattatgagcctcttcaagctgggcacaaaacaggtgtttcgctcccggaccaagctagcgtga

SEQ ID NO: 11517 - RNA, 3222 nt, synthetic construct
  misc_feature 1..3222: note = derived and/or modified CDS sequence (opt3) from SFTSV(Rodent01/NB/CHN/2014)__KR698343.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctgatattccacatcttctgggttacagcgagaagatctgtcaaatagacagattgatccacgtttcctcttggttaaggaatcattcgcagtttcagggctatgtggggcggcgcggaggccgatcacaggtaagctactatccggcagaaaacagttactcccgttggtctggtctgctaagcccctgcgatgccgactggctcgggatgctggtggtcaaaaaggcgaaaggatccgatatgattgtgcctggcccatcatataagggcaaggttttctttgagagacccacattcgacgggtacgtgggatggggttgtggcagtgggaaaagcaggactgaatctggagagctttgctcctcagatagcggcacgagttctggtctgttgccttccgaccgggtcctctggatcggggatgtggcttgtcaaccaatgacccccattcctgaagagacatttctggagcttaagagcttctcgcagtctgaatttccagacatctgcaaaatagatggaattgtattcaatcagtgtgagtccgaatcactcccgcagccctttgacgttgcctggatggatgtgggccacagtcataagatcattatgcgcgagcacaaaactaagtgggtccaagagagctcctctaaggacttcgtgtgctataaagaaggcaccgggccttgtagcgagtcagaagagaagacatgcaaaaccagtggatcctgcagaggtgacatgcagttttgtaaggtggcaggctgcgaacacggggaggaggccagcgaagctaaatgtaggtgctctttagtccataagccaggagaggttgtggtatcatacggcggtatgcgggtgcgccccaaatgttacgggttcagtcgaatgatggcaactctggaagtcaaccctccagagcagagaatcggccagtgcacaggatgtcaccttgaatgcgtgaatggcggggttaggttgatcaccctgacgagcgagctaaagtccgccactgtgtgtgcttctcatttttgctcgagcgccacctccggaaagaaatcaacagagattcaattccacagtggttctctcgtcggcaagactgcgatacacgtgaaaggggcactggtagatggaaccgaatttacatttgagggcagctgtatgttccccgacggttgcgatgccgttgactgcaccttttgtcgggagttccttaagaacccgcagtgctatcctgctaaaaagtggctgtttatcattatcgtgatattgctcgggtacgccggcctgatgttactgacgaatgtcctcaaggcaattggagtgtggggctcctgggtcatcgctcccgtgaaacttatgttcgccatcattaagaaactgatgcgttcagttagctgtttgatggggaagctaatggatcgcggaagacaggtgatccatgaagaaattggtgagaacagggagggcaatcaagacgatgtacggatagaaatggcgcgaccacgcagagtcaggcactggatgtattctcctgtgatcctgactattctcgccgttgggctggcagagggatgcgacgaaatggtgcatgctgattccaaacttgtcagttgtaagcagggcagcggtaacatgaaggagtgcgtgacaaccgggcgggccctgttgcccgctgtaaatccaggccaggaggcctgtctccactttactgcacccggatctcctgacctgaaatgcttaaagatcaaagtgaagaaaatcaacctgaagtgtaagaaatcctcaagttacttcgttccagatgcccgcagcagatgcacatcggtcaggcgttgtcggtgggctggcgactgccagtccgggtgcccgtctcattttaccagcaattcattcagtgacgattgggcgggaaagatggaccgagcaggcctaggtttttccgggtgttctgatggatgcggcggtgccgcttgtggctgcttcaacgccgcacccagctgtattttctggagaaaatgggtggaaaatcctcacgggataatctggaaggtgtccccatgcgccgcttgggtcccctcagccgttattgagctcacgatgcctagcggagaagtgaggaccttccacccaatgagtggcatccccacacaagtgttcaaaggggtatctgtcacttatctgggatccgacatggaggtgagcggccttaccgatttgtgtgaaattgaggagctgaagtcgaaaaagctcgcactggcgccgtgcaaccaggctggtatgggggttgtgggaaaggtcggcgaaatccagtgttcatctgaggaaagtgcccgcacaataaagaaggacggttgcatctggaacgcagatcttgtgggcattgagctgcgggttgacgatgccgtgtgttactccaaaatcactagcgtagaagctgtcgccaattattctgcaattcctaccacaatcgggggattgagatttgagaggagccatgactcccagggcaagatatcagggagtccactcgatattaccgctatccgcggcagcttctctgtgaactaccgaggactgcggttatccctgtcagagattactgccacgtgcacaggtgaagtgaccaatgtcagtgggtgctacagctgtatgatcggagcgaaagtttccataaagctacactctaacaaaaattcgactgcccatgtgcgttgcaaaggcgacgagaccgcttttagcgtactcgaaggtgtgcactcatatacagtctccctgagtttcgatcacgcagtggttgacgagcaatgtcagcttaactgcggcgggcatgaatctcaggtgaccttgaagggaaatctgatctttctcgacgtccccaaattcgtggatggcagctacatgcagacttatcactcctcagttcctacaggggccaacattccctctccaacggactggctgaatgctttatttggaaacggcctgagcagatggatccttggtgtgattggggtcttgctcggaggcctggccctattctttctgatcatgagtctcttcaagctgggcaccaaacaagtatttaggtcccgcactaagctggcatga

SEQ ID NO: 11518 - RNA, 3222 nt, synthetic construct
  misc_feature 1..3222: note = derived and/or modified CDS sequence (opt3) from SFTSV(SDLZtick12/2010)__JQ684872.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgaggatccggcccaaatgttacggctttagtcgcatgatggcaaccttagaagtgaaccagcctgagcaacgaatcggacagtgcactggctgtcacctggaatgcattaatgggggagtcagacttataacattgaccagcgagctgaagtccgccacggtgtgtgcttctcatttctgctcgagcgccacttccggtaagaaatcaaccgagatccagttccacagtggctctctagttgggaagacagcgattcacgtgaaaggagcactcgtcgatggcactgaatttaccttcgagggtagctgtatgtttccagacgggtgcgatgccgtggactgcacattctgtagggaatttctgaagaacccccaatgctatccggctaaaaagtggcttttcatcataattgtaatcctgttgggctacgccggactcatgctgttaaccaatgttctgaaggcaatcggcatttgggggtcctgggtgatcgctcctgtcaaactcatgtttgccattataaagaaacttatgcggacggtgtcatgtctgatgggaaagttgatggatcgtggtcgccaggtcatccatgaggaaattggcgagaacagagaggggaatcaggacgatgtgaggatcgaaatggcgcggccccgacgcgttagacactggatgtatagcccagtgatcctaactttcctggccattggactcgcagagtcttgcgacgaaatggtacatgctgattccaaactggtcagttgtaggcagggcagcggtaacatgaaggagtgcgtgacaaccgggcgggcccttctgcctgctgttaatcccggccaagaggcctgtttgcactttactgcaccaggatctcccgactccaagtgcctcaaaataaaggtgaaacgcatcaacctgaagtgtaaaaagtcaagtagctacttcgtccctgatgccagatcgaggtgcacatccgtgcgtcggtgtcgatgggctggcgactgccagtctgggtgcccaccgcattttaccagcaattcattcagtgacgattgggcgggaaagatggacagagcaggcttaggtttttccgggtgttctgatggatgcggcggtgccgcttgtggctgcttcaacgccgcacccagctgtattttctggaggaaatgggtagaaaatcctcacgggatcatttggaaggtgtccccatgcgccgcttgggttccctcagccgtcatcgagctgacgatgcctagcggagaagtgcgcacctttcacccaatgagtggcatacccacacaggtgttcaaaggggtctctgttacttatctaggatccgacatggaggtgagcggcctcaccgatctgtgtgaaatcgaggagcttaagtcgaaaaagttggcactggcgccgtgcaaccaggctggtatgggggtggtaggaaaagtcggcgaaattcaatgttcatctgaggaaagtgcccggacaatcaagaaggacggttgcatttggaacgcagatctcgtgggcatcgagctgagagttgacgatgccgtgtgttactccaaaataactagcgtcgaagctgtggccaattattctgcaattcctaccacaatcgggggacttaggtttgagcgcagccatgactcccagggcaagatttcagggagtccactggatatcaccgctatacgaggcagcttctctgttaactaccggggattgcgtctctccctgtcagagatcactgccacgtgcacaggtgaagtgaccaatgtaagtgggtgctacagctgtatgactggagcgaaagtctccattaagttacactcttcgaaaaacagcaccgcccatgtgagatgcaagggcgacgagacagctttttcagtgctggaaggtgtccactcctataccgttagtctatctttcgatcacgcagtggtagacgagcagtgtcagctcaattgcggcgggcatgaaagccaagtgactctgaagggaaaccttatctttttggacgtccccaaattcgtggatggctcctacatgcagacatatcactcaacggttcctaccggggccaatattccctctccaactgactggctgaacgctctctttggaaatggcctgagtaggtggatcttaggtgtgataggggtcctgcttggaggcttggccctcttctttatgattatgagcctgttcaagctaggcacaaaacaggtgtttcgctcccggaccaagctggcatga

SEQ ID NO: 11519 - RNA, 3222 nt, synthetic construct
  misc_feature 1..3222: note = derived and/or modified CDS sequence (opt3) from SFTSV(Zhao)__KF374684.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctactatccggcagaaaatagttactcccgatggtctggtctgctaagcccctgcgacgccgattggctcgggatgctggtggtcaaaaaggcgaaaggatccgacatgattgtgcctggcccatcatataagggcaaggttttctttgagcgtcccacattcgatgggtacgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacatttctggagctcaagagcttctcgcagtctgaatttccagatatctgcaaaatagacggaattgtattcaaccagtgtgagtccgaatcactgccgcaaccctttgatgttgcctggatggacgtgggccacagtcataagatcattatgcgggagcacaaaactaagtgggtccaggagagctcctctaaggatttcgtgtgctataaagaaggcaccgggccttgtagcgagtcagaagagaagacatgcaaaaccagtggatcctgccgcggtgacatgcagttttgtaaggtggcaggctgcgaacacggggaggaggccagcgaagctaaatgtagatgctctttagtccataagccaggagaggttgtggtatcatacggcggtatgagggtgcggcccaaatgttacgggttcagtcgcatgatggcaactctggaagtcaatcctccagagcagcgaatcggccaatgcacaggatgtcaccttgaatgcatcaacggcggggtgagattggttaccctgacgagcgagctaaagtccgccactgtgtgtgcttctcatttttgctcgagcgccacctccggaaagaaatcaacagagattcagttccacagtggttctctcgtcggcaaggcggcaatacacgtgaaaggggccctggtagacggaactgagttcacctttgaaggcagctgtatgttccccgatggttgcgacgctgttgattgcacattttgtagggagttccttaagaatccgcagtgctatcctgccaaaaagtggctgtttatcattatcgtgatattgctcgggtacgcaggcctgatgttactgaccaacgtcctcaaggctattggagtgtggggctcctgggtcatcgcccccgtgaaacttatgttcgcgatcattaagaaactgatgcggtcagttagctgtttgatggggaagctaatggaccgtggacgccaagtgatccatgaagaaattggtgagaatagagagggcaaccaggatgacgtaaggatagaaatggtccggccacgacgcgtgagacactggatgtattctcctgttatcctgacgattctcgccatcgggctgactgagggatgcgatgaaatggtgcatgcagactccaaacttgtcagttgtaggcagggcagcggtaatatgaaggagtgcgtgacaaccgggcgggctctgttgcccgccgtaaacccaggccaggaggcttgtctccactttactgcccccggatctcctgattccaagtgcctgaaaatcaaggtgaaacgcattaatttaaagtgtaaaaagtcaagtagctacttcgttccagacgcaagatcgaggtgcacatccgtccgtcggtgtcgatgggccggcgattgccaatctgggtgcccgagccattttacctcaaacagtttctccgacgactgggctggaaagatggatagagcgggcctgggtttttctgggtgtagcgacggatgcggcggtgcagcctgtggctgcttcaatgctgccccctcctgtatattttggaggaaatgggtggaaaaccctcacgggatcatttggaaggtgtcaccatgcgcagcctgggtccccagcgctgttatcgagctaacgatgcctagtggagaagtgcgcaccttccacccaatgtctggcattcccacacaggtgttcaaaggggtatccgtcacttatctcggaagcgatatggaggtgtcgggcctgaccgacctttgtgaaatcgaggagttgaagtctaaaaagctggccctcgcaccgtgcaaccaggcgggtatgggggttgtgggaaaagtcggcgaaatacagtgttcaagtgaggaatccgctcggacaatcaagaaggatggttgcatttggaatgccgacctggtgggcatcgagcttagagttgatgacgcagtgtgttacagcaaaattacttctgtagaagccgtcgctaactatagcgccatccctaccacaatagggggactgaggtttgagcgctcccatgattcacaaggcaaggtgagtgggagcccattggacattaccgcaatccgaggatctttctccgtgaattaccggggcctccgtctgtcattaagtgagattactgctacgtgcacaggtgaagtcaccaacgttagcgggtgctactcctgtatgactggagccaaagtgtctatcaagctgcactcgagcaaaaattcaaccgcgcatgtaagatgcaagggcgatgagacagccttttccgtgctagaaggtgtccacagttataccgtgtctctcagcttcgaccacgctgttgtggatgagcagtgtcagctgaactgcggcgggcatgaatcccaggtcactcttaagggaaatttgatatttctggacgtgcccaaattcgttgacggctcatacatgcaaacatatcactctagcgtgcctacgggggcaaacatccccagtccaaccgattggctcaatgccctgtttggaaacggcttatccaggtggattctgggtgtcatcggggtacttttgggaggcctcgctctgttctttctaattatgagcctgttcaagctcggcactaaacaggtgtttcgctctcggacaaagctggcctga

SEQ ID NO: 11520 - RNA, 3222 nt, synthetic construct
  misc_feature 1..3222: note = derived and/or modified CDS sequence (opt3) from SFTSV(Zhejiang/01/2011)__KJ597824.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctactatccggcagaaaatagttactcccgatggtctggtctgctaagcccctgcgacgccgattggctcgggatgctggtggtcaaaaaggcgaaaggatccgacatgattgtgcctggcccatcatataagggcaaggttttctttgagcgtcccacattcgatgggtacgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacatttctggagctcaagagcttctcgcagtctgaatttccagatatctgcaaaatagacggaattgtattcaaccagtgtgagtccgaatcactgccgcaaccctttgatgttgcctggatggacgtgggccacagtcataagatcattatgcgggagcacaaaactaagtgggtccaggagagctcctctaaggatttcgtgtgctataaagaaggcaccgggccttgtagcgagtcagaagagaagacatgcaaaaccagtggatcctgccgcggtgacatgcagttttgtaaggtggcaggctgcgaacacggggaggaggccagcgaagctaaatgtagatgctctttagtccataagccaggagaggttgtggtatcatacggcggtatgagggtgcggcccaaatgttacgggttcagtcgcatgatggcaactctggaagtcaatcctccagagcagcgaatcggccaatgcacaggatgtcaccttgaatgcatcaacggcggggtgagattggttaccctgacgagcgagctaaagtccgccactgtgtgtgcttctcatttttgctcgagcgccacctccggaaagaaatcaacagagattcagttccacagtggttctctcgtcggcaaggcggcaatacacgtgaaaggggccctggtagacggaactgagttcacctttgaaggcagctgtatgttccccgatggttgcgacgctgttgattgcacattttgtagggagttccttaagaatccgcagtgctatcctgccaaaaagtggctgtttatcattatcgtgatattgctcgggtacgcaggcctgatgttactgaccaacgtcctcaaggctattggagtgtggggctcctgggtcatcgcccccgtgaaacttatgttcgcgatcattaagaaactgatgcggtcagttagctgtttgatggggaagctaatggaccgtggacgccaagtgatccatgaagaaattggtgagaatagagagggcaaccaggatgacgtaaggatagaaatggtccggccacgacgcgtgagacactggatgtattctcctgttatcctgacgattctcgccatcgggctgactgagggatgcgatgaaatggtgcatgcagactccaaacttgtcagttgtaggcagggcagcggtaatatgaaggagtgcgtgacaaccgggcgggctctgttgcccgccgtaaacccaggccaggaggcttgtctccactttactgcccccggatctcctgattccaagtgcctgaaaatcaaggtgaaacgcattaatttaaagtgtaaaaagtcaagtagctacttcgttccagacgcaagatcgaggtgcacatccgtccgtcggtgtcgatgggccggcgattgccaatctgggtgcccgagccattttacctcaaacagtttctccgacgactgggctggaaagatggatagagcgggcctgggtttttctgggtgtagcgacggatgcggcggtgcagcctgtggctgcttcaatgctgccccctcctgtatattttggaggaaatgggtggaaaaccctcacgggatcatttggaaggtgtcaccatgcgcagcctgggtccccagcgctgttatcgagctaacgatgcctagtggagaagtgcgcaccttccacccaatgtctggcattcccacacaggtgttcaaaggggtatccgtcacttatctcggaagcgatatggaggtgtcgggcctgaccgacctttgtgaaatcgaggagttgaagtctaaaaagctggccctcgcaccgtgcaaccaggcgggtatgggggttgtgggaaaagtcggcgaaatacagtgttcaagtgaggaatccgctcggacaatcaagaaggatggttgcatttggaatgccgacctggtgggcatcgagcttagagttgatgacgcagtgtgttacagcaaaattacttctgtagaagccgtcgctaactatagcgccatccctaccacaatagggggactgaggtttgagcgctcccatgattcacaaggcaagattagtgggagcccattggacatcaccgcaattcgaggatctttctccgtgaattaccggggcctccgtctgtcattaagtgagatcactgctacgtgcacaggtgaagtgaccaacgtcagcgggtgctactcctgtatgactggagccaaagtttctataaagctgcactcgagcaaaaattcaaccgcgcatgtgagatgcaagggcgatgagacagccttttccgtactagaaggtgtgcacagttataccgtctctctcagcttcgaccacgctgtggttgatgagcagtgtcagctgaactgcggcgggcatgaatcccaggtgactcttaagggaaatttgatctttctggacgtccccaaattcgtggacggctcatacatgcaaacatatcactctagcgttcctacgggggcaaacattcccagtccaaccgattggctcaatgccctgtttggaaacggcttatccaggtggatcctgggtgtgattggggtccttttgggaggcctcgctctgttctttctaatcatgagcctgttcaagctcggcactaaacaggtatttcgctctcggacaaagctggcctga

SEQ ID NO: 11521 - RNA, 3222 nt, synthetic construct
  misc_feature 1..3222: note = derived and/or modified CDS sequence (opt3) from SFTSV(ZJ2013-06)__KP280204.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctgatattccacatcttctgggttacagcgagaagatctgtcaaatagacagattgatccacgtttcctcttggttaaggaatcattcgcagtttcagggctatgtggggcagcggggaggccgctcacaagtaagctactatccggcagaaaacagttactcccgatggtctggtctgctaagcccctgcgatgccgactggctcgggatgctggtggtcaaaaaggcgaaaggatccgatatgattgtgcctggcccatcatataagggcaaggttttctttgagcgtcccacattcgacgggtacgtgggatggggttgtggcagtgggaaaagcagaactgaatctggagagctttgctcctcagatagcggcacgagttctggtctgttgccttccgacagggtcctctggatcggggatgtggcttgtcagccaatgacccccattcctgaagagacatttctggagctcaagagcttctcgcagtctgaatttccagacatctgcaaaatagatggaattgtattcaatcagtgtgagtccgaatcactgccgcaaccctttgacgttgcctggatggatgtgggccacagtcataagatcattatgcgggagcacaaaactaagtgggtccaggagagctcctctaaggacttcgtgtgctataaagaaggcaccgggccttgtagcgagtcagaagagaagacatgcaaaaccagtggatcctgccgcggtgacatgcagttttgtaaggtggcaggctgcgaacacggggaggaggccagcgaagctaaatgtagatgctctttagtccataagccaggagaggttgtggtatcatacggcggtatgagggtgcggcccaaatgttacgggttcagtcgcatgatggcaactctggaagtcaaccctccagagcagcgaatcggccaatgcacaggatgtcaccttgaatgcgtgaatggcggggttagattgatcaccctgacgagcgagctaaagtccgccactgtgtgtgcttctcatttttgctcgagcgccacctccggaaagaaatcaacagagattcagttccacagtggttctctcgtcggcaagactgcgatacacgtgaaaggggcactggtagatggaaccgagttcacatttgaaggcagctgtatgttccccgacggttgcgatgccgttgactgcaccttttgtagggagttccttaagaacccgcagtgctatcctgctaaaaagtggctgtttatcaatattgtgatcttgctcgggtacgccggcctgatgttactgacgaacgtcctcaaggcaataggagtgtggggctcctgggtcattgctcccgtgaaacttatgttcgccatcatcaagaaactgatgcggtcagttagctgtttgatggggaagctaatggatcgtggacgccaagtgattcatgaagaaatcggtgagaatagagagggcaaccaggacgatgtaaggattgaaatggcgcggccacgacgcgtcagacactggatgtattctcctgtgatactgactatcctcgccgttgggctggcagagggatgcgacgaaatggtgcatgctgattccaaacttgtcagttgtaagcagggcagcggtaatatgaaggagtgcgtgacaaccgggagggccctgttgcccgctgtaaacccaggccaggaggcctgtctccactttactgcacccggatctcctgactccaaatgcctgaagattaaagtgaagaaaatcaatttaaagtgtaagaaatcaagtagctacttcgttccagatgcccggtcgcgctgcacatccgtcagaaggtgtcgttgggctggcgactgccaatctgggtgcccgagccattttacctcaaacagtttctccgacgattgggcgggaaagatggaccgggcaggcctgggtttttctgggtgtagcgatggatgcggcggtgccgcttgtggctgcttcaatgccgcaccctcctgtatcttttggcgaaaatgggtggaaaaccctcacgggattatatggaaggtgtcaccatgcgccgcttgggtccccagcgccgttatcgagctaacgatgcctagtggagaagtgagaaccttccacccaatgtctggcattcccacacaggtgttcaaaggggtatccgtcacttatctcggaagcgacatggaggtgtcgggcctgaccgatctttgtgaaatcgaggagttgaagtctaaaaagctggcactcgcgccgtgcaaccaggctggtatgggggttgtgggaaaggtcggcgaaattcagtgttcaagtgaggaatccgccaggacaatcaaaaaggacggttgcatatggaatgcagatctggtgggcatcgagcttcgcgttgacgatgccgtgtgttacagcaaaattacttctgtagaagctgtcgccaactatagcgcaatccctaccacaattgggggactgcggtttgagagatcccatgactcacaaggcaagatcagtgggagcccattggatataaccgctattaggggatctttctccgtgaattaccgcggcctccgactgtcattaagtgagatcactgccacgtgcacaggtgaagtgaccaacgtcagcgggtgctactcctgtatgactggagcgaaagtttctattaagctgcactcgaataagaacagcaccgcccatgtgcggtgcaaaggcgacgagacagctttttcagtactagaaggtgtgcactcctataccgtcagtctctctttcgatcacgcagtggttgacgagcagtgtcagctgaattgcggcgggcatgaaagccaggtgactcttaagggaaacttgatctttctggacgtccccaaattcgtggatggctcctacatgcaaacatatcactcatctgttcctacgggggccaatatacccagcccaaccgactggctcaacgctctgtttggaaatggcttaagtcgttggatcctgggtgtgattggggtccttttgggaggcctcgccctgttctttctaatcatgtccctgttcaagctcggcactaaacaggtatttagaagcaggacaaagctggcatga

SEQ ID NO: 11522 - RNA, 3222 nt, synthetic construct
  misc_feature 1..3222: note = derived and/or modified CDS sequence (opt3) from SFTSV(ZJZHSH-AM/China/05/2012)__KR017846.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctactatccggcagaaaatagttactcccgatggtctggtctgctaagcccctgcgacgccgattggctcgggatgctggtggtcaaaaaggcgaaaggatccgacatgattgtgcctggcccatcatataagggcaaggttttctttgagcgtcccacattcgatgggtacgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacatttctggagctcaagagcttctcgcagtctgaatttccagatatctgcaaaatagacggaattgtattcaaccagtgtgagtccgaatcactgccgcaaccctttgatgttgcctggatggacgtgggccacagtcataagatcattatgcgggagcacaaaactaagtgggtccaggagagctcctctaaggatttcgtgtgctataaagaaggcaccgggccttgtagcgagtcagaagagaagacatgcaaaaccagtggatcctgccgcggtgacatccagttttgtaaggtggcaggctgcgaacacggggaggaggccagcgaagctaaatgtagatgctctttagtccataagccaggagaggttgtggtatcatacggcggtatgagggtgcggcccaaatgttacgggttcagtcgcatgatggcaactctggaagtcaatcctccagagcagcgaatcggccaatgcacaggatgtcaccttgaatgcattaacggcggggtgagattgataaccctgacgagcgagctaaagtccgccactgtttgtgcttctcatttttgctcgagcgccacctccggaaagaaatcaacagagatccagttccacagtggttctctcgtgggcaaggcggcaattcacgtcaaaggggccctggtggacggaactgaatttacctttgagggcagctgtatgttccccgatggttgcgacgctgtagattgcacattttgtagggagttccttaagaatccgcagtgctatcctgccaaaaagtggctgtttatcataattgttatcttgctcgggtacgcaggcctgatgttactgaccaacgtgctcaaggctatcggagtctggggctcctgggtgattgcccccgtcaaacttatgttcgcgatcattaagaaactgatgcggtcagtgagctgtttgatggggaagctaatggaccgtggacgccaagttatacatgaagaaatcggtgagaatagagagggcaaccaggatgacgtgaggattgaaatggtacggccacgacgcgtcagacactggatgtattctcctgtgatcctgacgatcctcgccattgggctgactgagggatgcgatgaaatggttcatgcagactccaaacttgtgagttgtaggcagggcagcggtaatatgaaggagtgcgtcacaaccgggcgggctctgttgcccgccgtgaacccaggccaggaggcttgtctccactttactgcccccggatctcctgattccaagtgcctgaaaataaaggtaaaacgcatcaatttaaagtgtaaaaagtcaagtagctacttcgtgccagacgcaagatcgaggtgcacatccgttcgtcggtgtcgatgggccggcgattgccaatctgggtgcccgagccattttacctcaaacagtttctccgacgactgggctggaaagatggatagagcgggcctgggtttttctgggtgtagcgacggatgcggcggtgcagcctgtggctgcttcaatgctgccccctcctgtattttctggaggaaatgggtcgaaaaccctcacgggatcatttggaaggtgtcaccatgcgcagcctgggtgcccagcgctgtcatcgagctaacgatgcctagtggagaagttcgcaccttccacccaatgtctggcatacccacacaggtgttcaaaggggtgtccgtaacttatctcggaagcgatatggaggtctcgggcctgaccgacctttgtgaaatcgaggagttgaagtctaaaaagctggccctcgcaccgtgcaaccaggcgggtatgggggtggttggaaaagtgggcgaaattcagtgttcaagtgaggaatccgctcggacaatcaagaaggatggttgcatttggaatgccgacctggtcggcatcgagcttagagtggatgacgcagtttgttacagcaaaataacttctgtggaagccgtagctaactatagcgccattcctaccacaatcgggggactgaggtttgagcgctcccatgattcacaaggcaagattagtgggagcccattggacatcaccgcaatacgaggatctttctccgtcaattaccggggcctccgtctgtcattaagtgagatcactgctacgtgcacaggtgaagtgaccaacgtgagcgggtgctactcctgtatgactggagccaaagtctctattaagctgcactcgagcaaaaattcaaccgcgcatgttagatgcaagggcgatgagacagccttttccgtgctagaaggtgtacacagttataccgtgtctctcagcttcgaccacgctgtcgtggatgagcagtgtcagctgaactgcggcgggcatgaatcccaggttactcttaagggaaatttgatctttctggacgtgcccaaattcgtcgacggctcatacatgcaaacatatcactctagcgtgcctacgggggcaaacattcccagtccaaccgattggctcaatgccctgtttggaaacggcttatccaggtggatcctgggtgttataggggtgcttttgggaggcctcgctctgttctttctaattatgagcctgttcaagctcggcactaaacaggtctttcgctctcggacaaagctggcctga

SEQ ID NO: 11523 - RNA, 3222 nt, synthetic construct
  misc_feature 1..3222: note = derived and/or modified CDS sequence (opt3) from SFTSV(ZJZHSH-CXD/China/05/2012)__KR017858.1__GP
  source 1..3222: mol_type = other RNA
atgatgaaggtgatctggttcagctccctgatttgcctcgtcatacagtgtggcggggacaccggacccatcatttgcgccggtcctatccactctaacaaatcagctggcattccacatcttctggggtacagtgagaagatctgtcaaatagatagattgatccacgttagctcctggttaaggaatcattctcagtttcagggatatgtgggccagcggggtgggcgctcgcaagtatcatactatccggcagaaaacagctacagtcgatggtccggactgctatctccctgcgacgccgattggctcggcatgctggtggtcaaaaaggcgaaaggcagcgacatgattgtgcctgggccatcctataagggaaaggttttctttgagcgtcccacattcgatggttacgtgggctgggggtgtggatcaggcaaaagtagaactgaaagcggtgagctttgcagctccgactcagggacgagcagtggactgttgccttctgatagggtcctctggatcggcgacgtggcttgtcagccaatgacccccattcctgaagagacatttctggagctgaagtccttcagccagtcggaatttccagatgtatgcaaaatcgacggcatagttttcaatcagtgtgagggggaatctctcccgcaaccctttgatgtggcctggatggacgtcggacactcccataagattatcatgcgggagcacaaaactaagtgggtgcaggagtcaagtagcaaggatttcgtgtgctataaagaaggtaccggcccttgttccgagtctgaagagaagacatgcaaaaccagcgggtcatgccgcggagacatgcagttttgtaaggtcgcaggctgcgaacacggtgaggaggccagtgaagctaaatgtagatgctccttagttcataagccaggggaggtggtagtgagctacggcggaatgagggtccggcccaaatgttacggcttctctcgcatgatggcaactctggaagtgaaccctccagagcagcgaattgggcaatgcacaggatgtcaccttgaatgcatcaatggtggcgttagattgatcaccctgacgtcagagctaaagagtgccactgtgtgtgctagccatttttgctcctctgccacctcggggaagaaaagcacagagattcagttccactccggatcactcgtcggcaagactgcgatacacgtgaaaggtgcactggtagacgggaccgagttcacatttgaaggcagttgtatgttccccgatggatgcgacgccgttgattgcaccttttgtagggagttccttaagaacccgcagtgctatcctgctaaaaagtggctgtttatcattatcgtgatattgctcggctacgccgggctgatgttactgacgaatgtcctcaaggcaattggagtgtggggttcttgggtcatcgctcccgtgaaacttgttttcgccatcattaagaaactgatgcgggcggtgagctgtttgatgggcaagctaatggaccgtgggcgccaagtaatccatgaagaaattggagagaacagagagggcaatcagaacgatgtcaggatagaaatggcccggccacgacgcgtgagacactggatgtattcccctgttatcctgactattctcgcaatcggttttgctgaggggtgcgacgaaatggtgcatgccgattcaaaactggtcagctgtaggcagggctctgagaatatgaaggagtgcgtgacaaccggacgggcccttctgcccgctgtaaacccaggccaggaagcatgtttgcacttcactgcccccgggtcccctgacagtaagtgcctcaaaatcaaggtgaaacgcattaatctgaagtgtaaaaagtcttcttcctactttgttccagatgctagatcaaggtgcacaagtgtccgtcggtgtcgatgggcgggagactgccaaagcggctgcccgccccatttcacctcgaactccttttctgatgactgggcaggtaagatggacagagccgggttaggattcagcggctgttcagatggttgcggcggggctgcctgtggatgctttaatgcagcccctagttgtatattctggaggaaatgggtggagaacccacacggcatcatttggaaggtgtccccctgcgctgcctgggtcccttctgcagttatcgaactgacgatgccaagcggggaggtgcgcaccttccaccccatgtccggcattccgacacaggtgtttaaaggagtatcagtcacttatctaggtagcgacatggaagtgagtgggctcaccgatctgtgtgagatcgaggaacttaagtctaaaaagttggcgctggctccttgcaaccaggccggaatgggcgttgtgggtaaagtcggcgagatacagtgttccagcgaagagtcggcacggacaatcaagaaggacgggtgcatttggaatgccgatctcgtgggaatcgaactgagagttgacgatgctgtgtgttactcaaaaattacttctgtagaggccgtcgcaaactatagtgctatcccaaccacaataggcgggcttaggttcgagcgctcccatgacagccaaggaaagatttctggcagccccctggatatcaccgccattcgaggttccttttcagtgaattaccgggggttgcgtctcagtctgagcgaaatcactgcgacgtgcacaggagaggtgaccaacgtctctggctgctactcctgtatgactggtgccaaagtttcaataaagttacacagtagcaaaaattccaccgctcatgtgagatgcaagggcgacgaaacagcattctctgtactggagggggtgcactcgtatagcgtctcactatcctttgatcacgccgtggttgacgaacagtgtcagctcaactgcggaggccatgagagtcaggtgaccctgagggggaatcttatcttcttggatgtccctaagtttgtggacggatcttacatgcaaacttatcacagcacagttcccacgggcgctaacattccatcccctaccgactggctgaatgccctcttcggtaacgggctgtcacgctggatcttaggagtgattggcgtcctgcttggcgggttggcactctttttcctgatcatgtctctatttaaactgggaactaagcaggtattccggagcagaacaaaactcgcgtga

SEQ ID NO: 11524 - RNA, 3222 nt, synthetic construct
  misc_feature 1..3222: note = derived and/or modified CDS sequence (opt3) from SFTSV(ZJZHSH-FDE/China/06/2012)__KR017859.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctactatccggcagaaaatagttactcccgatggtctggtctgctaagcccctgcgacgccgattggctcgggatgctggtggtcaaaaaggcgaaaggatccgacatgattgtgcctggcccatcatataagggcaaggttttctttgagcgtcccacattcgatgggtacgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacatttctggagctcaagagcttctcgcagtctgaatttccagatatctgcaaaatagacggaattgtattcaaccagtgtgagtccgaatcactgccgcaaccctttgatgttgcctggatggacgtgggccacagtcataagatcattatgcgggagcacaaaactaagtgggtccaggagagctcctctaaggatttcgtgtgctataaagaaggcaccgggccttgtagcgagtcagaagagaagacatgcaaaaccagtggatcctgccgcggtgacatgcagttttgtaaggtggcaggctgcgaacacggggaggaggccagcgaagctaaatgtagatgctctttagtccataagccaggagaggttgtggtatcatacggcggtatgagggtgcggcccaaatgttacgggttcagtcgcatgatggcaactctggaagtcaatcctccagagcagcgaatcggccaatgcacaggatgtcaccttgaatgcatcaacggcggggtgagattgattaccctgacgagcgagctaaagtccgccactgtttgtgcttctcatttttgctcgagcgccacctccggaaagaaatcaacagagatacagttccacagtggttctctcgtgggcaaggcggcaatccacgtcaaaggggccctggtggacggaactgagttcacctttgaaggcagctgtatgttccccgatggttgcgacgctgtagattgcacattttgtagggagttccttaagaatccgcagtgctatcctgccaaaaagtggctgtttattatcatagttattttgctcgggtacgcaggcctgatgttactgaccaacgtgctcaaggctatcggagtctggggctcctgggtgatcgcccccgtcaaacttatgttcgcgattatcaagaaactgatgcggtcagtgagctgtttgatggggaagctaatggaccgtggacgccaagttattcatgaagaaataggtgagaatagagagggcaaccaggatgacgtgaggatcgaaatggtacggccacgacgcgtcagacactggatgtattctcctgtgattctgacgatcctcgccatcgggctgactgagggatgcgatgaaatggttcatgcagactccaaacttgtgagttgtaggcagggcagcggtaatatgaaggagtgcgtcacaaccgggcgggctctgttgcccgccgtgaacccaggccaggaggcttgtctccactttactgcccccggatctcctgattccaagtgcctgaaaattaaggtaaaacgcataaatttaaagtgtaaaaagtcaagtagctacttcgtgccagacgcaagatcgaggtgcacatccgttcgtcggtgtcgatgggccggcgattgccaatctgggtgcccgagccattttacctcaaacagtttctccgacgactgggctggaaagatggatagagcgggcctgggtttttctgggtgtagcgacggatgcggcggtgcagcctgtggctgcttcaatgctgccccctcctgtatcttttggaggaaatgggtcgaaaaccctcacgggattatctggaaggtgtcaccatgcgcagcctgggtgcccagcgctgtcattgagctaacgatgcctagtggagaagttcgcaccttccacccaatgtctggcatccccacacaggtgttcaaaggggtgtccgtaacttatctcggaagcgatatggaggtctcgggcctgaccgacctttgtgaaatagaggagttgaagtctaaaaagctggccctcgcaccgtgcaaccaggcgggtatgggggtggttggaaaagtgggcgaaatccagtgttcaagtgaggaatccgctcggacaattaagaaggatggttgcatctggaatgccgacctggtcggcattgagcttagagtggatgacgcagtttgttacagcaaaatcacttctgtggaagccgtagctaactatagcgccatacctaccacaattgggggactgaggtttgagcgctcccatgattcacaaggcaagatcagtgggagcccattggacattaccgcaatccgaggatctttctccgtcaattaccggggcctccgtctgtcattaagtgagataactgctacgtgcacaggtgaagtgaccaacgtgagcgggtgctactcctgtatgactggagccaaagtctctatcaagctgcactcgagcaaaaattcaaccgcgcatgttagatgcaagggcgatgagacagccttttccgtgctagaaggtgtacacagttataccgtgtctctcagcttcgaccacgctgtcgtggatgagcagtgtcagctgaactgcggcgggcatgaatcccaggttactcttaagggaaatttgatttttctggacgtgcccaaattcgtcgacggctcatacatgcaaacatatcactctagcgtgcctacgggggcaaacatccccagtccaaccgattggctcaatgccctgtttggaaacggcttatccaggtggattctgggtgttatcggggtgcttttgggaggcctcgctctgttctttctaataatgagcctgttcaagctcggcactaaacaggtctttcgctctcggacaaagctggcctga

SEQ ID NO: 11525 - RNA, 3222 nt, synthetic construct
  misc_feature 1..3222: note = derived and/or modified CDS sequence (opt3) from SFTSV(ZJZHSH-FZHR/China/07/2013)__KR017862.1__GP
  source 1..3222: mol_type = other RNA
atgatgaaggtgatctggttcagctccctgatttgcctcgtcatacagtgtggcggggacaccggacccatcatttgcgccggtcctatccactctaacaaaagagctggcattccacatcttctggggtactcagagaagatctgtcaaatagataggttgatccacgttagtagctggttacggaatcattcccagtttcagggatatgtgggccagcgcggtgggcgatctcaagtatcgtactatccggcagaaaactcatacagccgttggagtggactgctatccccctgcgacgccgattggctcggcatgctggtggtcaaaaaggcgaaaggctctgacatgattgtgcctgggccaagctataagggaaaggttttctttgagagacccacattcgatggttacgtgggctgggggtgtggatccggcaaatcaaggactgaaagtggtgagctttgcagctctgactccgggacgtcaagcggactgttgcctagtgatcgggtcctctggatcggcgacgtggcttgtcagccaatgacccccattcctgaagagacatttctggagctgaagtctttctcccagagcgaatttccagatgtatgcaaaatcgacggcatagttttcaatcagtgtgagggggaatcgctcccgcaaccctttgatgtggcctggatggacgtcggacactctcataagattatcatgcgcgagcacaaaactaagtgggtgcaggagtcctcaagtaaggatttcgtgtgctataaagaaggtaccggcccttgtagcgagtccgaagagaagacatgcaaaacctctgggagctgcagaggagacatgcagttttgtaaggtcgcaggctgcgaacacggtgaggaggcctcagaagctaaatgtaggtgcagtttagttcataagccaggggaggtggtagtgtcctacggcggaatgcgggtccgccccaaatgttacggcttcagccgaatgatggcaactctggaagtgaaccctccagagcagagaattgggcaatgcacaggatgtcaccttgaatgcatcaatggtggcgttaggttgatcaccctgacgtctgagctaaagtcagccactgtgtgtgctagtcatttttgcagctccgccacctctgggaagaaatcgacagagattcagttccacagcggatccctcgtcggcaagactgcgatacacgtgaaaggtgcactggtagacgggaccgagttcacatttgaaggctcatgtatgttccccgatggatgcgacgccgttgattgcaccttttgtcgggagttccttaagaacccgcagtgctatcctgctaaaaagtggctgtttatcattatcgtgatattgctcggctacgccgggctgatgttactgacgaatgtcctcaaggcaattggagtgtggggtagttgggtcatcgctcccgtgaaacttgttttcgccatcattaagaaactgatgcgtgcggtgtcttgtttgatgggcaagctaatggaccgcgggagacaagtaatccatgaagaaattggagagaacagggagggcaatcaggatgacgtccggatagaaatggcccgaccacgcagagtgaggcactggatgtatagccctgttatcctgactattctcgcaatcggtctggctgaggggtgcgatgaaatggtgcatgccgactccaaacttgtctcatgtcggcagggcagcggaaacatgaaggagtgcgtgacaaccggccgcgctctgttgcccgccgtaaatccagggcaggaggcatgtctccactttactgcccccggatctcctgattccaagtgcctgaaaatcaaggtgaaaagaattaacttaaagtgtaaaaagagtagctcttacttcgttccagacgctaggtcccgttgcacatcagtccggcgatgtagatgggcgggcgattgccaaagtggttgcccgccccattttaccagcaattcgttctccgacgactgggcagggaagatggatagggccggactgggcttttctggttgtagcgacggctgcgggggagctgcctgtggctgcttcaacgcagccccttcatgtatattttggcgcaaatgggtggaaaatccacacgggatcatttggaaggtgagtccctgcgctgcctgggtcccttccgcagttatcgagctaacgatgccatctggagaagtgcggaccttccaccccatgagcggcattccgacacaggtgttcaaaggtgtatccgtcacttatctcgggtcagatatggaggtgagcggactgaccgacctttgtgaaatcgaggagttgaagagtaaaaagctggcgctcgctccttgcaaccaggccggcatgggtgttgtgggcaaagtcggggaaatacagtgttcttccgaggaaagcgcaagaacaatcaagaaggatggatgcatttggaacgccgacctggtgggcatcgagcttagggttgatgacgctgtgtgttactcgaaaattacttcagtagaagccgtcgcaaattattctgctatcccaaccacaatagggggactgcgctttgagcgaagtcatgattcccaaggcaagattagcggttctcccttggacatcaccgccattcgggggagcttctccgtgaactaccgtggactcagactgtcattaagtgagatcactgcgacgtgcacaggcgaagtgaccaatgtcagcggttgctactcttgtatgactggcgccaaagtttccataaagctgcactcaagtaaaaacagcaccgctcatgtgaggtgcaagggggatgagacagcattttccgtactagaaggagtgcactcttattcggtcagcctctcattcgaccacgccgtggttgatgagcagtgtcagctgaattgcggcgggcatgaatcccaggtgacccttcgcggaaacttgatctttctggacgtccctaagttcgtggacggcagttacatgcaaacttatcactctacagttcccacgggtgctaatattccaagccctaccgattggctcaacgccctgtttgggaatggattatcccggtggatcctgggcgtgattggcgtccttctcgggggattggcactgttctttctaatcatgtcactgttcaaactcggtactaagcaggtatttagatctaggacaaaactggcgtga

SEQ ID NO: 11526 - RNA, 3222 nt, synthetic construct
  misc_feature 1..3222: note = derived and/or modified CDS sequence (opt3) from SFTSV(ZJZHSH-HCY/China/06/2012)__KR017855.1__GP
  source 1..3222: mol_type = other RNA
atgatgaaggtgatctggttccccagcctgatttgcctcgtcatacagtgttccggcgacaccgggcctatcatttgcgccggaccaatccactctaacaaatcagctaatattccgcatcttctgggttacagtgagaagatctgtcaaatagatagattgatccacgttagctcctggttaaggaaccattctcagtttcagggctatgtggggcagcggggaggccgctcgcaagtatcatactatcccgcagaaaatagctacagtcgatggtccggtctgctatctccttgcgacgccgattggctcgggatgctggtggtcaaaaaggcgaaaggaagcgacatgattgtgccaggcccctcctataagggcaaggttttctttgagcgtcctacattcgatgggtacgtgggatggggttgtggctcagggaaaagtagaactgaaagcggagagctttgcagctccgactcaggcacgagcagtggtctgttgccatctgatagggtcctctggatcggggacgtggcttgtcagcccatgacccctattccagaagagacatttctggagctgaagtccttcagccagtcggaatttccggatatctgcaaaatagacggaattgtattcaaccagtgtgagtctgaatccctcccccaaccttttgatgttgcctggatggacgtgggccactcacataagatcattatgcgggagcacaaaactaagtgggtccaggagagtagctccaaggatttcgtgtgctataaagaaggcaccgggccatgttctgagagcgaagagaagacatgcaaaacctcaggaagttgccgcggtgacatgcagttttgtaaggtggcaggctgcgaacacggggaggaggcctccgaagctaaatgtagatgcagcttagtccataagcccggagaggttgtggtatcttacggcggtatgagggtgcggcctaaatgttacgggttctcacgcatgatggcaactctggaagtcaatccacccgagcagcgaatcggccaatgcacaggatgtcaccttgaatgcatcaacggcggggtgagattggttaccctgacgagtgagctaaagagcgccactgtgtgtgcttcccatttttgcagctcggccaccagcggaaagaaatccacagagattcagttccactcaggtagtctcgtcggcaaggcggcaatacacgtgaaaggggccctggtagacggaactgagttcacctttgaaggctcttgtatgttcccggatggttgcgacgctgttgattgcacattttgtagggagttccttaagaatcctcagtgctatcccgccaaaaagtggctgtttatcattatcgtgatattgctcgggtacgcaggcctgatgttactgaccaacgtcctcaaggctattggagtgtggggcagctgggtcatcgccccagtgaaacttatgttcgcgatcattaagaaactgatgcggtccgtttcatgtttgatggggaagctaatggaccgtggacgccaagtgatccatgaagaaattggtgagaatagagagggcaaccaggatgacgtaaggatagaaatggtccggcctcgacgcgtgagacactggatgtatagccccgttatcctgacgattctcgccatcgggctgactgagggatgcgatgaaatggtgcatgcagactctaaacttgtctcctgtaggcagggcagtggtaatatgaaggagtgcgtgacaaccgggcgggctctgttgccagccgtaaaccccggccaggaggcttgtctccactttactgcccctggaagcccagattctaagtgcctgaaaatcaaggtgaaacgcattaatttaaagtgtaaaaagtcctcaagttacttcgttccggacgcaagatctaggtgcacatcggtccgtcggtgtcgatgggccggcgattgccaatccgggtgcccctctcattttaccagcaactcattcagtgacgactgggctggaaagatggatagagcgggcctgggtttttccgggtgttctgacggatgcggcggtgcagcctgtggctgcttcaatgctgcccctagctgtatattttggaggaaatgggtggaaaacccacacgggatcatttggaaggtgtccccctgcgcagcctgggtcccttcagctgttatcgagctaacgatgccaagcggagaagtgcgcaccttccaccccatgagtggcattccgacacaggtgttcaaaggggtatctgtcacttatctcggatccgatatggaggtgagcggcctgaccgacctttgtgaaatcgaggagttgaagtcgaaaaagctggccctcgcaccttgcaaccaggcgggtatgggggttgtgggaaaagtcggcgaaatacagtgttcatctgaggaaagtgctcggacaatcaagaaggatggttgcatttggaatgccgacctggtgggcatcgagcttagagttgatgacgcagtgtgttactccaaaattactagcgtagaagccgtcgctaactattctgccatcccaaccacaatagggggactgaggtttgagcgcagccatgattcccaaggcaagatttcagggagtcccttggacatcaccgcaattcgaggatctttctctgtgaattaccggggcctccgtctgtccttatcagagatcactgctacgtgcacaggtgaagtgaccaacgtcagtgggtgctacagctgtatgactggagccaaagtttccataaagctgcactcttcgaaaaatagcaccgcgcatgtgagatgcaagggcgatgagacagccttttcagtactagaaggtgtgcactcctataccgtcagtctctctttcgaccacgctgtggttgatgagcagtgtcagctgaactgcggcgggcatgaaagccaggtgactcttaagggaaatttgatctttctggacgtccctaaattcgtggacggctcctacatgcaaacatatcactcatctgttcccacgggggcaaacattccaagccctaccgattggctcaatgccctgtttggaaacggcttaagtaggtggatcctgggtgtgattggggtccttttgggaggcctcgctctgttctttctattcatgtccctgtttaagctcggcactaaacaggtattccgcagccggacaaagctggcctga

SEQ ID NO: 11527 - RNA, 3222 nt, synthetic construct
  misc_feature 1..3222: note = derived and/or modified CDS sequence (opt3) from SFTSV(ZJZHSH-HYC/China/05/2012)__KR017847.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctactatccggcagaaaatagttactcccgatggtctggtctgctaagcccctgcgacgccgattggctcgggatgctggtggtcaaaaaggcgaaaggatccgacatgattgtgcctggcccatcatataagggcaaggttttctttgagcgtcccacattcgatgggtacgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacatttctggagcttaagagcttctcgcagtctgaatttccagatatctgcaaaatagacggaattgtattcaaccagtgtgagtccgaatcactcccgcaaccctttgatgttgcctggatggacgtgggccacagtcataagatcattatgcgggagcacaaaactaagtgggtccaggagagctcctctaaggatttcgtgtgctataaagaaggcaccgggccttgtagcgagtcagaagagaagacatgcaaaaccagtggatcctgccgcggtgacatgcagttttgtaaggtggcaggctgcgaacacggggaggaggccagcgaagctaaatgtagatgctctttagtccataagccaggagaggttgtggtatcatacggcggtatgagggtgcggcccaaatgttacgggttcagtcgcatgatggcaactctggaagtcaatcctccagagcagcgaatcggccaatgcacaggatgtcaccttgaatgcatcaacggcggggtgagattgattaccctgacgagcgagctaaagtccgccactgtttgtgcttctcatttttgctcgagcgccacctccggaaagaaatcaacagagatacagttccacagtggttctctcgtgggcaaggcggcaatccacgtcaaaggggccctggtggacggaactgagttcacctttgaaggcagctgtatgttccccgatggttgcgacgctgtagattgcacattttgtagggagttccttaagaatccgcagtgctatcctgccaaaaagtggctgtttattatcatagttattttgctcgggtacgcaggcctgatgttactgaccaacgtgctcaaggctatcggagtctggggctcctgggtgatcgcccccgtcaaacttatgttcgcgattatcaagaaactgatgcggtcagtgagctgtttgatggggaagctaatggaccgtggacgccaagttattcatgaagaaataggtgagaatagaaaaggcaaccaggatgacgtgaggatcgagatggtacggccacgacgcgtcagacactggatgtattctcctgtgattctgacgatcctcgccatcgggctgactgaaggatgcgatgagatggttcatgcagactccaagctggtgagttgtaggcagggcagcggtaatatgaaggaatgcgtcacaaccgggcgggctctgttgcccgccgtgaacccaggccaggaggcttgtctccactttactgcccccggatctcctgattccaaatgcctgaagattaaagtaaagcgcataaatttaaaatgtaagaagtcaagtagctacttcgtgccagacgcaagatcgaggtgcacatccgttcgtcggtgtcgatgggccggcgattgccaatctgggtgcccgagccattttacctcaaacagtttctccgacgactgggctggaaaaatggatagagcgggcctgggtttttctgggtgtagcgacggatgcggcggtgcagcctgtggctgcttcaatgctgccccctcctgtatcttttggaggaagtgggtcgagaaccctcacgggattatctggaaagtgtcaccatgcgcagcctgggtgcccagcgctgtcattgaactaacgatgcctagtggagaggttcgcaccttccacccaatgtctggcatccccacacaggtgttcaagggggtgtccgtaacttatctcggaagcgatatggaagtctcgggcctgaccgacctttgtgagatagaagagttgaaatcaaagaaactggccctcgcaccgtgcaaccaggcgggtatgggggtggttggaaaggtgggcgagatccagtgttctagtgaagagtccgctcggacaattaagaaagatggttgcatctggaatgccgacctggtcggcattgaacttagagtggatgacgcagtttgttacagcaagatcacttctgtggaggccgtagctaactatagcgccatacctaccacaattgggggactgaggtttgaacgctcccatgattcacaaggcaaaatcagtgggagcccattggacattaccgcaatccgaggatctttctccgtcaattaccggggcctccgtctgtcattaagtgagataactgctacgtgcacaggtgaggtgaccaacgtgagcgggtgctactcctgtatgactggagccaaggtctctatcaaactgcactcgagcaaaaattcaaccgcgcatgttagatgcaagggcgatgaaacagccttttccgtgctagagggtgtacacagttataccgtgtctctcagcttcgaccacgctgtcgtggatgaacagtgtcagctgaactgcggcgggcatgagtcccaggttactcttaagggaaatttgatttttctggacgtgcccaagttcgtcgacggctcatacatgcaaacatatcactctagcgtgcctacgggggcaaacatccccagtccaaccgattggctcaatgccctgtttggaaacggcttatccaggtggattctgggtgttatcggggtgcttttgggaggcctcgctctgttctttctaataatgagcctgttcaaactcggcactaagcaggtctttcgctctcggacaaaactggcctga

SEQ ID NO: 11528 - RNA, 3222 nt, synthetic construct
  misc_feature 1..3222: note = derived and/or modified CDS sequence (opt3) from SFTSV(ZJZHSH-HYJ/China/07/2012)__KR017852.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctactatccggcagaaaatagttactcccgatggtctggtctgctaagcccctgcgacgccgattggctcgggatgctggtggtcaaaaaggcgaaaggatccgacatgattgtgcctggcccatcatataagggcaaggttttctttgagcgtcccacattcgatgggtacgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacatttctggagctcaagagcttctcgcagtctgaatttccagatatctgcaaaatagacggaattgtattcaaccagtgtgagtccgaatcactgccgcaaccctttgatgttgcctggatggacgtgggccacagtcataagatcattatgcgggagcacaaaactaagtgggtccaggagagctcctctaaggatttcgtgtgctataaagaaggcaccgggccttgtagcgagtcagaagagaagacatgcaaaaccagtggatcctgccgcggtgacatgcagttttgtaaggtggcaggctgcgaacacggggaggaggccagcgaagctaaatgtagatgctctttagtccataagccaggagaggttgtggtatcatacggcggtatgagggtgcggcccaaatgttacgggttcagtcgcatgatggcaactctggaagtcaatcctccagagcagcgaatcggccaatgcacaggatgtcaccttgaatgcatcaacggcggggtgagattgattaccctgacgagcgagctaaagtccgccactgtttgtgcttctcatttttgctcgagcgccacctccggaaagaaatcaacagagatacagttccacagtggttctctcgtgggcaaggcggcaatccacgtcaaaggggccctggtggacggaactgagttcacctttgaaggcagctgtatgttccccgatggttgcgacgctgtagattgcacattttgtagggagttccttaagaatccgcagtgctatcctgccaaaaagtggctgtttattatcatagttattttgctcgggtacgcaggcctgatgttactgaccaacgtgctcaaggctatcggagtctggggctcctgggtgatcgcccccgtcaaacttatgttcgcgattatcaagaaactgatgcggtcagtgagctgtttgatggggaagctaatggaccgtggacgccaagttattcatgaagaaataggtgagaatagagagggcaaccaggatgacgtgaggatcgaaatggtacggccacgacgcgtcagacactggatgtattctcctgtgattctgacgatcctcgccatcgggctgactgagggatgcgatgaaatggttcatgcagactccaaacttgtgagttgtaggcagggcagcggtaatatgaaggagtgcgtcacaaccgggcgggctctgttgcccgccgtgaacccaggccaggaggcttgtctccactttactgcccccggatctcctgattccaagtgcctgaaagtaaaggtgaaacgcattaatttaaagtgtaaaaagtcaagtagctacttcgttccagacgcaagatcgaggtgcacatccgtccgtcggtgtcgatgggccggcgattgccaatctgggtgcccgagccattttacctcaaacagtttctccgacgactgggctggaaagatggatagagcgggcctgggtttttctgggtgtagcgacggatgcggcggtgcagcctgtggctgcttcaatgctgccccctcctgtatattttggaggaaatgggtggaaaaccctcacgggatcatttggaaggtgtcaccatgcgcagcctgggtccccagcgctgttatcgagctaacgatgcctagtggagaagtgcgcaccttccacccaatgtctggcattcccacacaggtgttcaaaggggtatccgtcacttatctcggaagcgatatggaggtgtcgggcctgaccgacctttgtgaaatcgaggagttgaagtctaaaaagctggccctcgcaccgtgcaaccaggcgggtatgggggttgtgggaaaagtcggcgaaatacagtgttcaagtgaggaatccgctcggacaatcaagaaggatggttgcatttggaatgccgacctggtgggcatcgagcttagagttgatgacgcagtgtgttacagcaaaattacttctgtagaagccgtcgctaactatagcgccatccctaccacaatagggggactgaggtttgagcgctcccatgattcacaaggcaagattagtgggagcccattggacatcaccgcaattcgaggatctttctccgtgaattaccggggcctccgtctgtcattaagtgagatcactgctacgtgcacaggtgaagtgaccaacgtcagcgggtgctactcctgtatgactggagccaaagtttctataaagctgcactcgagcaaaaattcaaccgcgcatgtgagatgcaagggcgatgagacagccttttccgtactagaaggtgtgcacagttataccgtctctctcagcttcgaccacgctgtggttgatgagcagtgtcagctgaactgcggcgggcatgaatcccaggtgactcttaagggaaatttgatctttctggacgtccccaaattcgtggacggctcatacatgcaaacatatcactctagcgttcctacgggggcaaacattcccagtccaaccgattggctcaatgccctgtttggaaacggcttatccaggtggatcctgggtgtgattggggtccttttgggaggcctcgctctgttctttctaatcatgagcctgttcaagctcggcactaaacaggtatttcgctctcggacaaagctggcctga

SEQ ID NO: 11529 - RNA, 3222 nt, synthetic construct
  misc_feature 1..3222: note = derived and/or modified CDS sequence (opt3) from SFTSV(ZJZHSH-LU/China/10/2011)__KR017850.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctactatccggcagaaaatagttactcccgatggtctggtctgctaagcccctgcgacgccgattggctcgggatgctggtggtcaaaaaggcgaaaggatccgacatgattgtgcctggcccatcatataagggcaaggttttctttgagcgtcccacattcgatgggtacgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacatttctggagctcaagagcttctcgcagtctgaatttccagatatgtgcaaaatcgacggaatagtattcaaccagtgtgagtccgaatcactgccgcaaccctttgatgttgcctggatggacgtgggccacagtcataagattatcatgcgggagcacaaaactaagtgggtccaggagagctcctctaaggatttcgtgtgctataaagaaggcaccgggccttgtagcgagtcagaagagaagacatgcaaaaccagtggatcctgccgcggtgacatgcagttttgtaaggtggcaggctgcgaacacggggaggaggccagcgaagctaaatgtagatgctctttagtccataagccaggagaggttgtggtatcatacggcggtatgagggtgcggcccaaatgttacgggttcagtcgcatgatggcaactctggaagtcaatcctccagagcagcgaattggccaatgcacaggatgtcaccttgaatgcatcaacggcggggtgagattggttaccctgacgagcgagctaaagtccgccactgtgtgtgcttctcatttttgctcgagcgccacctccggaaagaaatcaacagagatccagttccacagtggttctctcgtcggcaaggcggcaattcacgtgaaaggggccctggtagacggaactgaatttacctttgagggcagctgtatgttccccgatggttgcgacgctgttgattgcacattttgtagggagttccttaagaatccgcagtgctatcctgccaaaaagtggctgtttataatcattgtgatcttgctcgggtacgcaggcctgatgttactgaccaacgtcctcaaggctataggagtgtggggctcctgggtcattgcccccgtgaaacttatgttcgcgatcatcaagaaactgatgcggtcagttagctgtttgatggggaagctaatggaccgtggacgccaagtgattcatgaagaaatcggtgagaatagagagggcaaccaggatgacgtaaggattgaaatggtccggccacgacgcgtgagacactggatgtattctcctgttatactgacgatcctcgccattgggctgactgagggatgcgatgaaatggtgcatgcagactccaaacttgtcagttgtaggcagggcagcggtaatatgaaggagtgcgtgacaaccgggcgggctctgttgcccgccgtaaacccaggccaggaggcttgtctccactttactgcccccggatctcctgattccaagtgcctgaaaatcaaggtgaaacgcatcaatttaaagtgtaaaaagtcaagtagctacttcgttccagacgcaagatcgaggtgcacatccgtccgtcggtgtcgatgggccggcgattgccaatctgggtgcccgagccattttacctcaaacagtttctccgacgactgggctggaaagatggatagagcgggcctgggtttttctgggtgtagcgacggatgcggcggtgcagcctgtggctgcttcaatgctgccccctcctgtattttctggaggaaatgggtggaaaaccctcacgggataatctggaaggtgtcaccatgcgcagcctgggtccccagcgctgttattgagctaacgatgcctagtggagaagtgcgcaccttccacccaatgtctggcatccccacacaggtgttcaaaggggtatccgtcacttatctcggaagcgatatggaggtgtcgggcctgaccgacctttgtgaaattgaggagttgaagtctaaaaagctggccctcgcaccgtgcaaccaggcgggtatgggggttgtgggaaaagtcggcgaaatccagtgttcaagtgaggaatccgctcggacaataaagaaggatggttgcatctggaatgccgacctggtgggcattgagcttagagttgatgacgcagtgtgttacagcaaaatcacttctgtagaagccgtcgctaactatagcgccattcctaccacaatcgggggactgaggtttgagcgctcccatgattcacaaggcaagataagtgggagcccattggacattaccgcaatccgaggatctttctccgtgaattaccggggcctccgtctgtcattaagtgagattactgctacgtgcacaggtgaagtgaccaacgtcagcgggtgctactcctgtatgactggagccaaagtttctatcaagctgcactcgagcaaaaattcaaccgcgcatgtgagatgcaagggcgatgagacagccttttccgtactagaaggtgtgcacagttataccgtctctctcagcttcgaccacgctgtggttgatgagcagtgtcagctgaactgcggcgggcatgaatcccaggtgactcttaagggaaatttgatatttctggacgtccccaaattcgtggacggctcatacatgcaaacatatcactctagcgttcctacgggggcaaacatccccagtccaaccgattggctcaatgccctgtttggaaacggcttatccaggtggattctgggtgtgatcggggtccttttgggaggcctcgctctgttctttctaattatgagcctgttcaagctcggcactaaacaggtatttcgctctcggacaaagctggcctga

SEQ ID NO: 11530 - RNA, 3222 nt, synthetic construct
  misc_feature 1..3222: note = derived and/or modified CDS sequence (opt3) from SFTSV(ZJZHSH-SHZ/China/05/2012)__KR017848.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctactatccggcagaaaatagttactcccgatggtctggtctgctaagcccctgcgacgccgattggctcgggatgctggtggtcaaaaaggcgaaaggatccgacatgattgtgcctggcccatcatataagggcaaggttttctttgagcgtcccacattcgatgggtacgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacatttctggagctcaagagcttctcgcagtctgaatttccagatatctgcaaaatagacggaattgtattcaaccagtgtgagtccgaatcactgccgcaaccctttgatgttgcctggatggacgtgggccacagtcataagatcattatgcgggagcacaaaactaagtgggtccaggagagctcctctaaggatttcgtgtgctataaagaaggcaccgggccttgtagcgagtcagaagagaagacatgcaaaaccagtggatcctgccgcggtgacatgcagttttgtaaggtggcaggctgcgaacacggggaggaggccagcgaagctaaatgtagatgctctttagtccataagccaggagaggttgtggtatcatacggcggtatgagggtgcggcccaaatgttacgggttcagtcgcatgatggcaactctggaagtcaatcctccagagcagcgaatcggccaatgcacaggatgtcaccttgaatgcatcaacggcggggtgagattggttaccctgacgagcgagctaaagtccgccactgtgtgtgcttctcatttttgctcgagcgccacctccggaaagaaatcaacagagattcagttccacagtggttctctcgtcggcaaggcggcaatacacgtgaaaggggccctggtagacggaactgagttcacctttgaaggcagctgtatgttccccgatggttgcgacgctgttgattgcacattttgtagggagttccttaagaatccgcagtgctatcctgccaaaaagtggctgtttatcattatcgtgatattgctcgggtacgcaggcctgatgttactgaccaacgtcctcaaggctattggagtgtggggctcctgggtcatcgcccccgtgaaacttatgttcgcgatcattaagaaactgatgcggtcagttagctgtttgatggggaagctaatggaccgtggacgccaagtgatccatgaagaaattggtgagaatagagagggcaaccaggatgacgtaaggatagaaatggtccggccacgacgcgtgagacactggatgtattctcctgttatcctgacgattctcgccatcgggctgactgagggatgcgatgaaatggtgcatgcagactccaaacttgtcagttgtaggcagggcagcggtaatatgaaggagtgcgtgacaaccgggcgggctctgttgcccgccgtaaacccaggccaggaggcttgtctccactttactgcccccggatctcctgattccaagtgcctgaaaatcaaggtgaaacgcattaatttaaagtgtaaaaagtcaagtagctacttcgttccagacgcaagatcgaggtgcacatccgtccgtcggtgtcgatgggccggcgattgccaatctgggtgcccgagccattttacctcaaacagtttctccgacgactgggctggaaagatggatagagcgggcctgggtttttctgggtgtagcgacggatgcggcggtgcagcctgtggctgcttcaatgctgccccctcctgtatattttggaggaaatgggtggaaaaccctcacgggatcatttggaaggtgtcaccatgcgcagcctgggtccccagcgctgttatcgagctaacgatgcctagtggagaagtgcgcaccttccacccaatgtctggcattcccacacaggtgttcaaaggggtatccgtcacttatctcggaagcgatatggaggtgtcgggcctgaccgacctttgtgaaatcgaggagttgaagtctaaaaagctggccctcgcaccgtgcaaccaggcgggtatgggggttgtgggaaaagtcggcgaaatacagtgttcaagtgaggaatccgctcggacaatcaagaaggatggttgcatttggaatgccgacctggtgggcatcgagcttagagttgatgacgcagtgtgttacagcaaaattacttctgtagaagccgtcgctaactatagcgccatccctaccacaatagggggactgaggtttgagcgctcccatgattcacaaggcaagattagtgggagcccattggacatcaccgcaattcgaggatctttctccgtgaattaccggggcctccgtctgtcattaagtgagatcactgctacgtgcacaggtgaagtgaccaacgtcagcgggtgctactcctgtatgactggagccaaagtttctataaagctgcactcgagcaaaaattcaaccgcgcatgtgagatgcaagggcgatgagacagccttttccgtactagaaggtgtgcacggctataccgtcagtctctctttcgaccacgctgtggttgatgagcagtgtcagctgaactgcgggggacatgaaagccaggtgactcttaagggcaatttgatctttctggacgtccccaaattcgtggacgggtcctacatgcaaacatatcactcatctgttcctacgggagcaaacattcccagcccaaccgattggctcaatgccctgtttggcaacggtttaagtaggtggatcctgggggtgattggagtccttttgggcggcctcgctctgttctttctaatcatgtccctgttcaagctcgggactaaacaggtatttcgcagccggacaaagctggcctga

SEQ ID NO: 11531 - RNA, 3222 nt, synthetic construct
  misc_feature 1..3222: note = derived and/or modified CDS sequence (opt3) from SFTSV(ZJZHSH-WSH/China/08/2012)__KR017854.1__GP
  source 1..3222: mol_type = other RNA
atgatgaaggtgatctggttcagctccctgatttgcctcgtcatacagtgtggcggggacaccggacccatcatttgcgccggtcctatccactctaacaaatcagctggcattccacatcttctggggtacagtgagaagatctgtcaaatagatagattgatccacgttagctcctggttaaggaatcattctcagtttcagggatatgtgggccagcggggtgggcgctcgcaagtatcatactatccggcagaaaacagctacagtcgatggtccggactgctatctccctgcgacgccgattggctcggcatgctggtggtcaaaaaggcgaaaggcagcgacatgattgtgcctgggccatcctataagggaaaggttttctttgagcgtcccacattcgatggttacgtgggctgggggtgtggatcaggcaaaagtagaactgaaagcggtgagctttgttcttccgactcagggacgagcagtggactgttgccttctgatagggtcctctggatcggcgacgtggcttgccagccaatgacccccattcctgaagagacatttctggagctgaagtccttcagccagtcggaatttccagatgtatgcaaaatcgacggcatagttttcaatcagtgtgagggggaatctctcccgcaaccctttgatgtggcctggatggacgtcggacactcccataagattatcatgcgggagcacaaaactaagtgggtgcaggagtcaagtagcaaggatttcgtgtgctataaagaaggtaccggcccttgttccgagtctgaagagaagacatgcaaaaccagcgggtcatgccgcggagacatgcagttttgtaaggtcgcaggctgcgaacacggtgaggaggccagtgaagctaaatgtagatgctccttagttcagaagccaggggaggtggtagtgagctacggcggaatgagggtccggcccaaatgttacggcttctctcgcatgatggcaactctggaagtgaaccctccagagcaacgaattgggcagtgcacaggatgtcatcttgaatgcatcaatggtggcgttagattgatcaccctgacgtcagagctaaagagtgccactgtgtgtgctagccacttttgctcctctgccacctcggggaagaaaagcacagagattcagttccattccggatcactcgtcggcaagactgcgatacacgtgaaaggtgcactggtagacgggaccgaatttacatttgagggcagttgtatgttccccgatggatgcgacgccgttgattgcaccttttgtagggagttccttaagaacccgcaatgctatcctgctaaaaagtggctgtttatcattatcgtgatattgctcggctacgccgggctgatgttactgacgaatgtcctcaaggcaattggagtgtggggttcttgggtcatcgctcccgtgaaacttatgttcgccatcatgaagaaactgatgcggagcgtttcctgtttgatgggcaagctaatggaccgtgggcgccaggtgattcacgaagaaatcggagagaacagagagggcaatcaggatgacgtaaggattgaaatggtccggccacgacgcgtgagacattggatgtattcacctgttatactgactatcctcgcgattggtctgacagaggggtgcgatgaaatggtgcacgccgacagcaaacttgtctcttgtaggcagggctccggaaacatgaaggagtgcgtgaccactggccgggcactgttgcccgctgtaaatccagggcaagaggcctgtctccattttacagctcccggaagtcctgatagcaagtgcctgaaaatcaaggtgaaacgcatcaacttaaagtgtaaaaagtcttcctcatacttcgttccagacgccagaagtaggtgcaccagcgtccgtcggtgtcgatgggcaggcgattgccagtcgggttgcccgccccactttacgtccaattctttcagcgacgactgggccgggaagatggatagagctggactgggcttttcaggttgtagtgacggctgcgggggagcggcatgtggctgcttcaacgccgctccttcctgtattttctggaggaaatgggtggaaaatccacatgggataatctggaaggtgtctccctgcgccgcatgggtccctagcgccgttattgagctaaccatgccatccggagaagtgcgcacattccaccccatgtcaggcatcccgactcaggtgttcaaaggtgtaagcgtcacctatctcgggagtgatatggaggtgtctggactgacagacctttgtgaaattgaggagttgaagtccaaaaagctggctctcgccccttgcaaccaggcaggcatgggtgttgtgggcaaagtcggggaaatccaatgtagctcggaggaatcagcgcggactataaagaaggatggatgcatctggaacgctgacctggtgggcattgagcttagagttgatgacgccgtgtgttactctaaaatcaccagtgtagaagcagtcgccaattattccgctattccaacaaccatcgggggactgaggtttgagcgcagccacgattctcagggcaagataagcggttcccccttggacattactgccatccgagggtcattcagtgtgaactaccggggactccgtctgagcttatctgagattacggcaacatgcaccggcgaagtgactaatgtctccggttgctactcatgtatgaccggcgctaaagttagtatcaagctgcatagctccaaaaactctacagcccacgtgagatgcaagggggatgagaccgcgttttcggtactagaaggagtgcatagctattcagtctccctcagtttcgaccacgccgtggttgatgagcagtgtcagctgaattgcggcgggcacgaatctcaagtgactcttaggggaaacttgatatttctggacgtccctaagttcgtggacggcagctacatgcagacatatcattccacggttcccaccggtgctaatatcccatcacctactgattggctcaacgcactgtttgggaatggattatctcgctggattctgggcgtgatcggcgtccttctcgggggattggccctgttctttctaattatgagcctgttcaaactcggtacaaagcaggtatttcggagtagaaccaaactggcttga

SEQ ID NO: 11532 - RNA, 3222 nt, synthetic construct
  misc_feature 1..3222: note = derived and/or modified CDS sequence (opt3) from SFTSV(ZJZHSH-XAM/China/06/2012)__KR017853.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctactatccggcagaaaatagttactcccgatggtctggtctgctaagcccctgcgacgccgattggctcgggatgctggtggtcaaaaaggcgaaaggatccgacatgattgtgcctggcccatcatataagggcaaggttttctttgagcgtcccacattcgatgggtacgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacatttctggagctcaagagcttctcgcagtctgaatttccagatatctgcaaaatagacggaattgtattcaaccagtgtgagtccgaatcactgccgcaaccctttgatgttgcctggatggacgtgggccacagtcataagatcattatgcgggagcacaaaactaagtgggtccaggagagctcctctaaggatttcgtgtgctataaagaaggcaccgggccttgtagcgagtcagaagagaagacatgcaaaaccagtggatcctgccgcggtgacatgcagttttgtaaggtggcaggctgcgaacacggggaggaggccagcgaagctaaatgtagatgctctttagtccataagccaggagaggttgtggtatcatacggcggtatgagggtgcggcccaaatgttacgggttcagtcgcatgatggcaactctggaagtcaatcctccagagcagcgaatcggccaatgcacaggatgtcaccttgaatgcatcaacggcggggtgagattggttaccctgacgagcgagctaaagtccgccactgtgtgtgcttctcatttttgctcgagcgccacctccggaaagaaatcaacagagattcagttccacagtggttctctcgtcggcaaggcggcaatacacgtgaaaggggccctggtagacggaactgagttcacctttgaaggcagctgtatgttccccgatggttgcgacgctgttgattgcacattttgtagggagttccttaagaatccgcagtgctatcctgccaaaaagtggctgtttatcattatcgtgatattgctcgggtacgcaggcctgatgttactgaccaacgtcctcaaggctattggagtgtggggctcctgggtcatcgcccccgtgaaacttgttttcgcgatcattaagaaactgatgcgggccgtgtcatgtttgatggggaagctaatggaccgtggacgccaagtaatccatgaagaaattggtgagaatagagagggcaaccaggatgacgtcaggatagaaatggcacggccacgacgcgtgagacactggatgtatagccctgttatcctgacgattctcgctatcgggctggccgagggatgcgatgaaatggtgcatgctgactctaaacttgtctcctgtaggcagggcagtggtaatatgaaggagtgcgtgactacagggcgggccctgttgcccgcagtaaacccaggccaggaggcctgtctccactttaccgctcccggaagccctgattctaagtgcctgaaaatcaaggtgaaacgcattaatttaaagtgtaaaaagtcctcaagttacttcgttccagacgcgagatcgaggtgcactagcgtccgtcggtgtcgatgggcaggcgattgccaatccgggtgcccgtctcattttacaagcaactcattcagtgacgactgggccggaaagatggatagagctggcctgggtttttccgggtgttctgacggatgcggcggtgccgcatgtggctgcttcaatgccgctcccagctgtatattttggaggaaatgggtggaaaaccctcacgggatcatttggaaggtgtccccatgcgccgcatgggtcccctcagcggttatcgagctaaccatgcctagcggagaagtgcgcacgttccacccaatgagtggcattcccacccaggtgttcaaaggggtatctgtcacatatctcggatccgatatggaggtgagcggcctgactgacctttgtgaaatcgaggagttgaagtcgaaaaagctggctctcgccccgtgcaaccaggcaggtatgggggttgtgggaaaagtcggcgaaatacagtgttcatctgaggaaagtgcccggaccatcaagaaggatggttgcatttggaatgctgacctggtgggcatcgagcttagagttgatgacgccgtgtgttactccaaaattacaagcgtagaagcagtcgctaactattctgccatccctactaccatagggggactgaggtttgagcgcagccatgattcccaaggcaagatttcagggagtccattggacatcacagcgattcgaggcagcttctctgtgaattaccggggactccgtctgtccttatcagagatcaccgccacttgcacgggtgaagtgacaaacgtcagtgggtgctacagctgtatgaccggagctaaagtttccataaagctgcactcttcgaaaaatagcactgcacatgtgagatgcaagggcgatgagaccgccttttcagtactagaaggtgtgcactcctatacagtcagtctctctttcgaccacgctgtggttgatgagcagtgtcagctgaactgcggcgggcatgaaagccaggtgacccttaagggaaatttgatctttctggacgtccccaaattcgtggacggctcctacatgcaaacttatcactcatctgttcctacaggggccaacattcccagcccaacggattggctcaatgcactgtttggaaacggcttaagtaggtggatcctgggtgtgattggggtccttttgggaggcctcgcgctgttctttctaatcatgtccctgttcaagctcggcaccaaacaggtatttcgcagccggactaagctggcctga

SEQ ID NO: 11533 - RNA, 3222 nt, synthetic construct
  misc_feature 1..3222: note = derived and/or modified CDS sequence (opt3) from SFTSV(ZJZHSH-YJX/China/06/2012)__KR017860.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctactatccggcagaaaatagttactcccgatggtctggtctgctaagcccctgcgacgccgattggctcgggatgctggtggtcaaaaaggcgaaaggatccgacatgattgtgcctggcccatcatataagggcaaggttttctttgagcgtcccacattcgatgggtacgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacatttctggagcttaagagcttctcgcagtctgaatttccagatatctgcaaaatagacggaattgtattcaaccagtgtgagtccgaatcactcccgcaaccctttgatgttgcctggatggacgtgggccacagtcataagatcattatgcgggagcacaaaactaagtgggtccaggagagctcctctaaggatttcgtgtgctataaagaaggcaccgggccttgtagcgagtcagaagagaagacatgcaaaaccagtggatcctgccgcggtgacatgcagttttgtaaggtggcaggctgcgaacacggggaggaggccagcgacgctaaatgtagatgctctttagtccataagccaggagaagttgtggtatcatacggcggtatgagggtgcggcccaaatgttacgggttcagtcgcatgatggcaactctggaggtcaatcctccagaacagcgaatcggccaatgcacaggatgtcaccttgagtgcatcaacggcggggtgagattgattaccctgacgagcgaactaaggtccgccactgtttgtgcttctcatttttgctcgagcgccacctccggaaagaagtcaacagagatacagttccacagtggttctctcgtgggcaaaactaccatccacgtcaagggggcgctggtggatggaacagagttcacctttgaaggcagctgtatgttccccgacggttgcgatgcagtagactgcacgttttgtcgggagttccttaaaaatccgcagtgctatcctgccaagaaatggctgtttattatcatagttattttgctcgggtacgctggcctgatgttactgactaacgtgctcaaggccatcggagtctggggctcctgggtgatcgcacccgtcaagctgatgttcgctattatcaaaaagctgatgcgttcagtgagctgtttgatggggaaactaatggatcgcggaagacaagttattcatgaagagataggtgaaaatagggagggcaaccaggacgatgtgcggatcgagatggcccgaccacgcagagtaaggcactggatgtattctcctgtcattctgacaatcctcgcgatcgggctggccgaaggatgcgacgagatggtgcatgcagattccaaacttgttagttgtaaacaggctagcggcaatatgaaggaatgcgtgaccactggtcgggccctgttgcccgctgtcaacccagggcaggaggcctgtctccactttacagcacccggctctcctgactccaagtgcctgaaaattaaggtgaaacgcataaatttaaagtgtaaaaagtcaagtagctacttcgtactggatgccagatcgaggtgcacctccgtgcgtcggtgtcgatgggctggagactgccaatctggctgcccaagccattttacgtcaaacagtttctccgacgattgggcggggaagatggacagagcaggactaggcttttctggttgtagcgatgggtgcggaggcgccgcttgtggttgcttcaatgccgcaccgtcctgtatcttttggaggaaatgggttgagaacccccacggcattatctggaaggtctcaccttgcgccgcttgggtgccaagcgccgtgattgaactcaccatgcccagtggggaggtccgcacattccaccctatgtctggaatcccaactcaggttttcaaaggcgtgtccgtgacctatctggggagcgacatggaagtatcgggacttacagatttgtgtgagatagaggaactgaagtcaaagaagctcgcactggcgccctgcaaccaggctggcatgggtgtcgtggggaaagttggagagatccagtgttctagtgaagagtccgcccggactattaagaaggacggctgcatctggaatgcagatcttgtgggtattgaactgagagtcgacgatgccgtgtgttacagcaaaatcacctctgttgaggctgtggccaactatagcgcaataccgacaaccattggcgggttgaggtttgaacgctcccatgactcacaaggaaagatcagtggcagccctctcgatattactgctatccgagggtctttctccgtaaattaccggggactgcgtttatcactgagtgaggtcacggccacatgcaccggcgaggtgactaacgtgagcggttgctactcctgtatgaccggggcgaaagtctctataaagctacactcgagcaaaaattcaacagcccatgttagatgcaagggagacgaaaccgctttttccgtgctcgagggcgtacacagttatactgtgtctctgagcttcgatcacgcagtcgtggacgaacagtgtcagcttaactgcggtggccatgagtcccaggttacattgaaggggaatctgatctttctcgacgtgccaaaattcgtcgatggatcatacatgcaaacgtatcactctagcgtgctgaccggcgccaacattcccagtcctactgactggttaaatgctctgtttgggaacggactttccaagtggatcttgggcgttattggtgtgctcctagggggactggccctgttctttctcatcatgagcctgttcaaacttggcacaaagcagatatttaggtctcgcaccaaattggcatga

SEQ ID NO: 11534 - RNA, 3222 nt, synthetic construct
  misc_feature 1..3222: note = derived and/or modified CDS sequence (opt3) from SFTSV(SPL003A)__AB817988.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctacttcccggcagaaaatagttattcccgatggtctggtctgctaagcccctgcgacgccgattggctcgggatgctggtggtcaaaaaggcgaaaggatccgacatgattgtgcctggcccatcatacaagggcaaggttttcttcgagcgtcccacatttgatgggtatgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacattcctggagctcaagagcttttcgcagtctgaatttccagatatctgcaaaatagacggaattgtatttaaccagtgtgagtccgaatcactgccgcaacccttcgatgttgcctggatggacgtgggccacagtcataagatcattatgcgggagcacaaaactaagtgggtccaggagagctcctctaaggattttgtgtgctacaaagaaggcaccgggccttgtagcgagtcagaagagaagacatgcaaaaccagtggatcctgccgcggtgacatgcagttctgtaaggtggcaggctgcgaacacggggaggaggccagcgaagctaaatgtagatgctctttagtccataagccaggagaggttgtggtatcatatggcggtatgagggtgcggcccaaatgttacgggtttagtcgcatgatggcaactctggaagtcaatagccctgagcagcgaatcggccaatgcacaggatgtcaccttgaatgcatcaacggcggggtgagattgattaccctgacgtccgagctaaagtctgccactgtttgtgcttcgcatttctgcagctccgccacctcaggaaagaaaagtacagagatacagttccactctggtagcctcgtgggcaagactgcgatccacgtcaaaggggcactggtggacggaaccgaatttacattcgagggctcctgtatgtttccagatggttgcgacgccgtagattgcaccttctgtagggaatttcttaagaatccccagtgctacccggctaaaaagtggctgttcattatcatagttattttgctcgggtatgccggcctgatgttactgacgaacgtgctcaaggcaatcggagtctggggctcatgggtgatcgctcctgtcaaacttatgtttgccattatcaagaaactgatgcggagcgtgtcttgtttgatggggaagctaatggaccgtggacgccaagttattcatgaggaaataggtgagaatagagagggcaaccaggatgacgtgaggatcgaaatggcgcggccccgacgcgtaagacactggatgtactccccagtcattctgactatcctcgccatcgggctggcagagggatgcgatgaaatggtgcatgctgacagtaaacttgttagctgtaagcagggctctggtaatatgaaggagtgcgtgacaaccgggagggccctgttgcctgctgtcaaccccggccaggaggcctgtctccacttcactgcaccaggatcccccgattcaaaatgcctgaagattaaagtgaagcggataaatttaaaatgtaagaagagtagctcgtattttgtacctgacgcccgctccagatgcacatctgtgaggcgttgtcggtgggctggcgattgccaaagcgggtgcccatcacatttcaccagtaactccttttctgacgactgggcgggaaaaatggatcgagcaggcctgggtttcagcgggtgttccgacggatgcggcggtgccgcttgtggctgctttaatgccgcaccgtcatgtatcttctggagaaagtgggttgaaaacccccacgggattatctggaaagtcagcccttgcgccgcttgggtgccaagtgccgtgattgagctaacgatgccctctggagaagtcaggaccttccaccctatgtccggcatcccaacacaggtttttaagggggtgagcgtgacttacctcggatcggatatggaggtatcaggcctgaccgacctttgtgaaatagaggagttgaaatctaagaaactggcactcgcgccctgcaaccaggctggtatgggggtcgtgggaaaggttggcgaaatccagtgtagttccgaggaaagcgcccgcacaattaagaaagatggttgcatctggaatgcagacctggtgggcattgagcttcgggtcgatgacgccgtgtgttattctaagatcactagcgttgaagctgtggccaactactccgcaataccgaccacaattgggggactgagattcgagaggtcacatgatagtcaaggcaaaatcagcgggtctcctttggacattaccgctatccgcggatccttttcagtaaattatcgaggcctccggctgagtttaagcgagataactgccacgtgcacaggtgaagtcaccaacgtgtccgggtgctactcttgtatgactggagcgcgtgtgtcgatcaagctgcacagcagcaaaaattccaccgcccatgtcagatgcaagggcgatgagacagctttcagtgttctagaaggtgtgcactcttacaccgtaagcctctcctttgaccacgcagtggtcgatgagcagtgtcagctgaactgcggcgggcatgaatcacaggtgactcttaagggaaatttgattttcctggacgttccaaaatttgtggacggctcttatatgcaaacataccacagcagtgtccccacgggggccaacatcccttcccccaccgattggctcaatgctctgttcggaaacggcttatcaaggtggattctgggtgtgatcggggttcttttgggaggcctcgccctgtttttcctaataatgtctctgtttaagctcggcactaaacaggtgttccgctcacggacaaagctggcatga

SEQ ID NO: 11535 - RNA, 3222 nt, synthetic construct
  misc_feature 1..3222: note = derived and/or modified CDS sequence (opt3) from SFTSV(SPL004A)__AB817989.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctactatccggcagaaaatagttactcccgatggtctggtctgctaagcccctgcgacgccgattggctcgggatgctggtggtcaaaaaggcgaaaggatccgacatgattgtgcctggcccatcatataagggcaaggttttctttgagcgtcccacattcgatgggtacgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacatttctggagctcaagagcttctcgcagtctgaatttccagatatctgcaaaatagacggaattgtattcaaccagtgtgagtccgaatcactgccgcaaccctttgatgttgcctggatggacgtgggccacagtcataagatcattatgcgggagcacaaaactaagtgggtccaggagagctcctctaaggatttcgtgtgctataaagaaggcaccgggccttgtagcgagtcagaagagaagacatgcaaaaccagtggatcctgccgcggtgacatgcagttttgtaaggtggcaggctgcgaacacggggaggaggccagcgaagctaaatgtagatgctctttagtccataagccaggagaggttgtggtatcatacggcggtatgagggtgcggcccaaatgttacgggttcagtcgcatgatggcaactctggaagtcaatcctccagagcagcgaatcggccaatgcacaggatgtcaccttgaatgcatcagcggcggggtgagattgattaccctgacgtccgagctaaagtctgccactgtttgtgcttcgcatttttgcagctccgccacctcaggaaagaaaagtacagagatacagttccactctggtagcctcgtgggcaaggcggcaatccacgtcaaaggggccctggtggacggaactgagttcacctttgaaggctcctgtatgttccccgatggttgcgacgctgtagattgcacattttgtagggagttccttaagaacccgcagtgctatcctgccaaaaagtggctgtttattatcatagttattttgctcgggtacgcaggcctgatgttactgaccaatgtgctcaaggctatcggagtctggggctcatgggtgatcgcccccgtcaaacttatgttcgcgattatgaagaaactgatgcggagcgtgtcttgtttgatggggaagctaatggaccgtggacgccaagttatccatgaagaaattggtgagaacagagagggcaatcaggatgacgtgaggatagaaatggcccggccacgacgcgtaagacactggatgtattcccctgtcatcctgacgattctcgcaatcgggctggctgagggatgcgatgaaatggtgcatgccgacagtaaacttgttagctgtaggcagggctctggtaacatgaaggagtgcgtgactacagggcgggctctgttgcccgccgtcaatccaggccaggaggcatgtctccactttaccgcccccggatcccctgattcaaagtgcctgaaaatcaaggtgaaacgcattaacttaaagtgtaaaaagagtagctcgtacttcgtaccagacgctagatccaggtgcacttctgtgcgtcggtgtcgatgggcgggcgattgccaaagcgggtgcccgtcacattttacaagtaattccttctctgacgactgggcaggaaagatggatagagccggcctgggttttagcgggtgttccgacggatgcggcggtgctgcctgtggctgcttcaacgcagccccctcatgtatattttggaggaaatgggttgaaaatcctcacgggatcatttggaaggtcagcccatgcgctgcctgggtgcccagtgcagtgatcgagctaaccatgccttctggagaagtccgcacgttccacccaatgtccggcattcccacccaggttttcaaaggggtgagcgtgacatatctcggatcggatatggaggtatcaggcctgactgacctttgtgaaatcgaggagttgaagtctaaaaagctggcgctcgctccgtgcaaccaggccggtatgggggtcgtgggaaaagttggcgaaatacagtgtagttccgaggaaagcgcacggaccatcaagaaggatggttgcatttggaacgccgacctggtgggcatcgagcttagagtcgatgacgctgtgtgttactctaaaattacaagcgttgaagccgtggcaaattattccgctatccctactaccatagggggactgaggtttgagcgctcacatgatagtcaaggcaagattagcgggtctccattggacatcacagccattcgaggatccttctcagtaaactaccggggcctccgtctgagtttaagcgagatcaccgcgacttgcacgggtgaagtcacaaatgtgtccgggtgctactcttgtatgaccggagccaaagtgtcgataaagctgcacagcagcaaaaactccactgctcatgtcagatgcaaggaggatgaaaccgcatttagtgttctagagggcgtgcactcttatacagtaagcctctccttcgaccacgccgtggtcgatgaacagtgtcagctgaattgcggtggccatgagtcacacgtgacccttaaggggaacttgatctttctggacgttcccaaattcgtggacggatcttacatgcagacttatcatagcagtgtccctacaggcgctaatattccctccccaacggattggctcaacgccctgtttgggaatggattatcaaggtggatcctgggcgtgatgggtgttcttttgggagggctcgcactgttctttctaattatgtctctgttcaagctcggcaccaaacaagtgtttcgctcacggactaagctggcgtga

SEQ ID NO: 11536 - RNA, 3222 nt, synthetic construct
  misc_feature 1..3222: note = derived and/or modified CDS sequence (opt3) from SFTSV(SPL005A)__AB817990.1__GP
  source 1..3222: mol_type = other RNA
atgatgaaggtgatctggttcagctccctgatttgcctcgtcatacagtgttctggcgacgcctcacccatcatttgcgctgggcctatccacagtaacaaaagcgcaaatattccacatcttctgggatactccgagaagatctgtcaaatagatagattgatccacgtttcttcgtggttaaggaaccattcacagtttcagggttatgtgggccagcgcgggggacggagccaagtaagttacttcccggccgaaaattcctattctcgatggagcggcctgctatccccctgcgacgcggattggctcggtatgctggtggtcaaaaaggctaaagggtcagacatgattgtgcctggaccaagttacaagggcaaggttttcttcgagcgtcccacctttgatggctatgtggggtggggatgtggtagcggcaaatctagaacagaatccggggagctttgctcaagcgacagtggaacttcttccggcctgttgcctagcgatagggtcctctggatcggtgacgtggcctgtcagccaatgacgcccattcctgaagagaccttcctggagctgaagtcgttttctcagtccgaatttccagatatctgcaaaatagacgggattgtatttaaccagtgtgagtcagaaagtctcccgcaacccttagatgttgcatggatggacgtgggacacagccataagatcattatgcgggagcacaaaacaaagtgggtccaggagtcctctagcaaggatttcgtgtgctacaaagaaggcactggcccttgttcagagagtgaagagaagacctgcaaaacatccgggagctgccgcggagacatgcagttttgtaaggtggccggttgcgaacacggcgaggaggcttctgaagcaaaatgtagatgctcactggtccataagccaggggaggttgtggtaagttatggaggcatgagggtgcggcccaaatgttacggtttcagccgcatgatggccacccttgaagtcaatcctttggagcagcgaatcgggcaatgcactggctgtcacctggaatgcatcaacggaggcgtgagactaattacactcacctccgagctgaagtctgctacggtttgtgcctcgcatttttgcagctccgcgacttcagggaagaaaagtaccgagatacagttccactctggaagccttgtgggtaagacagcaatccacgtcaaaggcgccctggtggacgggactgagttcacctttgaaggatcctgtatgttcccagatggctgcgacgctgtagattgcacattttgtagggagttcttgaagaatccccagtgctacccggccaaaaagtggctctttattatcatagttattctgttaggttatgcagggctgatgctccttaccaacgtgctgaaggctatcggcgtctggggatcatgggtgatcgcccctgtcaaattgatgttcgcgattatcaagaaactaatgcggagcgtgtcttgtctgatgggcaagctcatggaccgtgggcgccaagttattcatgaagaaataggagagaatagagagggtaaccaggatgacgtgaggatcgaaatggcccggccccgacgcgtaagacactggatgtactccccagtcattctgacgatccttgcaatcggcctggctgaggggtgcgatgaaatggtgcatgccgacagtaaattggttagctgtaagcagggaggcggtaatatgaaggagtgcgtgactacagggagggctctcctgcctgccgtcaaccccggccaggaggcatgtttacactttaccgccccaggatctcccgattccaaatgcctgaagattaaagtgaagcggataaatctaaaatgtaagaagtcaagtagctatttcgtacctgacgctcgctcgagatgcacttccgtgaggcgttgtcggtgggcgggcgattgccaatctgggtgcccaagccattttacatcaaacagtttctccgacgactgggcaggaaaaatggatcgagccggcctcggtttttctgggtgtagcgacggatgcggcggtgctgcctgtggctgcttcaatgcagccccgtcctgtatcttttggagaaagtgggttgaaaacccccacgggattatctggaaagtctcaccttgcgctgcctgggtgccaagcgcagtgattgagctgaccatgcccagtggagaagtcaggacgttccaccctatgtctggcatcccaacccaggttttcaagggggtgtccgtgacataccttggaagcgatatggaggtatcgggcttgactgacctgtgtgaaatagaggagctcaaatcaaagaaactggcgcttgctccctgcaaccaggccggtatgggggtcgtgggaaaggttggcgaaatccagtgttctagtgaggaatccgcacgcaccattaagaaagatggttgcatctggaatgccgacctggtgggcattgagttgcgggtcgatgacgctgtgtgttatagcaagatcacatctgttgaagccgtggcaaactacagcgctataccgactaccattgggggactcagatttgagaggtcccatgattcacaaggcaaaatcagtgggagccctctggacattacagccatccgcggatctttctccgtaaattatcgaggcttacggctgtcactaagtgagataaccgcgacttgcacgggtgaagtcacaaacgtgagcgggtgctactcctgtatgaccggagccaaggtgtctatcaaactccactcgagcaaaaattcaactgctcatgtccgttgcaagggcgatgagaccgcattttccgttctggaaggtgtgcacagttacacagtatctcttagcttcgaccacgccgtggtcgatgagcagtgtcagttgaactgcggcgggcatgaatcccaggtgaccctgaagggaaatctcatttttctggacgttccaaagttcgtggacggctcatatatgcaaacttaccactctagcgtccccacaggggctaacatccctagtcccacggattggttaaatgccctgtttggaaacggcctttccagatggattttgggtgtgatcggggttctcctgggaggcctagcactgttctttctcataatgagcctgttcaaacttggcaccaaacaggtgtttaggtctcgcactaagttggcgtga

SEQ ID NO: 11537 - RNA, 3222 nt, synthetic construct
  misc_feature 1..3222: note = derived and/or modified CDS sequence (opt3) from SFTSV(SPL010A)__AB817991.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctacttcccggcagaaaatagttattcccgatggtctggtctgctaagcccctgcgacgccgattggctcgggatgctggtggtcaaaaaggcgaaaggatccgacatgattgtgcctggcccatcatacaagggcaaggttttcttcgagcgtcccacatttgatgggtatgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacattcctggagctcaagagcttttcgcagtctgaatttccagatatctgcaaaatagacggaattgtatttaaccagtgtgagtccgaatcactgccgcaacccttcgatgttgcctggatggacgtgggccacagtcataagatcattatgcgggagcacaaaactaagtgggtccaggagagctcctctaaggattttgtgtgctacaaagaaggcaccgggccttgtagcgagtcagaagagaagacatgcaaaaccagtggatcctgccgcggtgacatgcagttctgtaaggtggcaggctgcgaacacggggaggaggccagcgaagctaaatgtagatgctctttagtccataagccaggagaggttgtggtatcatatggcggtatgagggtgcggcccaaatgttacgggtttagtcgcatgatggcaactctggaagtcaatagccctgagcagcgaatcggccaatgcacaggatgtcaccttgaatgcatcaacggcggggtgagattgattaccctgacgtccgagctaaagtctgccactgtttgtgcttcgcatttctgcagctccgccacctcaggaaagaaaagtacagagatacagttccactctggtagcctcgtgggcaagactgcgatccacgtcaaaggggcactggtggacggaaccgaatttacattcgagggctcctgtatgtttccagatggttgcgacgccgtagattgcaccttctgtagggaatttcttaagaatccccagtgctacccggctaaaaagtggctgttcattatcatagttattttgctcgggtatgccggcctgatgttactgacgaacgtgctcaaggcaatcggagtctggggctcatgggtgatcgctcctgtcaaacttatgtttgccattatcaagaaactgatgcggagcgtgtcttgtttgatggggaagctaatggaccgtggacgccaagttattcatgaggaaataggtgagaatagagagggcaaccaggatgacgtgaggatcgaaatggcgcggccccgacgcgtaagacactggatgtactccccagtcattctgactatcctcgccatcgggctggcagagggatgcgatgaaatggtgcatgctgacagtaaacttgttagctgtaagcagggctctggtaatatgaaggagtgcgtgacaaccgggagggccctgttgcctgctgtcaaccccggccaggaggcctgtctccacttcactgcaccaggatcccccgattcaaaatgcctgaagattaaagtgaagcggataaatttaaaatgtaagaagagtagctcgtattttgtacctgacgcccgctccagatgcacatctgtgaggcgttgtcggtgggctggcgattgccaaagcgggtgcccatcacatttcaccagtaactccttttctgacgactgggcgggaaaaatggatcgagcaggcctgggtttcagcgggtgttccgacggatgcggcggtgccgcttgtggctgctttaatgccgcaccgtcatgtatcttctggagaaagtgggttgaaaacccccacgggattatctggaaagtcagcccttgcgccgcttgggtgccaagtgccgtgattgagctaacgatgccctctggagaagtcaggaccttccaccctatgtccggcatcccaacacaggtttttaagggggtgagcgtgacttacctcggatcggatatggaggtatcaggcctgaccgacctttgtgaaatagaggagttgaaatctaagaaactggcactcgcgccctgcaaccaggctggtatgggggtcgtgggaaaggttggcgaaatccagtgtagttccgaggaaagcgcccgcacaattaagaaagatggttgcatctggaatgcagacctggtgggcattgagcttcgggtcgatgacgccgtgtgttattctaagatcactagcgttgaagctgtggccaactactccgcaataccgaccacaattgggggactgagattcgagaggtcacatgatagtcaaggcaaaatcagcgggtctcctttggacattaccactatccgcggatccttttcagtaaattatcgaggcctccggctgagtttaagcgagataacggctacatgcaccggtgaagtcactaacgtgtccgggtgctactcttgtatgaccggagcccgtgtgtcgatcaagctgcacagcagcaaaaattccacagcgcatgtcagatgcaagggcgatgagaccgccttcagtgttctagaaggtgtgcactcttacactgtaagcctctcctttgaccacgctgtggtcgatgagcagtgtcagctgaactgcggcgggcatgaatcacaggtgacacttaagggaaatttgattttcctggacgttccaaaatttgtggacggctcttatatgcaaacgtaccacagcagtgtccccaccggggcaaacatcccttcccccactgattggctcaatgccctgttcggaaacggcttatcaaggtggattctgggtgtgatcggggttcttttgggaggcctcgctctgtttttcctaataatgtctctgtttaagctcggcacaaaacaggtgttccgctcacggaccaagctggcctga

SEQ ID NO: 11538 - RNA, 3222 nt, synthetic construct
  misc_feature 1..3222: note = derived and/or modified CDS sequence (opt3) from SFTSV(SPL030A)__AB817992.1__GP
  source 1..3222: mol_type = other RNA
atgatgaaggtgatctggttcagctccctgatttgcctcgtcatacagtgttctggcgacacctcacccatcatttgcgccgggcctatccacagtaacaaaagcgcttccattccacatcttctgggatactctgagaagatctgtcaaatagatagattgatccacgtttcgtcatggttaaggaatcatagccagtttcagggttatgtgggccagcgcgggggacggagtcaagtatcctacttcccggcagaaaactcttatagccgatggtccggcctgctatcaccctgcgacgccgattggctcggtatgctggtggtcaaaaaggcgaaagggagtgacatgattgtgcctggaccaagctacaagggcaaggttttcttcgagcgtcccacatttgatggctatgtggggtggggatgtggttctggcaaatccagaactgaatcaggggagctttgcagcagtgactctggaacgtccagcggcctgttgccttcggatagggtcctctggatcggtgacgtggcttgtcagccaatgacccccattcctgaagagacattcctggagctgaagtctttttcccagtcagaatttccagatatctgcaaaatagacgggattgtatttaatcagtgtgagagtgaaagcctcccgcaacccttagatgttgcctggatggacgtgggacactcccataagatcattatgcgggagcacaaaactaagtgggtccaggagtctagctcaaaggatttcgtgtgctacaaagaaggcaccggcccttgtagtgagtccgaagagaagacatgcaaaaccagcgggtcttgccgcggagacatgcagttttgtaaggtggcaggttgcgaacacggcgaggaggcctcagaagctaaatgtagatgcagtctggtccataagccaggggaggttgtggtaagctatggaggcatgagggtgcggcccaaatgttacggtttctcccgcatgatggcaactcttgaagtcaaccctccagagttgcgaatcgggcagtgcacaggctgtcacctggaatgcatcaatggaggcgtgagactaattaccctcacgtctgagctgaagtcggccactgtttgtgctagccatttttgctcctcagccaccagtgggaagaaatctacagagatacaattccacagcggatcccttgtgggtaagactgcgatccacgtcaaaggcgcactggtggacgggaccgagttcacatttgaaggatcatgtatgttccccgatggctgcgacgccgtagattgcaccttttgtagggagttcttgaagaacccgcagtgctaccctgctaaaaagtggctctttattatcatagttattctgttaggttatgccgggctgatgctccttacgaatgtgctgaaggcaatcggcgtctggggaagctgggtgatcgctcccgtcaaattgatgttcgccattatcaagaaactaatgcggtctgtgtcctgtctgatgggcaagctcatggaccgtgggcgccaggttattcatgaagaaataggagagaacagagagggtaatcaagatgacgtgaggatcgaaatggcgcggccacgacgcgtaagacactggatgtacagtcctgtcattctgactatccttgccatcggcctggcagaggggtgcgatgaaatggtgcatgctgacagcaaattggtttcttgtaagcagggaggcggtaacatgaaggagtgcgtgacaaccgggagggccctcctgcccgctgtcaatccaggccaggaggcctgtttacactttactgcacccggatcccctgattcaaaatgcctgaagattcgggtgaaacgcataaacctaaagtgtaaaaagagtagctcgtatttcgtaccagacgccagatccaggtgcacatctgtgcgtcggtgtcgatgggctggcgattgccagagcgggtgcccgtcacattttaccagtaattccttctctgacgactgggcgggaaagatggatagagcaggcctcggttttagcgggtgttccgacggatgcggcggtgccgcttgtggctgcttcaacgccgcaccctcatgtatcttttggaggaaatgggttgaaaatcctcacgggattatctggaaggtcagcccatgcgccgcttgggtgcccagtgccgtgattgagctgacgatgccttctggagaagtccgcaccttccacccaatgtccggcatccccacacaagttttcaaaggggtgagcgtgacttaccttggatcggatatggaggtatcaggcttgaccgacctgtgtgaaatagaggagctcaagtctaaaaagctggcacttgcgccgtgcaaccaggctggtatgggggtcgtgggaaaagttggcgaaatccagtgtaacagtgaggaatccgcccggacaattaagaaggatggttgcatctggaatgcagacctggtgggcattgagttgagagtcgatgacgccgtgtgttatagcaaaatcacttctgttgaagctgtggccaactacagcgcaatacctaccacaattgggggactcaggtttgagcgctcccatgattcacagggcaagatcagtgggagcccactggacattaccgctatccgaggatctttctccgtaaattatcggggcttacgtctgtcactaagtgagataactgccacgtgcacaggtgaagtcaccaacgtgagcgggtgctactcctgtatgactggagcgaaagtgtctatcaagctccactcgagcaaaaattcaaccgcccatgtcagatgcaagggcgatgagacagctttttccgttctggaaggtgtgcacagttacaccgtatctcttagcttcgaccacgcagtggtcgatgagcaatgtcagttgaactgcggcgggcatgaatcccaggtgactctgaagggaaatctcatttttctggacgttcccaaattcgtggacggctcatatatgcagacataccactctagcgtccctacgggggccaacatccccagtccaaccgattggttaaatgctctgtttggaaacggcctttccaggtggattttgggtgtgatcggggttctcctgggaggcctagccctgttctttctcataatgagcctgttcaaacttggcactaagcaagtgtttcgctctcggacaaagttggcatga

SEQ ID NO: 11539 - RNA, 3222 nt, synthetic construct
  misc_feature 1..3222: note = derived and/or modified CDS sequence (opt3) from SFTSV(SPL053A)__AB985292.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaggtgctaatattccacatcttctgggctacagtgagaagatctgtcaaatagatagattgatccacgttagctcctggttaaggaaccattctcagtttcaggggtatgtgggacagcggggcggtcgctcgcaagtatcatacttcccggcagaaaatagctatagtcgatggtccgggctgctatctccctgcgacgccgattggctcggaatgctggtggtcaaaaaggcgaaaggcagcgacatgattgtgcctggcccatcctacaaggggaaggttttcttcgagcgtcccacatttgatggatatgtgggttggggctgtgggtcaggaaaaagtagaactgaaagcggcgagctttgcatctctgactccggtacgtcaagcgggctgttgcctagtgatagggtcctctggattggagacgtggcttgtcagccaatgacccccatccctgaagagacattcctggagctgaagtctttttcccagagcgaatttccagatatatgcaaaattgacggcatcgtatttaaccagtgtgagtcggaatctctcccgcaacccttcgatgttgcctggatggacgtgggccactcccataagattatcatgcgggagcacaaaactaagtgggtccaggagtcaagtagcaaggattttgtgtgctacaaagaagggaccggaccttgttccgagtctgaagagaagacatgcaaaaccagcggttcatgccgcggcgacatgcagttctgtaaggtggcagggtgcgaacacggagaggaggccagtgaagctaaatgtagatgctccttagtccataagccaggcgaggttgtggtaagctatggtgggatgagggtgcggcccaaatgttacggcttttctcgcatgatggcaactctggaagtcaattcacctgagcagcgaatcggacaatgcacaggctgtcaccttgaatgcattaacgggggagtgagattgataaccctgacgagtgagctaaagagcgccactgtttgtgcttcccatttctgttcttcggccaccagcggtaagaaatccacagagatccagttccactcaggcagtctcgtggggaagactgcgattcacgtcaaaggagcactggtggacggcaccgaatttacattcgagggttcttgcatgtttccagatgggtgcgacgccgtagattgcaccttctgtagggaatttcttaagaatccccagtgctacccggctaaaaagtggctgttcatcataattgttatcttgctcggctatgccggactgatgttactgacgaacgtgctcaaggcaatcggcgtctgggggagctgggtgattgctcctgtcaaacttatgtttgccatcattaagaaactgatgcggtccgtgtcatgtttgatgggaaagctaatggaccgtggtcgccaagttatacatgaggaaatcggcgagaatagagaggggaaccaggatgacgtgaggattgaaatggcgcggccccgacgcgtaagacactggatgtacagcccagtcatcctgactatcctcgccattggactggcagagggctgcgatgaaatggtgcatgctgactctaaacttgtttcctgtaagcagggtagtgggaatatgaaggagtgcgtgacaaccggcagggccctgttgcctgctgtcaaccccggacaggaggcctgtctccacttcactgcaccaggcagccccgattctaaatgcctgaagataaaagtgaagcggatcaatttaaaatgtaagaagtcctcaagttattttgtacctgacgcccgcagcagatgcacatcggtgaggcgttgtcggtgggctggggattgccaatccggatgcccatctcatttcaccagcaactcatttagtgacgactgggcgggcaaaatggatcgagcaggtctggggttctccggatgttctgacggctgcggtggcgccgcttgtgggtgctttaatgccgcaccgagctgtattttctggagaaagtgggttgaaaacccccacggaatcatttggaaagtctccccttgcgccgcttgggtgccatcagccgtgatcgagctaacgatgcccagcggcgaagtcaggaccttccaccctatgagtgggataccaacacaggtttttaagggagtgtctgtgacttacctcggctccgatatggaggtaagcggtctgaccgacctttgtgaaatcgaggagttgaaatcgaagaaactggcactcgcgccctgcaaccaggctgggatgggagtcgtgggcaaggttggtgaaattcagtgttcatctgaggaaagtgcccgcacaatcaagaaagatggctgcatttggaatgcagacctggtggggatcgagcttcgggtcgatgacgccgtgtgttattccaagataactagcgttgaagctgtggccaactactctgcaattccgaccacaatcggaggcctgagattcgagaggagccatgattcccaagggaaaatttcaggaagtcctttggacatcaccgctatacgcggcagcttttctgtaaattatcgaggtctccggctgtccttatcagagatcactgccacgtgcacaggggaagtcaccaacgtgagtggatgctacagctgtatgactggcgcgcgtgtgtccattaagctgcactcttcgaaaaatagcaccgcccatgtcagatgcaagggtgatgagacagctttctcagttctagaaggcgtgcactcctacaccgtaagtctctcttttgaccacgcagtggtcgatgagcagtgtcagctgaactgcgggggacatgaaagccaggtgactcttaagggcaatttgatcttcctggacgttccaaaatttgtggacgggtcctatatgcaaacataccactcatctgtccccacgggagccaacattcctagccccaccgattggctcaatgctctgttcggcaacggtttaagtaggtggatcctgggggtgataggagttcttttgggcggcctcgccctgtttttcctaattatgtccctgtttaagctcgggactaaacaggtgttccgcagccggacaaagctggcatga

SEQ ID NO: 11540 - RNA, 3222 nt, synthetic construct
  misc_feature 1..3222: note = derived and/or modified CDS sequence (opt3) from SFTSV(SPL054A)__AB985293.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctacttcccggcagaaaatagttattcccgatggtctggtctgctaagcccctgcgacgccgattggctcgggatgctggtggtcaaaaaggcgaaaggatccgacatgattgtgcctggcccatcatacaagggcaaggttttcttcgagcgtcccacatttgatgggtatgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacattcatggagctaaagagcttttcgcagtctgaatttccagatatctgcaaaatagacggaattgtatttaaccagtgtgagtccgaatcactgccgcaacccttcgatgttgcctggatggacgtgggccacagtcataagatcattatgcgggagcacaaaactaagtgggtccaggagagctcctctaaggattttgtgtgctacaaagaaggcaccgggccttgtagcgagtcagaagagaagacatgcaaaaccagtggatcctgccgcggtgacatgcagttctgtaaggtggcaggctgcgaacacggggaggaggccagcgaagctaaatgtagatgctctctcgtccataagccaggagaggttgtggtatcatatggcggtatgagggtgcggcccaaatgttacgggtttagtcgcatgatggcaactttagaagtcaatcctccagagcagcgaatcggccaatgcacaggatgtcacctggaatgcatcaacggcggggtgagacttattaccttgacgagcgagctgaagtccgccactgtttgtgcttctcatttctgctcgagcgccacctccggaaagaaatcaacagagatacagttccacagtggttctctagtgggcaagactgcgatccacgtcaaaggggcactcgtggacggaaccgaatttacattcgagggcagctgtatgtttcccgatggttgcgacgccgtagattgcaccttctgtagggaatttctgaagaatccgcagtgctaccctgctaaaaagtggcttttcattatcatagttattctgttggggtatgccggcctcatgctgttaacgaacgtgctgaaggcaatcggagtctggggctcctgggtgatcgctcccgtcaaactcatgtttgccattatcaagaaacttatgcggtcagtgagctgtctgatggggaagttgatggaccgtggacgccaagttattcatgaggaaataggtgagaatggcgaggggaaccaggatgacgtgagaatcgaaattgcgaggccacggcgagtacgccactggatgtactctcctgtcatcctaactatcctggccattggactcgcagagggctgcgatgaaatggtgcatgctgactccaaactggttagttgtaagcagggtagcgggaatatgaaggagtgcgtgacaaccggcagagcccttctgcccgctgtcaacccaggacaggaggcctgtttgcacttcactgcacccggctctcctgattccaaatgcctcaagataaaagtgaagaggatcaatctgaaatgtaagaagtcaagtagctattttgtaccagacgcccggtcgcgctgcacatccgtgagaaggtgtcgttgggctggggattgccaatctggatgcccgagccatttcacctcaaacagtttttccgacgactgggcgggcaaaatggatcgggcaggtttagggttctctggatgtagcgacggctgcggtggcgccgcttgtgggtgctttaatgccgcaccctcctgtattttctggcgaaagtgggttgaaaaccctcacggaatcatttggaaagtctcaccatgcgccgcttgggtgcccagcgccgtgatcgagctgacgatgcctagtggcgaagtcagaaccttccacccaatgtctgggatacccacacaggtttttaagggagtgtccgtgacttacctaggcagcgatatggaggtatcgggtctcaccgacctgtgtgaaatcgaggagcttaaatcaaagaaattggcactggcgccgtgcaaccaggctgggatgggagtcgtgggcaaggttggtgaaattcagtgttctagtgaggaatccgccaggacaatcaagaaagatggctgcatttggaatgcagacctcgtggggatcgagctgcgcgtcgatgacgccgtgtgttatagcaagataacttctgttgaagctgtggccaactacagcgcaattcctaccacaatcggaggccttcggttcgagagatcccatgattcacaagggaaaattagtggaagcccactggacatcaccgctataaggggctctttttccgtaaattatcgcggtttgcgactctcactgagtgagatcactgccacgtgcacaggggaagtcaccaacgtgagcggatgctactcctgtatgactggcgcgaaggtgtctattaaattacactcgagcaaaaattcaaccgcccatgtccggtgcaagggtgatgagacagctttctccgttctggaaggcgtgcacagttacaccgtatctctgagctttgaccacgcagtggtcgatgagcagtgtcagctcaactgcgggggacatgaatcccaggtgactctgaagggcaatcttatcttcttggacgttccccgttttgtggacgggtcatatatgcaaacataccactctagcgtccctacgggagccaacattcccagtccaaccgattggctgaatgctctcttcggcaacggtctgtccagatggatcttaggggtgataggagttctgcttggcggcttggccctctttttcctgattatgagcctatttaagctggggactaaacaggtgttcaggtctcgcacaaagctcgcatga

SEQ ID NO: 11541 - RNA, 3222 nt, synthetic construct
  misc_feature 1..3222: note = derived and/or modified CDS sequence (opt3) from SFTSV(SPL055A)__AB985294.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctacttcccggcagaaaatagttattcccgatggtctggtctgctaagcccctgcgacgccgattggctcgggatgctggtggtcaaaaaggcgaaaggatccgacatgattgtgcctggcccatcatacaagggcaaggttttcttcgagcgtcccacatttgatgggtatgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacattcctggagctcaagagcttttcgcagtctgaatttccagatatctgcaaaatagacggaattgtatttaaccagtgtgagtccgaatcactgccgcaacccttcgatgttgcctggatggacgtgggccacagtcataagatcattatgcgggagcacaaaactaagtgggtccaggagagctcctctaaggattttgtgtgctacaaagaaggcaccgggccttgtagcgagtcagaagagaagacatgcaaaaccagtggatcctgccgcggtgacatgcagttctgtaaggtggcaggctgcgaacacggggaggaggccagcgaagctaaatgtagatgctctttagtccataagccaggagaggttgtggtatcatatggcggtatgagggtgcggcccaaatgttacgggtttagtcgcatgatggcaactctggaagtcaatagccctgagcagcgaatcggccaatgcacaggatgtcaccttgaatgcatcaacggcggggtgagattgattaccctgacgtccgagctaaagtctgccactgtttgtgcttcgcatttctgcagctccgccacctcaggaaagaaaagtacagagatacagttccactctggtagcctcgtgggcaagactgcgatccacgtcaaaggggcactggtggacggaaccgaatttacattcgagggctcctgtatgtttccagatggttgcgacgccgtagattgcaccttctgtagggaatttcttaagaatccccagtgctacccggctaaaaagtggctgttcattatcatagttattttgctcgggtatgccggcctgatgttactgacgaacgtgctcaaggcaatcggagtctggggctcatgggtgatcgctcctgtcaaacttatgtttgccattatcaagaaactgatgcggagcgtgtcttgtttgatggggaagctaatggaccgtggacgccaagttattcatgaggaaataggtgagaatagagagggcaaccaggatgacgtgaggatcgaagtagcgcggccccgacgcgtcagacactggatgtactccccagtgattctgactatcctcgccatcgggctggcagagggatgcgatgaaatggttcatgctgacagtaaacttgtgagctgtaagcagggctctggtaatatgaaggagtgcgtcacaaccgggagggccctgttgcctgctgtgaaccccggccaggaggcctgtctccacttcactgcaccaggatcccccgattcaaaatgcctgaagattaaagtaaagcggataaatttaaaatgtaagaagagtagctcgtattttgtgcctgacgcccgctccagatgcacatctgttaggcgttgtcggtgggctggcgattgccaaagcgggtgcccatcacatttcaccagtaactccttttctgacgactgggcgggaaaaatggatcgagcaggcctgggtttcagcgggtgttccgacggatgcggcggtgccgcttgtggctgctttaatgccgcaccgtcatgtatcttctggagaaagtgggtcgaaaacccccacgggattatctggaaagtgagcccttgcgccgcttgggtgccaagtgccgtcattgagctaacgatgccctctggagaagttaggaccttccaccctatgtccggcatcccaacacaggtgtttaagggggtgagcgtaacttacctcggatcggatatggaggtctcaggcctgaccgacctttgtgaaatagaggagttgaaatctaagaaactggcactcgcgccctgcaaccaggctggtatgggggtggttggaaaggtgggcgaaatccagtgtagttccgaggaaagcgcccgcacaattaagaaagatggttgcatctggaatgcagacctggtcggcattgagcttcgggtggatgacgccgtttgttattctaagatcactagcgtggaagctgtagccaactactccgcaataccgaccacaattgggggactgagattcgagaggtcacatgatagtcaaggcaaaatcagcgggtctcctttggacattaccgctatccgcggatccttttcagtcaattatcgaggcctccggctgagtttaagcgagataactgccacgtgcacaggtgaagtgaccaacgtgtccgggtgctactcttgtatgactggagcgcgtgtctcgatcaagctgcacagcagcaaaaattccaccgcccatgttagatgcaagggcgatgagacagctttcagtgtgctagaaggtgtacactcttacaccgtgagcctctcctttgaccacgcagtcgtggatgagcagtgtcagctgaactgcggcgggcatgaatcacaggttactcttaagggaaatttgattttcctggacgtgccaaaatttgtcgacggctcttatatgcaaacataccacagcagtgtgcccacgggggccaacatcccttcccccaccgattggctcaatgctctgttcggaaacggcttatcaaggtggattctgggtgttatcggggtgcttttgggaggcctcgccctgtttttcctaataatgtctctgtttaagctcggcactaaacaggtcttccgctcacggacaaagctggcatga

SEQ ID NO: 11542 - RNA, 3222 nt, synthetic construct
  misc_feature 1..3222: note = derived and/or modified CDS sequence (opt3) from SFTSV(SPL057A)__AB985295.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctgatattccacatcttctgggttacagcgagaagatctgtcaaatagacagattgatccacgtttcctcttggttaaggaatcattcgcagtttcagggctatgtggggcagcggggaggccgctcacaagtaagctactatccggcagaaaacagttactcccgatggtctggtctgctaagcccctgcgatgccgactggctcgggatgctggtggtcaaaaaggcgaaaggatccgatatgattgtgcctggcccatcatataagggcaaggttttctttgagcgtcccacattcgacgggtacgtgggatggggttgtggcagtgggaaaagcagaactgaatctggagagctttgctcctcagatagcggcacgagttctggtctgttgccttccgacagggtcctctggatcggggatgtggcttgtcagccaatgacccccattcctgaagagacatttctggagcttaagagcttctcgcagtctgaatttccagacatctgccggatagatggaattgtattcaatcagtgtgagtccgaatcactcccgcaaccctttgacgttgcctggatggatgtgggccacagtcataaaatcattatgcgcgagcacaagactaaatgggtccaggagagctcctctaaggacttcgtgtgctataaggaaggcaccgggccttgtagcgagtcagaagagaaaacatgcaagaccagtggatcctgcagaggtgacatgcagttttgtaaagtggcaggctgcgaacacggggaggaggccagcgaagctaagtgtaggtgctctttagtccataaaccaggagaggttgtggtatcatacggcggtatgcgggtgcgccccaagtgttacgggttcagtcgaatgatggcaactctggaagtcaaccctccagagcagagaatcggccaatgcacaggatgtcaccttgaatgcgtgaatggcggggttaggttgatcaccctgacgagcgagctaaaatccgccactgtgtgtgcttctcatttttgctcgagcgccatttccggaaagaagtcaaccgagatacagttccacagtggttctctcgtcggcaaaacagcgatccacgtgaagggggcactggtagatggaactgaatttacctttgagggcagctgtatgttccccgacggttgcgatgccgttgactgcacattttgtcgggagttccttaaaaacccgcagtgctatcctgctaagaaatggctgtttattatcatagtgattttgctcgggtacgccggcctgatgttactgaccaatgtcctcaaggcaatcggagtgtggggctcctgggtcatcgctcccgtgaagctgatgttcgccattatgaaaaagctgatgcgttcagttagctgtttgatggggaaactaatggatcgcggaagacaagtgatccatgaagaaattggtgagaacagggagggcaatcaggacgatgtacggatagaaatggcgcgaccacgcagagtcaggcactggatgtattctcctgtgatcctgacgattctcgccgttgggctggcagagggatgcgacgaaatggtgcatgctgattccaaacttgtcagttgtaagcagggcagcggtaacatgaaggagtgcgtgactacagggcgggccctgttgcccgctgtaaatccaggccaggaggcctgtctccactttaccgcacccggatctcctgactccaagtgcctgaaaatcaaggtgaaaaagatcaacttaaaatgtaagaagtcaagtagctacttcgttccagatgcccgctcgagatgcacttccgtcaggcgttgtcggtgggctggcgactgccaatctgggtgcccgagccattttacatcaaatagtttctccgacgattgggcgggaaaaatggaccgagcaggcctgggtttttctgggtgtagcgatggatgcggcggtgccgcttgtggctgcttcaacgccgcaccctcctgtattttctggagaaagtgggtggaaaatcctcacgggataatctggaaagtgtcaccatgcgccgcttgggtccccagcgccgttattgagctaaccatgcctagtggagaagtgaggacgttccacccaatgtctggcatccccacccaggtgttcaagggggtatccgtcacatatctcggaagcgacatggaggtgtcgggcctgactgatctttgtgaaattgaggagttgaaatcaaagaaactggcactcgcgccgtgcaaccaggctggtatgggggttgtgggaaaggtcggcgaaatccagtgttctagtgaggaatccgcccgcaccataaagaaagacggttgcatctggaacgcagatctggtgggcattgagcttcgggttgacgatgccgtgtgttacagcaagatcacatctgtagaagctgtcgccaattatagcgcaattcctactaccatcgggggactgagatttgagaggtcccatgactcacaaggcaaaataagtgggagcccattggatattacagctatccgcggatctttctccgtgaactaccgaggcctccggctgtcattaagtgagattaccgccacttgcacgggtgaagtgacaaatgtcagcgggtgctactcctgtatgaccggagcgaaggtttctatcaaactgcactcgaacaagaatagcactgcccatgtgcgttgcaagggcgacgagaccgctttttcagtactagaaggtgtgcactcctatacagtcagtctctctttcgatcacgcagtggttgacgagcagtgtcagctgaactgcggcgggcatgaaagccaggtgacccttaaaggaaatttgatatttctggacgtccccaagttcgtggatggctcctacatgcaaacttatcactcatctgttcctacaggggccaacatccccagcccaacggactggctcaatgctctgtttggaaacggcttaagtagatggattctgggtgtgatcggggtccttttgggaggcctcgccctgttctttctaattatgtccctgttcaaactcggcaccaagcaggtatttaggagccgcactaaactggcatga

SEQ ID NO: 11543 - RNA, 3222 nt, synthetic construct
  misc_feature 1..3222: note = derived and/or modified CDS sequence (opt3) from SFTSV(SPL062A)__AB985297.1__GP
  source 1..3222: mol_type = other RNA
atgatgaaggtgatctggttcagctccctgatttgcctcgtcataagatgttctggcgggaccggacccatcatttgcgccggtcctatccactcaaacaaaagtgctaatattccacatcttctgggctacagcgagaagatctgtcagatagacaggttgatccacgtttcctcttggttacggaaccattcgcaatttcaggggtatgtgggacagcgcggcggtcgatcacaggtaagctacttcccggcagaaaatagttattcccgttggtctgggctgctaagcccctgcgatgccgactggctcggaatgctggtggtcaaaaaggcgagaggctccgatatgattgtgcctggcccatcatacaaagggaaggttttcttcgagaggcccacatttgacggatatgtgggttggggctgtgggagtggaaagagccggactgaatctggcgagctttgctcctcagatagcggtacgagttctgggctgttgccttccgaccgcgtcctctggatcggagatgtggcttgtcaaccaatgacccccattcctgaagagacattcctggagctgaaatcgtttagccagtctgaatttccagacatctgcaagatagatggcattgtatttaaccagtgtgagtccgaatcactcccgcagcccttcgacgttgcctggatggatgtgggccacagtcataaaatcattatgagagagcacaagactaaatgggtccaagagagctcctctaaggactttgtgtgctacaaggaagggaccggaccttgtagcgagtcagaagagaaaacatgcaagaccagtggttcctgcaggggcgatatgcagttctgtaaagtggcagggtgcgaacacggagaggaggccagcgaagctaagtgtcggtgctctttagtccataaaccaggcgaggttgtggtatcatatggtgggatgcgcgtgcgacccaagtgttacggctttagtagaatgatggcaactctggaagtcaatcctccagagcagaggatcggacagtgcacaggctgtcaccttgaatgcatcaacgggggagtgcggttgattaccctgacgagcgagctaaaatccgccactgtttgtgcttctcatttctgctcgagcgccacctccggtaagaagtcaacagagatacaattccacagtggctctctcgtggggaaaactgcgatccacgtcaagggagcactggtggacggcaccgaatttacattcgagggtagctgtatgtttcccgacgggtgcgatgccgtagactgcaccttctgtcgtgaatttcttaaaaatccgcagtgctaccctgctaagaaatggctgttcattatcatagccattttgctcggctatgcaggactgatgttactgacgaacgttctcaaggctatcggcgtgtgggggtcctgggtcatcgcccccgtgaaacttatgtttgcgattatcaaaaagctgatgcgctcagtcagctgtttgatgggaaaactaatggatagaggtaggcaagtgattcatgaggaaataggcgagaatcgggaggggaaccaggacgatgttcgaatcgaaatggcccgcccaagaagggtgcggcactggatgtactctcctgtaattctgactatcctcgcaatcggactggctgagggctgcgacgaaatggtccatgccgattccaaacttgtgagttgtaagcagggtagcgggaatatgaaggagtgcgttacaaccggccgcgctctgttgcccgccgtgaacccaggacaggaggcatgtctccacttcactgcccccggctctcctgactccaagtgcctgaaaattaaggtcaaaagaataaatttaaagtgtaaaaagtcaagtagctattttgtgccagatgctaggtcgcgttgcacatccgtacggcgatgtagatgggcgggggactgccagtctggatgcccgagccatttcacctcaaacagtttttccgatgactgggcaggcaagatggacagggccggtctggggttctctggatgtagcgatggctgcggtggcgctgcctgtgggtgctttaatgcagccccctcctgtatcttctggcgcaaatgggtggaaaaccctcacggaattatctggaaggtttcaccatgcgctgcctgggtccccagcgcagtgattgagctaacgatgcctagtggcgaagtgcggaccttccacccaatgtctgggatccccacacaagtctttaaaggagtttccgtgacttacctcggcagcgacatggaggtgtcgggtctgaccgatctttgtgaaatagaggagttgaagtcaaagaagctggcgctcgctccgtgcaaccaggccgggatgggagtagtcggcaaagtgggtgaaatccagtgttctagtgaggaatccgcaagaacaattaagaaggacggctgcatctggaatgccgatctggttgggattgagcttagggtggacgatgctgtctgttatagcaaaatcacttctgtggaagccgttgcaaactacagcgctatacctaccacaattggaggcctgcgcttcgagcgatcccatgactcacaggggaagatcagtggaagcccattggatattaccgccatccggggctctttttccgtgaattatcgtggtctcagactgtcattaagtgagataactgcgacgtgcacaggggaagtaaccaacgtcagcggatgctactcctgtatgactggcgccaaagtgtctatcaagctgcactcgagcaaaaattcaaccgctcatgtgaggtgcaagggtgacgagacagcattctccgtcctagaaggcgttcacagttacaccgtgtctctcagctttgatcacgccgtagtggacgagcaatgtcagctgaactgcgggggacatgaatcccaggtcactcttaagggcaatttgattttcctggatgtgcccaaatttgttgacgggtcatatatgcagacataccactctagcgtgcctacgggagctaacatccccagtccaaccgactggctcaatgccctgttcggcaacggtttatcccgctggattctgggggtcatcggagtgcttttgggcggcctcgcactgtttttcctaataatgagcctgtttaagctcgggactaaacaagttttccggtctagaacaaagctggcgtga

SEQ ID NO: 11544 - RNA, 3222 nt, synthetic construct
  misc_feature 1..3222: note = derived and/or modified CDS sequence (opt3) from SFTSV(SPL066A)__AB985298.1__GP
  source 1..3222: mol_type = other RNA
atgatgaaggtgatctggttcagctccctgatttgcctcgtcatacagtgttctggcgacgcctcacccatcatttgcgctgggcctatccacagtaacaaaagcgcaaatattccacatcttctgggatactccgagaagatctgtcaaatagatagattgatccacgtttcttcgtggttaaggaaccattcacagtttcagggttatgtgggccagcgcgggggacggagccaagtaagttacttcccggccgaaaattcctattctcgatggagcggcctgctatccccctgcgacgcggattggctcggtatgctggtggtcaaaaaggctaaagggtcagacatgattgtgcctggaccaagttacaagggcaaggttttcttcgagcgtcccacctttgatggctatgtggggtggggatgtggtagcggcaaatctagaacagaatccggggagctttgctcaagcgacagtggaacttcttccggcctgttgcctagcgatagggtcctctggatcggtgacgtggcctgtcagccaatgacgcccattcctgaagagaccttcctggagctgaagtcgttttctcagtccgaatttccagatatctgcaaaatagacgggattgtatttaaccagtgtgagtcagaaagtctcccgcaacccttcgatgttgcatggatggacgtgggacacagccataagatcattatgcgggagcacaaaacaaagtgggtccaggagtcctctagcaaggattttgtgtgctacaaagaaggcactggcccttgttcagagagtgaagagaagacctgcaaaacatccgggagctgccgcggagacatgcagttctgtaaggtggccggttgcgaacacggcgaggaggcttctgaagcaaaatgtagatgctcattagtccataagccaggggaggttgtggtaagttatggaggcatgagggtgcggcccaaatgttacggttttagccgcatgatggccaccctggaagtcaatcctccagagcagcgaatcgggcaatgcactggctgtcaccttgaatgcatcaacggaggcgtgagattgattacactgacctccgagctaaagtctgctacggtttgtgcctcgcatttctgcagctccgcgacttcagggaagaaaagtaccgagatacagttccactctggaagcctcgtgggtaaggcagccatccacgtcaaaggcgctctggtggacgggacagaatttactttcgagggatcctgtatgtttcccgatggctgcgacgccgtagattgcaccttctgtagggaatttcttaagaatccgcagtgctaccctgccaaaaagtggctgttcattatcatagttattttgctcggttatgctgggctgatgttactgacaaacgtgctcaaggccatcggcgtctggggatcatgggtgatcgcgcccgtcaaacttatgtttgccattatcaagaaactgattcggagcgtgtcttgtttgatgggcaagctaatggaccgtgggcgccaagttatacatgaggaaatcggagagaatggtgagggcaaccaggatgacgtgagaattgaaatggcaaggccacggcgagtacgccactggatgtactcccctgtcatcctgaccatcctcgctattgggctggccgagggatgcgatgaaatggtgcatgctgacagtaaacttgttagctgtaagcagggctctggtaatatgaaggagtgcgtgacgactgggagagccctgttgcccgcagtcaacccaggccaggaggcctgtctccacttcacagctcccggatcccctgattcaaaatgcctgaagataaaagtgaagaggatcaatttaaaatgtaagaagagtagctcgtattttgtaccagacgcgcggtcccgctgcacctctgtgagaaggtgtcgttgggcaggcgattgccaaagcgggtgcccgtcacatttcacttcaaactccttttctgacgactgggccggaaaaatggatcgggctggcctgggtttcagcgggtgttccgacggatgcggcggtgccgcatgtggctgctttaatgccgctccctcatgtattttctggcgaaagtgggttgaaaaccctcacgggatcatttggaaagtcagcccatgcgccgcatgggtgcccagtgcggtgatcgagctaacaatgccttctggagaagtcagaaccttccacccaatgtccggcatacccacgcagatctttaagggggttagcgtgacctacctcggatcggatatggaggtgtcaggcctgacagacctttgtgaaattgaggagttgaggtctaaaaagctggctctcgccccgtgcaaccaggcaggtatgggggtagtcggaaaagtgggcgaaatccagtgtagttccgaggaaagcgcccgcactattaagaaggatggttgcatctggaatgctgacctggttggcatagagcttcgggtggatgacgccgtctgttattctaaaattaccagcgtggaagcagttgctaactactccgccatccctacaactattgggggactgagattcgagaggtcacatgatagtcaaggcaagatcagcgggtctccattggacataaccgcgatccgcggatccttttcagtgaattatcgaggcctccggctgagtttaagcgagattacagcaacctgcactggtgaagtaacgaacgtctccgggtgctactcttgtatgacaggagctaaagtgtcgatcaagctgcacagcagtaaaaattccaccgcacatgtgcgttgcaagggcgatgagactgccttcagtgtcctagaaggtgttcactcttacaccgtgagcctctcctttgaccacgctgtagtggatgagcagtgtcagctgaactgcggcgggcatgaatcacaggtcacacttaagggaaatttgattttcctggacgtgcccaaatttgttgacggctcttatatgcaaacctaccacagcagtgtgcctactggggccaacatcccctccccaacagattggctcaatgcactgttcggaaacggcttaagcagatggatactgggtgtcattggggtgcttttgggaggcctcgcgctgtttttcctaatcatgtctctgtttaagctcggcacgaaacaggttttcaggtcacgcaccaagctggcctga

SEQ ID NO: 11545 - RNA, 3222 nt, synthetic construct
  misc_feature 1..3222: note = derived and/or modified CDS sequence (opt3) from SFTSV(SPL070A)__AB985301.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctacttcccggcagaaaatagttattcccgatggtctggtctgctaagcccctgcgacgccgattggctcgggatgctggtggtcaaaaaggcgaaaggatccgacatgattgtgcctggcccatcatacaagggcaaggttttcttcgagcgtcccacatttgatgggtatgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacattcatggagctaaagagcttttcgcagtctgaatttccagatatctgcaaaatagacggaattgtatttaaccagtgtgagtccgaatcactgccgcaacccttcgatgttgcctggatggacgtgggccacagtcataagatcattatgcgggagcacaaaactaagtgggtccaggagagctcctctaaggattttgtgtgctacaaagaaggcaccgggccttgtagcgagtcagaagagaagacatgcaaaaccagtggatcctgccgcggtgacatgcagttctgtaaggtggcaggctgcgaacacggggaggaggccagcgaagctaaatgtagatgctctctcgtccataagccaggagaggttgtggtatcatatggcggtatgagggtgcggcccaaatgttacgggtttagtcgcatgatggcaactttagaagtcagccctccagagcagcgaatcggccaatgcacaggatgtcacctggaatgcatcaatggcggggtgagacttattaccttgacgtccgagctgaagtctgccactgtttgtgcttcgcatttctgcagctccgccacctcaggaaagaaaagtacagagatacagttccactctggtagcctagtgggcaagactgcgatccacgtcaaaggggcactcatggacggaaccgaatttacattcgagggctcctgtatgtttcccgatggttgcgacgccgtggattgcaccttctgtagggaatttctgaagaacccgcagtgctaccctgctaaaaagtggcttttcattatcatagtaattctgttggggtatgccggcctcatgctgttaacgaatgttctgaaggcaatcggagtgtggggctcatgggtcatcgctcccgtgaaactcatgtttgccattatcaagaaacttatgcggagcgtctcttgtctgatggggaagttgatggaccgtggacgccaagtgattcatgaggaaataggtgagaacggcgaggggaatcaggatgacgttagaatcgaaatggcgaggccacggcgagtgcgccactggatgtactcccctgtaattctaactatcctggccatcggactcgcagagggctgcgatgaaatggtccatgctgacagtaaactggtgagctgtaagcagggttctgggaacatgaaggagtgcgttacaaccggcagagcccttctgcccgctgtgaatccaggacaggaggcctgtttgcacttcactgcacccggctcccctgattcaaaatgcctcaagattaaagtcaagaggataaacctgaaatgtaagaagagtagctcgtattttgtgccagacgcccggtcccgctgcacatctgtaagaaggtgtcgttgggctggggattgccaaagcggatgcccgtcacatttcaccagtaattccttttctgacgactgggcgggcaaaatggatcgggcaggtttagggttcagcggatgttccgacggctgcggtggcgccgcttgtgggtgctttaacgccgcaccctcatgtatcttctggcgaaagtgggtggaaaatcctcacggaattatctggaaagttagcccatgcgccgcttgggtccccagtgccgtgattgagctgacgatgccttctggcgaagtgagaaccttccacccaatgtccgggatccccacacaggtctttaagggagttagcgtgacttacctaggctcggatatggaggtgaccggtctcacagacctgtgtgaaatagaggagcttaaatcaaagaaattggcactggcgccgtgcaaccaggctgggatgggagtagtcggcaaggtgggtgaaatccagtgttctagtgaggaatccgccaggactattaagaaagatggctgcatctggaacgcagacctcgttgggattgagctgcgcgtggatgacgccgtctgttatagcaagatcacctctgtggaagctgttgccaattacagcgcaatacctacaaccattggaggccttcggttcgagagatcccatgattcacaagggaaaatcagtggaagcccactggacattactgctatcaggggctctttttccgtgaactatcgcggtttgcgactctcactgagtgagataacggccacatgcaccggggaagtaactaatgtcagcggatgctactcctgtatgaccggcgcgaaggtgtctatcaaattacactcgagcaagaactcaacagcccatgtgcggtgcaagggtgatgagaccgctttctccgtcctggaaggcgttcacagttacactgtgtctctgagctttgaccacgcagtagtggatgagcagtgtcagctcaattgcgggggacatgaatcccaggtcacactgaaaggcaaccttattttcttggacgtgcccaagtttgttgacgggtcatatatgcaaacgtaccactctagcgtgcctaccggagccaatatccccagtccaactgattggctgaacgctctcttcggcaatggtctgtcccgttggattttaggggtcatcggagtgctgcttggcggcttggccctctttttcctgataatgagcctatttaaactggggacaaagcaggttttcagacctaggaccaaactcgcatga

SEQ ID NO: 11546 - RNA, 3222 nt, synthetic construct
  misc_feature 1..3222: note = derived and/or modified CDS sequence (opt3) from SFTSV(SPL071A)__AB985302.1__GP
  source 1..3222: mol_type = other RNA
atgatgaaggtgatctggttcagctccctgatttgcctcataatccagtgttctggcgacaccgggcccattatctgcgccggacctattcactcaaacaaaagtgctaatatcccacatcttctgggttacagcgagaagatatgtcaaatcgatagattgattcacgtctcctcttggttaaggaaccattcgcagtttcagggctatgttgggcagcggggaggccgctcacaagtgagctacttcccggcagaaaatagttattcccgatggtctggtctgctaagcccctgcgacgccgattggctcgggatgctggtagtgaaaaaggcgaaaggatccgacatgatcgtccctggcccatcatacaagggcaaggtgtttttcgagcgtcccacatttgatgggtatgttggatggggttgtggcagtgggaaaagcagaactgaatctggagagctttgctcctcagacagcggcacgagttctggtctgttgccttccgatagggtgctctggattggggacgtcgcttgtcagccaatgacccccatccctgaagagacattcctggagctgaagtcattttcgcagtctgagttcccagatatatgcaaaattgacggaatcgtgtttaaccagtgtgaatccgaatcactcccgcaacccttcgatgtagcctggatggacgttggccacagtcataagattatcatgcgggagcacaaaactaagtgggtgcaggagagctcctctaaggattttgtctgctacaaagaaggcaccgggccttgtagcgagtcagaagagaagacatgcaaaaccagtggatcctgccgcggtgacatgcagttctgtaaggtggcaggctgcgaacacggggaggagactagcgaagccaaatgtagatgctctttagtgcataagccaggagaggtcgttgtgtcatatggcggtatgagggtacggcccaaatgttacgggtttagtcgcatgatggctacactggaagtgaatcctccagagcagcgaatcggccaatgcaccggatgtcaccttgaatgcattaacggcggggtcagattgataacgctgactagcgagctaaagtccgcaaccgtgtgtgcctctcatttctgctcgagcgctacatccggaaagaaatcaactgagatccagttccacagtggttctctcgttggcaagaccgccattcacgtgaaaggggcgctggtcgacggaacagaatttaccttcgagggcagctgtatgtttcccgatggttgcgacgcagtggattgcacgttctgtagggaatttcttaagaatccgcagtgctaccctgccaaaaagtggctgttcatcataattgtaatcttgctcgggtatgctggcctgatgttactgactaacgttctcaaggccatcggagtgtggggctcctgggtcattgcacccgtgaaacttatgtttgctatcattaagaaactgatgcggtcagtcagctgtttgatggggaagctaatggaccgtggacgccaagtgatacatgaggaaatcggtgagaatagagagggcaaccaggatgacgttaggattgaaatggcccggccacgacgcgtgagacactggatgtactctcctgtaatcctggcgatcctcgccattgggctggcagagggatgcgatgaaatggtccatgctgactccaaacttgtgagttgtaagcagggcagcggtaatatgaaggagtgcgttacaaccgggagggccctgttgcccgctgtgaacccaggccaggaggcctgtctccacttcactgcacccggatctcctgattccaaatgcctgaagataaaagtcaagcggatcaatttaaaatgtaagaagtcaagtagctattttgtgccagacgcccgctcgagatgcacatccgtaaggcgttgtcggtgggctggcgattgccaatctgggtgcccgagccatttcacctcaaacagtttttccgacgactgggcgggaaaaatggatcgagcaggcctgggtttctctgggtgtagcgacggatgcggcggtgccgcttgtggctgctttaatgccgcaccctcctgtattttctggagaaagtgggtggaaaaccctcacgggatcatttggaaagtttcaccatgcgccgcttgggtccccagcgccgtgatcgagctaacgatgcctagtggagaagtgaggaccttccacccaatgtctggcatacccacacaggtctttaagggggtttccgtgacttacctcggaagcgatatggaggtgtcgggcctgaccgacctttgtgaaatcgaggagttgaaatcaaagaaactggcactcgcgccgtgcaaccaggctggtatgggggtagtcggaaaggtgggcgaaattcagtgttctagtgaggaatccgcccgcacaatcaagaaagatggttgcatttggaatgcagacctggttggcatcgagcttcgggtggatgacgccgtctgttatagcaagataacttctgtggaagctgttgccaactacagcgcaattcctaccacaatcgggggactgagattcgagaggtcccatgattcacaaggcaaaattagtgggagcccattggacatcaccgctatacgcggatctttttccgtgaattatcgaggcctccggctgtcattaagtgagatcactgccacgtgcacaggtgaagtaaccaacgtcagcgggtgctactcctgtatgactggagcgaaggtgtctattaaactgcactcgagcaagaatagcaccgcccatgtgcgttgcaagggcgatgagacagctttctccgtcctagaaggtgttcacagttacaccgtgtctctcagctttgaccacgcagtagtggatgagcagtgtcagctgaactgcggcgggcatgaatcccaggtcactcttaaaggaaatttgatcttcctggacgtgcccaagtttgttgacggctcatatatgcaaacataccactctagcgtgcctacgggggccaacattcccagtccaaccgattggctcaatgctctgttcggaaacggcttatccagatggatcctgggtgtcataggggtgcttttgggaggcctcgccctgtttttcctaattatgagcctgtttaaactcggcactaagcaggttttcaggtctcgcacaaaactggcatga

SEQ ID NO: 11547 - RNA, 3222 nt, synthetic construct
  misc_feature 1..3222: note = derived and/or modified CDS sequence (opt3) from SFTSV(SPL077A)__AB985304.1__GP
  source 1..3222: mol_type = other RNA
atgatgaaggtgatctggttcagctccctgatttgcctcgtcacccagtgttctggcgacacagggcccataatctgcgccggacctattcactcaaacaaaagtgctaatatcccacatcttctgggttacagcgagaagatttgtcaaatcgatagattgatacacgtttcctcttggttaaggaaccattcgcagtttcagggctatgtggggcagcggggaggccgctcacaagtaagctacttcccggcagaaaatagttattcccgatggtctggtctgctaagcccctgcgacgccgattggctcgggatgctggtggtcaaaaaggcgaaaggatccgacatgatcgtgcctggcccatcatacaagggcaaggttttcttcgagcgtcccacttttgatgggtatgtgggatggggttgtggcagtgggaaaagcagaacggaatctggagagctttgctcctcagacagcggcaccagttctggtctgttgccttccgatagggtcctctggattggggacgtggcttgtcagccaatgacacccatccctgaagagactttcctggagctcaagagcttttcgcagtctgaatttccagatatttgcaaaatcgacggaatagtatttaaccagtgtgagtccgaatcactgccgcaacccttcgatgttgcctggatggacgtgggccacagtcataagattatcatgcgggagcacaaaaccaagtgggtccaggagagctcctctaaggattttgtgtgctacaaagaaggcacagggccttgtagcgagtcagaagagaagacctgcaaaacttccggatcctgccgcggtgacatgcagttctgtaaggtggcaggctgcgaacacggggaggaggccagcgaagctaaatgtagatgctctttagtccataagccaggagaggttgtggtatcatatggcggtatgagggtgcggcccaaatgttacgggtttagtcgcatgatggcaacactggaagtcaatcctccagagcagcgaattggccaatgcaccggatgtcaccttgaatgcatcaacggcggggtgagattgatcacgctgactagcgagctaaagtccgccaccgtttgtgcttctcatttctgctcgagcgccacatccggaaagaaatcaactgagattcagttccacagtggttctctcgtgggcaagaccgcgatacacgtcaaaggggcactggtggacggaacagaatttaccttcgagggcagctgtatgtttcccgatggttgcgacgccgtagattgcacgttctgtagggaatttcttaagaatccgcagtgctaccctgctaaaaagtggctgttcatcattatcgttatattgctcgggtatgccggcctgatgttactgactaacgtgctcaaggcaattggagtctggggctcctgggtgatcgctcccgtcaaacttatgtttgccatcctgaagaaattgatgcggtcagtgagctgtctaatggggaagctgatggaccgtggacgccaagttattcatgaggaaatcggtgagaatagagagggcaaccaggatgacgtgaggattgaaatggcgcggccacgacgcgtaagacactggatgtactctcctgtcatactcacaatcctggccattgggcttgcagagggatgcgatgaaatggtgcatgctgactccaaactggttagttgtaagcagggcagcggtaatatgaaggagtgcgtgaccactgggagggccttgctccccgctgtcaacccaggccaggaggcctgtctgcacttcacagcacccggatctcctgattccaaatgcttaaagatcaaagtgaagcggatcaatctgaaatgtaagaagtcaagtagctattttgtaccagacgcccgctcgagatgcacctccgtgaggcgttgtcggtgggctggcgattgccaatctgggtgcccgagccatttcacgtcaaacagtttttccgacgactgggcgggaaaaatggatcgagcaggcctaggtttctctgggtgtagcgacggatgcggcggtgccgcttgtggctgctttaatgccgcaccctcctgtattttctggagaaagtgggttgaaaaccctcacgggataatctggaaagtctcaccatgcgccgcttgggtgcccagcgccgtgattgagctcaccatgcctagtggagaagtcaggacattccacccaatgtcttccatccccactcaggtttttaagggcgtgagcgtgacctacctggggtcggatatggaggtatcaggacttacagacttgtgtgaaattgaggagctgaaatctaagaaactcgcactggcgccgtgcaaccaggctggcatgggtgtcgtggggaaggttggagaaatccagtgtagttccgaggaaagcgcccgcactataaagaaagatggctgcatctggaatgcagaccttgtgggtattgagctgcgggtcgatgacgccgtgtgttattctaagatcaccagcgttgaagctgtggccaactactccgcaattcctacaaccatcggcgggttgagattcgagaggtcacatgatagtcaaggaaaaataagcggctctccactcgacattactgctatccgcgggtccttttcagtaaattatcgaggactgcggttaagtctgagcgagattacggccacatgcaccggcgaagtcactaacgtgtccggttgctactcttgtatgaccggggcgaaggtgtcgatcaaactacacagctcaaagaatagtacagcccatgtccgttgcaagggagatgagaccgctttcagtgttctcgaaggcgtgcactcttacactgtaagcctgtcctttgaccacgcagtggtcgatgagcagtgtcagcttaactgcggtggccatgaatcacaggtgacattgaaagggaatctgatattcctcgacgttcccaagtttgtggacggatcttatatgcaaacgtaccacagcagtgtccctaccggcgccaacatcccctccccaactgattggctgaatgctttattcgggaacggactgagcagatggattcttggcgtgatcggtgttttgctcgggggactggccctatttttcctgattatgtctctctttaaacagggcacaaaacaggtgttcaggtcacgcaccaagctggcatga

SEQ ID NO: 11548 - RNA, 3222 nt, synthetic construct
  misc_feature 1..3222: note = derived and/or modified CDS sequence (opt3) from SFTSV(SPL084A)__AB985307.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctacttcccggcagaaaatagttattcccgatggtctggtctgctaagcccctgcgacgccgattggctcgggatgctggtggtcaaaaaggcgaaaggatccgacatgattgtgcctggcccatcatacaagggcaaggttttcttcgagcgtcccacatttgatgggtatgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacattcctggagctgaagtcattttcgcagtctgaatttccagatatctgcaaaatagacggaattgtatttaaccagtgtgagtccgaatcactcccgcaacccttcgatgttgcctggatggacgtgggccacagtcataagatcattatgcgggagcacaaaactaagtgggtccaggagagctcctctaaggattttgtgtgctacaaagaaggcaccgggccttgtagcgagtcagaagagaagacatgcaaaaccagtggatcctgccgcggtgacatgcagttctgtaaggtggcaggctgcgaacacggggaggaggccagcgaagctaaatgtagatgctctttagtccataagccaggagaggttgtggtatcatatggcggtatgagggtgcggcccaaatgttacgggtttagtcgcatgatggcaactctggaagtcaatcctccagagcagcgaatcggccaatgcacaggatgtcaccttgaatgcatcaacggcggggtgagattgattaccctgacgagcgagctaaagtccgccactgtttgtgcttctcatttctgctcgagcgccacctccggaaagaaatcaacagagatacagttccacagtggttctctcgtgggcaagactgcgatccacgtcaaaggggcactggtggacggaaccgaatttacattcgagggcagctgtatgtttcccgatggttgcgacgccgtagattgcaccttctgtagggaatttcttaagaatccgcagtgctaccctgctaaaaagtggctgttcattatcatagttattttgctcgggtatacgggcctgatgttactgactaacgtgctcaaggccatcggagtctggggctcctgggtgatcgcacccgtcaaacttatgtttgctattctgaagaaattgatgcggtcagtgagctgtctaatggggaagctgatggaccgtggacgccaagttatccatgaggaaattggtgagaatagagagggcaaccaggatgacgtgaggatagaaatggcccggccacgacgcgtaagacactggatgtactctcctgtcatcctcacaattctggcgatcgggcttgccgagggatgcgatgaaatggtgcatgcagactccaaactggttagttgtaagcagggcagcggtaatatgaaggagtgcgtgaccactgggagggctttgctccccgccgtcaacccaggccaggaggcttgtctgcacttcacagcccccggatctcctgattccaaatgcttaaagatcaaagtgaagcggattaatctgaaatgtaagaagtcaagtagctattttgtaccagacgcacgctcgagatgcacctccgtgaggcgttgtcggtgggccggcgattgccaatctgggtgcccgagccatttcacgtcaaacagtttttccgacgactgggctggaaaaatggatcgagcgggcctaggtttctctgggtgtagcgacggatgcggcggtgcagcctgtggctgctttaatgctgccccctcctgtatattctggagaaagtgggttgaaaaccctcacgggatcatttggaaagtctcaccatgcgcagcctgggtgcccagcgctgtgatcgagctcaccatgcctagtggagaagtcaggacattccacccaatgtctggcattcccactcaggtttttaagggggtgtccgtgacctacctgggaagcgatatggaggtatcgggccttacagacttgtgtgaaatcgaggagctgaaatcaaagaaactcgccctggcaccgtgcaaccaggcgggtatgggggtcgtgggaaaggttggcgaaatacagtgttctagtgaggaatccgctcgcactatcaagaaagatggttgcatttggaatgccgaccttgtgggcatcgagctgcgggtcgatgacgcagtgtgttatagcaagattacctctgttgaagccgtggctaactacagcgccatccctacaaccatagggggattgagattcgagaggtcccatgattcacaaggcaaaattagtgggagcccactcgacatcactgcaattcgcggatctttttccgtaaattatcgaggcctgcggttatcactgagtgagatcacggctacatgcaccggtgaagtcactaacgtgagcgggtgctactcctgtatgaccggagccaaggtgtctataaaactacactcgagcaagaatagcacagcgcatgtccgttgcaagggcgatgagaccgccttctccgttcaggaaggtgtgcacagttacactgtatctctcagctttgaccacgctgtggtcgatgagcagtgtcagctgaactgcggcgggcatgaatcccaagtgacacttaaaggaaatttgatcttcctggacgttcccaagtttgtggacggctcatatatgcagacgtaccactctagcgtccctaccggggcaaacattcccagtccaactgattggctcaatgccctgttcggaaacggcttatccagatggatcctgggtgtgattggggttcttttgggaggcctcgctctgtttttcctaatcatgagcctgtttaaactcggcacaaaacaggtgttcaggtctcgcaccaagctggcctga

SEQ ID NO: 11549 - RNA, 3222 nt, synthetic construct
  misc_feature 1..3222: note = derived and/or modified CDS sequence (opt3) from SFTSV(SPL086A)__AB985308.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctacttcccggcagaaaatagttattcccgatggtctggtctgctaagcccctgcgacgccgattggctcgggatgctggtggtcaaaaaggcgaaaggatccgacatgattgtgcctggcccatcatacaagggcaaggttttcttcgagcgtcccacatttgatgggtatgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacattcctggagctcaagagcttttcgcagtctgaatttccagatatctgcaaaatagacggaattgtatttaaccagtgtgagtccgaatcactgccgcaacccttcgatgttgcctggatggacgtgggccacagtcataagatcattatgcgggagcacaaaactaagtgggtccaggagagctcctctaaggattttgtgtgctacaaagaaggcaccgggccttgtagcgagtcagaagagaagacatgcaaaaccagtggatcctgccgcggtgacatgcagttctgtaaggtggcaggctgcgaacacggggaggaggccagcgaagctaaatgtagatgctctttagtccataagccaggagaggttgtggtatcatatggcggtatgagggtgcggcccaaatgttacgggtttagtcgcatgatggcaactctggaagtcaatcctccagagcagcgaatcggccaatgcacaggatgtcaccttgaatgcatcaacggcggggtgagattgattaccctgacgagcgagctaaagtccgccactgtttgtgcttctcatttctgctcgagcgccacctccggaaagaaatcaacagagatacagttccacagtggttctctcgtgggcaagactgcgatccacgtcaaaggggcactggtggacggaaccgaatttacattcgagggcagctgtatgtttcccgatggttgcgacgccgtagattgcaccttctgtagggaatttcttaagaatccgcagtgctaccctgctaaaaagtggctgttcattatcatagttattttgctcgggtatgccggcctgatgttactgacgaacgtgctcaaggcaatcggagtctggggctcctgggtgatcgctcccgtcaaacttatgtttgccattatcaagaaactgatgcggtcagtgagctgtttgatggggaagctaatggaccgtggacgccaagttattcatgaggaaataggtgagaatagagagggcaaccaggatgacgtgaggatcgaaatggcgcggccacgacgcgtaagacactggatgtactctcctgtcattctgactatcctcgccatcgggctggcagagggatgcgatgaaatggtgcatgctgactccaaacttgttagttgtaagcagggcagcggtaatatgaaggagtgcgtgacaaccgggagggccctgttgcccgctgtcaacccaggccaggaggcctgtctccacttcactgcacccggatctcctgattccaaatgcctgaagattaaagtgaagcggataaatttaaaatgtaagaagtcaagtagctattttgtaccagacgcccgctcgagatgcacatccgtgaggcgttgtcggtgggctggcgattgccaatctgggtgcccgagccatttcacctcaaacagtttttccgacgactgggcgggaaaaatggatcgagcaggcctgggtttctctgggtgtagcgacggatgcggcggtgccgcttgtggctgctttaatgccgcaccctcctgtatcttctggagaaagtgggttgaaaaccctcacgggattatctggaaagtctcaccatgcgccgcttgggtgcccagcgccgtgattgagctaacgatgcctagtggagaagtcaggaccttccacccaatgtctggcatccccacacaggtttttaagggggtgtccgtgacttacctcggaagcgatatggaggtatcgggcctgaccgacctttgtgaaatagaggagttgaaatcaaagaaactggcactcgcgccgtgcaaccaggctggtatgggggtcgtgggaaaggttggcgaaatccagtgttctagtgaggaatccgcccgcacaattaagaaagatggttgcatctggaatgcagacctggtgggcattgagcttcgggtcgatgacgccgtgtgttatagcaagatcacttctgttgaagctgtggccaactacagcgcaatacctaccacaattgggggactgagattcgagaggtcccatgattcacaaggcaaaatcagtgggagcccattggacattaccgctatccgcggatctttttccgtaaattatcgaggcctccggctgtcattaagtgagataactgccacgtgcacaggtgaagtcaccaacgtgagcgggtgctactcctgtatgactggagcgcgtgtgtctatcaagctgcactcgagcaaaaattcaaccgcccatgtcagatgcaagggcgatgagacagctttctccgttctagaaggtgtgcacagttacaccgtatctctcagctttgaccacgcagtggtcgatgagcagtgtcagctgaactgcggcgggcatgaatcccaggtgactcttaagggaaatttgattttcctggacgttcccaaatttgtggacggctcatatatgcaaacataccactctagcgtccctacgggggccaacatccccagtccaaccgattggctcaatgctctgttcggaaacggcttatccaggtggattctgggtgtgatcggggttcttttgggaggcctcgccctgtttttcctaataatgagcctgtttaagctcggcactaaacaggtgttccgctctcggacaaagctggcatga

SEQ ID NO: 11550 - RNA, 3222 nt, synthetic construct
  misc_feature 1..3222: note = derived and/or modified CDS sequence (opt3) from SFTSV(SPL087A)__AB985309.1__GP
  source 1..3222: mol_type = other RNA
atgatgaaggtgatctggttcagctccctgatttgcctcgtcatacagtgttctggcgactcagggcccatcatttgcgccggacctatccacagtaacaaaagcgctgatattccacatcttctgggttactccgagaagatctgtcaaatagacagattgatccacgtttcttcgtggttaaggaatcattcacagtttcagggctatgtggggcagcggggaggccgcagccaagtaagttactatccggcagaaaactcctactctcgatggagcggtctgctatccccctgcgatgccgactggctcgggatgctggtggtcaaaaaggcgaaaggatcagatatgattgtgcctggcccaagttataagggcaaggttttctttgagcgtcccaccttcgacgggtacgtgggatggggttgtggcagcgggaaatctagatccgaatcaggagagctttgcagcagtgattctggcacatccagcggtctgttgccttcggacagggtcctctggatcggggatgtggcttgtcagccaatgactcccattcctgaagagacgtttctggagctgaagtctttctcccagtcagaatttccagacatctgcaaaatagatggaattgtattcaatcagtgtgagggcgaaagtctcccgcaaccctttgacgttgcctggatggatgtgggccacagccataagatcattatgcgggagcacaaaaccaagtgggtccaggagtcctctagcaaggacttcgtgtgctataaagaagggacaggaccttgttcagagagtgaagagaagacttgcaaaacctccggtagctgccgcggcgacacacagttttgtaaggtggcagggtgcgaacacggagaggaggcctctgaagctaaatgtagatgctcattagtccataagccaggcgaggttgtggtaagttacggtgggatgagggtgcggcccaaatgttacggcttcagccgcatgatggcaaccctggaagtctcccctccagagcagcgaatcggacaatgcactggctgtcaccttgaatgcatcaacgggggagtgagattgattacactgacctctgagctaaagtcggccacggtttgtgctagccatttttgctcctcagccacttcaggtaagaaatctaccgagatacagttccacagcggctccctcgtggggaagacagcgatccacgtcaaaggagcactggtggatggcactgaatttacctttgagggttcatgtatgttccccgacgggtgcgatgccgtagactgcacattttgtagggagttccttaagaatccgcagtgctatcctgctaaaaagtggctgtttattatcatagttattttgctcggctacgccggactgatgttactgaccaacgtgctcaaggcaatcggcgtctgggggagctgggtgatcgctcccgtcaaacttatgttcgccattatcaagaaactgatgcggacggtgtcttgtttgatgggaaagctaatggatcgtggtcgccaagttattcatgaagaaataggcgagaatagagaggggaacagggacgatatccggattgaaatggcgcgaccacgcagagtgaggcactggatgtattcccctgtaatcctgactatcctcgccattggactggcagagggctgcgacgaaatggtccatgctgatagtaaacttgtgagctgtcggcagggttctgggaatatgaaggagtgcgttacaaccggccgcgccctgttgcccgctgtgaacccaggacaggaggcctgtctccactttactgcacccggctcccctgactcaaagtgcctgaaaataaaggtcaaaagaatcaatttaaagtgtaaaaagagtagctcgtacttcgtgccagatgccaggtcccgttgcacatctgtacggcgatgtagatgggctggggactgccagagcggatgcccgccccattttacctcaaacagtttctccgacgattgggcgggcaagatggacagggcaggtctggggttttctggatgtagcgatggctgcggtggcgccgcttgtgggtgcttcaatgccgcaccttcctgtattttctggcgcaaatgggtggaaaacccacacggaatcatttggaaggtttcaccctgcgccgcttgggtccctagcgccgtgatcgagctaacgatgccaagtggcgaagtgcggaccttccaccccatgtctgggataccgacacaagtcttcaaaggagtttccgtgacttatctcggcagcgacatggaggtgtcgggtctgaccgatctttgtgaaatcgaggagttgaagagtaaaaagctggcactcgcgccttgcaatcaggctgggatgggagtagtcggcaaagtgggtgaaattcagtgttctagtgaggaatccgccagaacaatcaagaaggacggctgcatttggaacgcagatctggttgggatcgagcttagggtggacgatgccgtctgttacagcaaaataacttctgtggaagctgttgccaactatagcgcaattccaaccacaatcggaggcctgcgctttgagcgatcccatgactcacaggggaagattagtggaagccccttggatatcaccgctatacggggctctttctccgtgaattaccgtggtctcagactgtcattaagtgagatcactgccacgtgcacaggggaagtaaccaacgtcagcggatgctactcctgtatgactggcgcgaaagtgtctattaagctgcactcgagcaaaaattcaaccgcccatgtgaggtgcaagggtgacgagacagctttttccgtcctagaaggcgttcacagttataccgtgtctctcagcttcgatcacgcagtagtggacgagcgctgtcaactgaactgcgggggacatgaatcccaggtcactcttaagggcaatttgatctttctggacgtgcctaaattcgttgatgggtcatacatgcagacatatcactctacggtgcccaccggagccaacattccaagccctactgactggctcaatgctctgtttggcaacggtttaagtcggtggatcctgggggtcataggagtgcttttgggcggcctcgccctgttctttctaattatgtccctgttcaagctcgggacaaaacaggtttttagaagcaggaccaagctggcatga

SEQ ID NO: 11551 - RNA, 3222 nt, synthetic construct
  misc_feature 1..3222: note = derived and/or modified CDS sequence (opt3) from SFTSV(SPL090A)__AB985311.1__GP
  source 1..3222: mol_type = other RNA
atgatgaaggtgatctggttccccagcctgatttgcctcgtcataagatgttccggcgggaccggacctatcatttgcgccggtccaatccactctaacaaatcagctaatattccgcatcttctgggctacagtgagaagatctgtcagatagacaggttgatccacgttagctcctggttacggaaccattctcaatttcaggggtatgtgggacagcgcggcggtcgatcgcaggtatcatacttccccgcagaaaatagctatagtcgttggtccgggctgctatctccttgcgatgccgactggctcggaatgctggtggtcaaaaaggcgagaggcagcgatatgattgtgccaggcccctcctacaaagggaaggttttcttcgagaggcctacatttgacggatatgtgggttggggctgtgggtcaggaaagagtcggactgaaagcggcgagctttgttcttccgattcaggtacgagcagtgggctgttgccatctgaccgcgtcctctggatcggagatgtggcttgccaacccatgacccctattccagaagagacattcctggagctgaaatcctttagccagtcggaatttccggacatctgcaagatagatggcattgtatttaaccagtgtgagtctgaatccctcccccagcctttcgacgttgcctggatggatgtgggccactcacataaaatcattatgagagagcacaagactaaatgggtccaagagagtagctccaaggactttgtgtgctacaaggaagggaccggaccatgttctgagagcgaagagaaaacatgcaagacctcaggtagttgcaggggcgatatgcagttctgtaaagtggcagggtgcgaacacggagaggaggcctccgaagctaagtgtcggtgcagcttagtccataaacccggcgaggttgtggtatcttatggtgggatgcgcgtgcgacctaagtgttacggcttttcaagaatgatggcaactctggaagtcaatccacccgagcagaggatcggacagtgcacaggctgtcaccttgaatgcatcaacgggggagtgcggttgattaccctgacgagtgagctaaaaagcgccactgtttgtgcttcccatttctgttcttcggccaccagcggtaagaagtccacagagatacaattccactcaggcagtctcgtggggaaaactgcgatccacgtcaagggagcactggtggacggcaccgaatttacattcgagggttcttgcatgtttccggacgggtgcgatgccgtagactgcaccttctgtcgtgaatttcttaaaaatcctcagtgctaccccgctaagaaatggctgttcattatcatagccattttgctcggctatgcaggactgatgttactgacgaacgttctcaaggctatcggcgtgtgggggagctgggtcatcgccccagtgaaacttatgtttgcgattatcaagaagctgatgcgctccgtctcatgtttgatgggaaaactaatggatagaggtaggcaagtgattcatgaggaaataggcgagaatcgggaggggaaccaggacgatgttcgaatcgaaatggcccgccctagaagggtgcggcactggatgtacagccccgtaattctgactatcctcgcaatcggactggctgagggctgcgacgaaatggtccatgccgattctaaacttgtgtcctgtaagcagggtagtgggaatatgaaggagtgcgttacaaccggccgcgctctgttgccagccgtgaaccccggacaggaggcatgtctccacttcactgcccctggcagcccagactctaagtgcctgaaaattaaggtcaaaagaataaatttaaagtgtaaaaagtcctcaagttattttgtgccggatgctaggagccgttgcacatcggtacggcgatgtagatgggcgggggactgccagtccggatgcccctctcatttcaccagcaactcatttagtgatgactgggcaggcaagatggacagggccggtctggggttctccggatgttctgatggctgcggtggcgctgcctgtgggtgctttaatgcagcccctagctgtatcttctggcgcaaatgggtggaaaacccacacggaattatctggaaggtttccccctgcgctgcctgggtcccttcagcagtgattgagctaacgatgccaagcggcgaagtgcggaccttccaccccatgagtgggatcccgacacaagtctttaaaggagtttctgtgacttacctcggctccgacatggaggtgagcggtctgaccgatctttgtgaaatagaggagttgaagtcgaaaaagctggcgctcgctccttgcaaccaggccgggatgggagtagtcggcaaagtgggtgaaatccagtgttcatctgaggaaagtgcaagaacaattaagaaggacggctgcatctggaatgccgatctggttgggattgagcttagggtggacgatgctgtctgttattccaaaatcactagcgtggaagccgttgcaaactactctgctataccaaccacaattggaggcctgcgcttcgagcgaagccatgactcccaggggaagatctcaggaagtcccttggatattaccgccatccggggcagcttttctgtgaattatcgtggtctcagactgtccttatcagagataactgcgacgtgcacaggggaagtaaccaacgtcagtggatgctacagctgtatgactggcgccaaagtgtccatcaagctgcactcttcgaaaaatagcaccgctcatgtgaggtgcaagggtgacgagacagcattctcagtcctagaaggcgttcactcctacaccgtgagtctctcttttgatcacgccgtagtggacgagcaatgtcagctgaactgcgggggacatgaaagccaggtcactcttaagggcaatttgattttcctggatgtgcctaaatttgttgacgggtcctatatgcagacataccactcatctgtgcccacgggagctaacatcccaagccctaccgactggctcaatgccctgttcggcaacggtttaagtcgctggattctgggggtcatcggagtgcttttgggcggcctcgcactgtttttcctaataatgtccctgtttaagctcgggactaaacaagttttccggagcagaacaaagctggcgtga

SEQ ID NO: 11552 - RNA, 3222 nt, synthetic construct
  misc_feature 1..3222: note = derived and/or modified CDS sequence (opt3) from SFTSV(SPL097A)__AB985312.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctgatattccacatcttctgggttacagcgagaagatctgtcaaatagacagattgatccacgtttcctcttggttaaggaatcattcgcagtttcagggctatgtggggcagcggggaggccgctcacaagtaagctactatccggcagaaaacagttactcccgatggtctggtctgctaagcccctgcgatgccgactggctcgggatgctggtggtcaaaaaggcgaaaggatccgatatgattgtgcctggcccatcatataagggcaaggttttctttgagcgtcccacattcgacgggtacgtgggatggggttgtggcagtgggaaaagcagaactgaatctggagagctttgctcctcagatagcggcacgagttctggtctgttgccttccgacagggtcctctggatcggggatgtggcttgtcagccaatgacccccattcctgaagagacatttctggagctgaagtctttctcgcagtctgaatttccagacatctgcaaaatagatggaattgtattcaatcagtgtgagtccgaatcactcccgcaaccctttgacgttgcctggatggatgtgggccacagtcataagatcattatgcgggagcacaaaactaagtgggtccaggagagctcctctaaggacttcgtgtgctataaacagggcaccgggccttgtccagaaagcgaggaaaagacatgcaaaacctcaggaagttgccgcggtgacatgcagttttgtaaggtggcaggctgcgagcacggggaagaggcctccgaggctaaatgtagatgcagcttagtccataagcccggagaagttgtggtatcttacggcggtatgagggtgcggcctaaatgttacgggttctcacgcatgatggcaactctggaggtcaacccacccgaacaacgaatcggccagtgcacaggatgtcaccttgagtgcgtgaatggcggggttagattgatcaccctgacgagtgaactaaagagcgccactgtgtgtgcttcccatttttgcagctcggccaccagcggaaagaaaaacacagagattcagttccactccggttcactcgtcggcaagactgcgatacacgtgaaaggggcactgcttgatggaaccgagttcacatttgaaggcagttgtatgttcccggacggttgcgatgccgtagactgcaccttttgtagggagttcctgaagaatcctcaatgctatcccgctaaaaagtggttgtttatcattatcgttatactcctggggtacgccggcttaatgctgctcacgaacgtgcttaaggcaattggagtctggggctcttgggtgatcgctccagtcaaactgatgttcgccatcattaagaaattgatgcggagcgtgtcctgtctaatggggaagctgatggatcgtggacgccaggttatccatgaagagattggtgaaaatagagagggcaaccaggacgatgtgaggatagagatggcgcggcctcgacgcgtaagacactggatgtattcacccgtcatcctcactattctggccgtggggcttgcagaaggatgcgacgagatggttcatgctgatagcaaactggtgtcttgtaagcagggctccggtaatatgaaggaatgcgtcacaaccgggagggccttgctcccagctgtgaaccccggccaagaggcctgtctgcactttactgcacctggaagtccagacagcaaatgcttaaagatcaaagtaaagaaaatcaatctgaagtgtaagaaatcttcctcatacttcgtgccggatgcccggagtcgctgcacaagcgttagaaggtgtcgttgggctggcgactgccagtcggggtgcccctcccattttacctctaacagcttctcagacgattgggcgggaaagatggaccgggcaggcctaggttttagtgggtgttccgatggatgcggcggtgccgcttgtggctgcttcaatgccgcaccttcttgtatattttggcgaaaatgggtcgagaacccacacgggataatctggaaggtgagcccctgcgccgcttgggtgccttccgccgtcattgaactcacgatgccatcaggagaggttagaaccttccaccccatgagcggcatcccgacacaggtgttcaaaggggtgagtgtaacttatctgggatctgacatggaagtctccggccttaccgatttgtgtgagattgaggaacttaagagcaaaaagctcgcactggcgccttgcaaccaggctggtatgggggtggttggaaaggtgggcgagatccaatgttcgtcagaagagtctgccaggacaattaaaaaggacggttgcatctggaatgcagatcttgtcggcattgaactgcgcgtggacgatgccgtttgttacagtaaaatcacttccgtggaggctgtagccaactatagcgcaattccaaccacaatcgggggattgcggtttgaaagatctcatgacagccagggcaagatatccgggtcacccctcgatattaccgctatcaggggaagtttcagcgtcaattaccgcggcctgcgattatctctgtccgagattactgccacgtgcacaggtgaggtgaccaacgtgtcagggtgctacagttgtatgactggagcgaaagtcagcatcaagctacactccaataagaactctaccgcccatgttcggtgcaaaggcgacgaaacagctttttcggtgctcgagggtgtacacagctataccgtgtcactgtccttcgatcacgcagtcgtggacgaacagtgtcagcttaattgcggcgggcatgagagtcaagttactttgaagggaaacctgatatttctcgacgtgcctaaattcgtcgatggctcttacatgcagacatatcacagctccgtgcccacgggggccaatatcccatcacctaccgactggctgaacgctttatttggaaatggcctgtctcgttggattcttggtgttatcggggtgttgctcggaggcctggccctattctttctgattatgagcctcttcaagctgggcactaaacaggtctttagaagtaggacaaagctggcatga

SEQ ID NO: 11553 - RNA, 3222 nt, synthetic construct
  misc_feature 1..3222: note = derived and/or modified CDS sequence (opt3) from SFTSV(SPL100A)__AB985313.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctgatattccacatcttctgggttacagcgagaagatctgtcaaatagacagattgatccacgtttcctcttggttaaggaatcattcgcagtttcagggctatgtggggcagcggggaggccgctcacaagtaagctactatccggcagaaaacagttactcccgatggtctggtctgctaagcccctgcgatgccgactggctcgggatgctggtggtcaaaaaggcgaaaggatccgatatgattgtgcctggcccatcatataagggcaaggttttctttgagcgtcccacattcgacgggtacgtgggatggggttgtggcagtgggaaaagcagaactgaatctggagagctttgctcctcagatagcggcacgagttctggtctgttgccttccgacagggtcctctggatcggggatgtggcttgtcagccaatgacccccattcctgaagagacatttctggagctcaagagcttctcgcagtctgaatttccagacatctgcaaaatagatggaattgtattcaatcagtgtgagtccgaatcactgccgcaaccctttgacgttgcctggatggatgtgggccacagtcataagatcattatgcgggagcacaaaactaagtgggtccaggagagctcctctaaggacttcgtgtgctataaacagggcaccgggccttgtagcgaatcagaggaaaagacatgcaaaaccagtggatcctgccgcggtgacatgcagttttgtaaggtggcaggctgcgagcacggggaagaggccagcgaggctaaatgtagatgctctttagtccataagccaggagaagttgtggtatcatacggcggtatgagggtgcggcccaaatgttacgggttcagtcgcatgatggcaactctggaggtcaaccctccagaacaacgaatcggccagtgcacaggatgtcaccttgagtgcgtgaatggcggggttagattgatcaccctgacgagcgaactaaagtccgccactgtgtgtgcttctcatttttgctcgagcgccacctccggaaagaaatcaacagagattcagttccacagtggttctctcgtcggcaagactgcgatacacgtgaaaggggcactgcttgatggaaccgagttcacatttgaaggcagctgtatgttccccgacggttgcgatgccgtagactgcaccttttgtagggagttcctgaagaacccgcaatgctatcctgctaaaaagtggttgtttatcattatcgttatactcctggggtacgccggcttaatgctgctcacgaatgtgcttaaggcaattgctgtctggggatcctgggtgatcgcccccgtcaaactgatgttcgcgatcattaagaaattgatgcggtcagtgagctgtctaatgggcaagctgatggatcgtgggcgccaggttatccatgaagagattggagaaaacagagagggtaatcaggacgatgtgaggatagagatggcccggccacgacgcgtaagacactggatgtattctcctgtcatcctcactgtgctggcagttggccttgctgaagggtgcgacgagatggtgcatgccgattccaaactggtcagttgtaagcagggaagcggcaacatgaaggaatgcgtgacaaccggtagggctttgctccccgccgtaaatccagggcaagaggcatgtctgcactttactgcccccggctctcctgactccaaatgcttaaagattaaagtgaagaaaatcaacctgaagtgtaagaaatcaagtagctacttcgttccagatgctcggtcgcgctgcacatccgtcagaaggtgtcgttgggcgggagactgccagtctggctgcccgagccattttacctcaaatagtttctccgacgattgggcagggaagatggaccgggccggactaggcttttctggttgtagcgatgggtgcggaggcgctgcctgtggttgcttcaacgcagccccctcctgtatcttttggcgaaaatgggtggagaatcctcacggcattatatggaaggtgtcaccatgcgctgcctgggtccccagcgcagttatcgaactcacgatgcctagtggggaggtgagaaccttccacccaatgtctggcattcccacacaggtgttcaaaggagtatccgtcacttatctggggagcgacatggaagtgtcgggacttaccgatttgtgtgagatcgaggaactgaagtcaaagaagctcgcgctggctccgtgcaaccaggccggcatgggtgttgtggggaaggtcggagagattcaatgttctagtgaagagtccgcaaggacaatcaaaaaggacggctgcatatggaacgccgatcttgtgggtatcgaactgcgcgttgacgatgctgtgtgttacagcaaaattacttctgtagaggccgtcgcaaattatagcgctatccctaccacaattggcgggttgcggtttgaaagatcccatgactcacagggaaagatcagtggcagcccactcgatataaccgccattagggggtctttctccgtgaactaccgcggactgcgattatcactgagtgagatcactgcgacgtgcacaggcgaggtgaccaatgtcagcggttgctactcctgtatgactggggccaaagtttctattaagctacactcgaacaagaatagcaccgctcatgtgcggtgcaaaggagacgaaacagcattttcagtactcgagggcgtgcactcctataccgtcagtctgtctttcgatcacgccgtggttgacgaacagtgtcagcttaactgcggtggccatgagagccaagtgactttgaaggggaatctgatctttctcgacgtccccaaattcgtggatggatcctacatgcagacatatcactcatctgttcctacgggcgctaacatacccagcccaaccgactggctgaatgccttatttgggaacggactgagtcgttggatccttggcgtgattggtgtcttgctcgggggactggcactattctttctgatcatgtccctcttcaagctgggcactaaacaggtatttagaagcaggacaaaacttgcgtga

SEQ ID NO: 11554 - RNA, 3222 nt, synthetic construct
  misc_feature 1..3222: note = derived and/or modified CDS sequence (opt3) from SFTSV(SPL106A)__AB985316.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctacttcccggcagaaaatagttattcccgatggtctggtctgctaagcccctgcgacgccgattggctcgggatgctggtggtcaaaaaggcgaaaggatccgacatgattgtgcctggcccatcatacaagggcaaggttttcttcgagcgtcccacatttgatgggtatgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacattcctggagctgaagtcattttcgcagtctgaatttccagatatctgcaaaatagacggaattgtatttaaccagtgtgagtccgaatcactcccgcaacccttcgatgttgcctggatggacgtgggccacagtcataagatcattatgcgggagcacaaaactaagtgggtccaggagagctcctctaaggattttgtgtgctacaaagaaggcaccgggccttgtagcgagtcagaagagaagacatgcaaaaccagtggatcctgccgcggtgacatgcagttctgtaaggtggcaggctgcgaacacggggaggaggccagcgaagctaaatgtagatgctctttagtccataagccaggagaggttgtggtatcatatggcggtatgagggtgcggcccaaatgttacgggtttagtcgcatgatggcaactctggaagtcaatcctccagagcagcgaatcggccaatgcacaggatgtcaccttgaatgcatcaacggcggggtgagattgattaccctgacgagcgagctaaagtccgccactgtttgtgcttctcatttctgctcgagcgccacctccggaaagaaatcaacagagatacagttccacagtggttctctcgtgggcaagactgcgatccacgtcaaaggggcactggtggacggaaccgaatttacattcgagggcagctgtatgtttcccgatggttgcgacgccgtagattgcaccttctgtagggaatttcttaagaatccgcagtgctaccctgctaaaaagtggctgttcattatcatagttattttgctcgggtatgccggcctgatgttactgacgaacgtgctcaaggcaatcggagtctggggctcctgggtgatcgctcccgtcaaacttatgtttgccattctgaagaaattgatgcggtcagtgagctgtctaatggggaagctgatggaccgtggacgccaagttatccatgaggaaattggtgagaatagagagggcaaccaggatgacgtgaggatagaaatggcgcggccacgacgcgtaagacactggatgtactctcctgtcatcctcactattctggccatcgggcttgcagagggatgcgatgaagtggttcatgctgactccaaactggtgagttgtaagcagggcagcggtaatatgaaggagtgcgtcacaaccgggagggccttgctccccgctgtgaacccaggccaggaggcctgtctgcacttcactgcacccggatctcctgattccaaatgcttaaagatcaaagtaaagcggattaatctgaaatgtaagaagtcaagtagctattttgtgccagacgcccgctcgagatgcacatccgttaggcgttgtcggtgggctggcgattgccaatctgggtgcccgagccatttcacctcaaacagtttttccgacgactgggcgggaaaaatggatcgagcaggcctaggtttctctgggtgtagcgacggatgcggcggtgccgcttgtggctgctttaatgccgcaccctcctgtatattctggagaaagtgggtcgaaaaccctcacgggatcatttggaaagtgtcaccatgcgccgcttgggtgcccagcgccgtcatcgagctcacgatgcctagtggagaagttaggaccttccacccaatgtctggcattcccacacaggtgtttaagggggtgtccgtaacttacctgggaagcgatatggaggtctcgggccttaccgacttgtgtgaaatcgaggagctgaaatcaaagaaactcgcactggcgccgtgcaaccaggctggtatgggggtggttggaaaggtgggcgaaatacagtgttctagtgaggaatccgcccgcacaatcaagaaagatggttgcatttggaatgcagaccttgtcggcatcgagctgcgggtggatgacgccgtttgttatagcaagattacttctgtggaagctgtagccaactacagcgcaatccctaccacaatagggggattgagattcgagaggtcccatgattcacaaggcaaaattagtgggagcccactcgacatcaccgctattcgcggatctttttccgtcaattatcgaggcctgcggttatcactgagtgagatcactgccacgtgcacaggtgaagtgaccaacgtgagcgggtgctactcctgtatgataggagcgaaggtctctatcaaactacactcgagcaagaatagcactgcccatgttcgttgcaagggcgatgagaccgctttctccgtgctcgaaggtgtacacagttacacagtgtctctgagctttgaccacgcagtcgtggatgagcagtgtcagcttaactgcggcgggcatgaatcccaggttaccttgaaaggaaatctgattttcctcgacgtgcccaagtttgtcgacggctcatatatgcaaacttaccactctagcgtgcctacaggggccaacatccccagtccaacggattggctgaatgctttattcggaaacggcctgtccagatggattcttggtgttatcggggtgttgctcggaggcctggccctatttagcctgataatgtctctcttcaaactgggcaccaagcaggtccttaggtcacgcactaaattggcatga

SEQ ID NO: 11555 - RNA, 3222 nt, synthetic construct
  misc_feature 1..3222: note = derived and/or modified CDS sequence (opt3) from SFTSV(SPL117A)__AB985321.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctacttcccggcagaaaatagttattcccgatggtctggtctgctaagcccctgcgacgccgattggctcgggatgctggtggtcaaaaaggcgaaaggatccgacatgattgtgcctggcccatcataccgtggcaaggttttcttcgagagacccacatttgatgggtatgtgggatggggttgtggcagtggaaagagcaggactgaatctggggagctttgctcctcagacagcggcacgagttctggtctgttgccttccgatcgggtcctctggatcggggacgtggcttgtcagccaatgacccccattcctgaagagacattcctggagctgaaatcgtttagccagtctgaatttccagatatctgcaagatagacggaattgtatttaaccagtgtgagtccgaatcactcccgcaacccttcgatgttgcctggatggacgtgggccacagtcataaaatcattatgcgcgagcacaagactaaatgggtccaggagagctcctctaaggattttgtgtgctacaaggaaggcaccgggccttgtagcgagtcagaagagaaaacatgcaagaccagtggatcctgcagaggtgacatgcagttctgtaaagtggcaggctgcgaacacggggaggaggccagcgaagctaagtgtaggtgctctttagtccataaaccaggagaggttgtggtatcatatggcggtatgcgggtgcgccccaagtgttacgggtttagtcgaatgatggcaactctggaagtcaatcctccagagcagagaatcggccaatgcacaggatgtcaccttgaatgcatcaacggcggggtgaggttgattaccctgacgagcgagctaaaatccgccactgtttgtgcttctcatttctgctcgagcgccacctccggaaagaagtcaacagagatacagttccacagtggttctctcgtgggcaaaactgcgatccacgtcaagggggcactggtggacggaaccgaatttacattcgagggcagctgtatgtttcccgatggttgcgacgccgtagattgcaccttctgtcgggaatttcttaaaaatccgcagtgctaccctgctaagaaatggctgttcattatcatagttattttgctcgggtatgccggcctgatgttactgacgaacgtgctcaaggcaatcggagtctggggctcctgggtgatcgctcccgtcaaacttatgtttgccattatcaaaaagctgatgcgttcagtgagctgtttgatggggaaactaatggaccgcggaagacaagttattcatgaggaaataggtgagaatagggagggcaaccaggatgacgtgcggatcgaaatggcgcgaccacgcagagtaaggcactggatgtactctcctgtcattctgactatcctcgccatcgggctggcagagggatgcgatgaaatggtgcatgctgactccaaacttgttagttgtaagcagggcagcggtaatatgaaggagtgcgtgacaaccgggcgggccctgttgcccgctgtcaacccaggccaggaggcctgtctccacttcactgcacccggatctcctgattccaagtgcctgaaaattaaggtgaaacgcataaatttaaagtgtaaaaagtcaagtagctattttgtaccagacgccagatcgaggtgcacatccgtgcgtcggtgtcgatgggctggcgattgccaatctgggtgcccgagccatttcacctcaaacagtttttccgacgactgggcgggaaagatggatagagcaggcctgggtttctctgggtgtagcgacggatgcggcggtgccgcttgtggctgctttaatgccgcaccctcctgtatcttctggaggaaatgggttgaaaaccctcacgggattatctggaaggtctcaccatgcgccgcttgggtgcccagcgccgtgattgagctaacgatgcctagtggagaagtccgcaccttccacccaatgtctggcatccccacacaggtttttaaaggggtgtccgtgacttacctcggaagcgatatggaggtatcgggcctgaccgacctttgtgaaatagaggagttgaagtcaaagaagctggcactcgcgccgtgcaaccaggctggtatgggggtcgtgggaaaagttggcgaaatccagtgttctagtgaggaatccgcccggacaattaagaaggatggttgcatctggaatgcagacctggtgggcattgagcttagagtcgatgacgccgtgtgttatagcaaaatcacttctgttgaagctgtggccaactacagcgcaatacctaccacaattgggggactgaggttcgagcgctcccatgattcacaaggcaagatcagtgggagcccattggacattaccgctatccgaggatctttttccgtaaattatcggggcctccgtctgtcattaagtgagataactgccacgtgcacaggtgaagtcaccaacgtgagcgggtgctactcctgtatgactggagcgaaagtgtctatcaagctgcactcgagcaaaaattcaaccgcccatgtcagatgcaagggcgatgagacagctttctccgttctagaaggtgtgcacagttacaccgtatctctcagctttgaccacgcagtggtcgatgagcagtgtcagctgaactgcggcgggcatgaatcccaggtgactcttaagggaaatttgattttcctggacgttcccaaatttgtggacggctcatatatgcaaacataccactctagcgtccctacgggggccaacatccccagtccaaccgattggctcaatgctctgttcggaaacggcttatccaggtggattctgggtgtgatcggggttcttttgggaggcctcgccctgtttttcctaataatgagcctgtttaagctcggcactaaacaggtgttccgctctcggacaaagctggcatga

SEQ ID NO: 11556 - RNA, 3222 nt, synthetic construct
  misc_feature 1..3222: note = derived and/or modified CDS sequence (opt3) from SFTSV(SPL120A)__AB985322.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctacttcccggcagaaaatagttattcccgatggtctggtctgctaagcccctgcgacgccgattggctcgggatgctggtggtcaaaaaggcgaaaggatccgacatgattgtgcctggcccatcatacaagggcaaggttttcttcgagcgtcccacatttgatgggtatgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacattcctggagctgaagtcattttcgcagtctgaatttccagatatctgcaaaatagacggaattgtatttaaccagtgtgagtccgaatcactcccgcaacccttcgatgttgcctggatggacgtgggccacagtcataagatcattatgcgggagcacaaaactaagtgggtccaggagagctcctctaaggattttgtgtgctacaaagaaggcaccgggccttgtagcgagtcagaagagaagacatgcaaaaccagtggatcctgccgcggtgacatgcagttctgtaaggtggcaggctgcgaacacggggaggaggccagcgaagctaaatgtagatgctctttagtccataagccaggagaggttgtggtatcatatggcggtatgagggtgcggcccaaatgttacgggtttagtcgcatgatggcaactctggaagtcaatcctccagagcagcgaatcggccaatgcacaggatgtcaccttgaatgcatcaacggcggggtgagattgattaccctgacgagcgagctaaagtccgccactgtttgtgcttctcatttctgctcgagcgccacctccggaaagaaatcaacagagatacagttccacagtggttctctcgtgggcaagactgcgatccacgtcaaaggggcactggtggacggaaccgaatttacattcgagggcagctgtatgtttcccgatggttgcgacgccgtagattgcaccttctgtagggaatttcttaagaatccgcagtgctaccctgctaaaaagtggctgttcattatcatagttattttgctcgggtatgccggcctgatgttactgacgaacgtgctcaaggcaatcggagtctggggctcctgggtgatcgctcccgtcaaacttatgtttgccattctgaagaaattgatgcggtcagtgagctgtctaatggggaagctgatggaccgtggacgccaagttatccatgaggaaattggtgagaatagagagggcaaccaggatgacgtgaggatagaaatggcgcggccacgacgcgtaagacactggatgtactctcctgtcatcctcactattctggccatcgggcttgcagagggatgcgatgaagtggttcatgctgactccaaactggtgagttgtaagcagggcagcggtaatatgaaggagtgcgtcacaaccgggagggccttgctccccgctgtgaacccaggccaggaggcctgtctgcacttcactgcacccggatctcctgattccaaatgcttaaagatcaaagtaaagcggattaatctgaaatgtaagaagtcaagtagctattttgtgccagacgcccgctcgagatgcacatccgttaggcgttgtcggtgggctggcgattgccaatctgggtgcccgagccatttcacctcaaacagtttttccgacgactgggcgggaaaaatggatcgagcaggcctaggtttctctgggtgtagcgacggatgcggcggtgccgcttgtggctgctttaatgccgcaccctcctgtatattctggagaaagtgggtcgaaaaccctcacgggatcatttggaaagtgtcaccatgcgccgcttgggtgcccagcgccgtcatcgagctcacgatgcctagtggagaagttaggaccttccacccaatgtctggcattcccacacaggtgtttaagggggtgtccgtaacttacctgggaagcgatatggaggtctcgggccttaccgacttgtgtgaaatcgaggagctgaaatcaaagaaactcgcactggcgccgtgcaaccaggctggtatgggggtggttggaaaggtgggcgaaatacagtgttctagtgaggaatccgcccgcacaatcaagaaagatggttgcatttggaatgcagaccttgtcggcatcgagctgcgggtggatgacgccgtttgttatagcaagattacttctgtggaagctgtagccaactacagcgcaatccctaccacaatagggggattgagattcgagaggtcccatgattcacaaggcaaaattagtgggagcccactcgacatcaccgctattcgcggatctttttccgtcaattatcgaggcctgcggttatcactgagtgagatcactgccacgtgcacaggtgaagtgaccaacgtgagcgggtgctactcctgtatgactggagcgaaggtctctataaaactacactcgagcaagaatagcaccgcccatgttcgttgcaagggcgatgagacagctttctccgtgctcgaaggtgtacacagttacaccgtgtctctgagctttgaccacgcagtcgtggatgagcagtgtcagcttaactgcggcgggcatgaatcccaggttactttgaaaggaaatctgatcttcctcgacgtgcccaagtttgtcgacggctcatatatgcaaacataccactctagcgtgcctacgggggccaacattcccagtccaaccgattggctgaatgctttattcggaaacggcctgtccagatggatccttggtgttattggggtgttgctcggaggcctggccctatttagcctgatcatgtctctcttcaaactgggcactaagcaggtctttaggtcacgcacaaaacttgcatga

SEQ ID NO: 11557 - RNA, 3222 nt, synthetic construct
  misc_feature 1..3222: note = derived and/or modified CDS sequence (opt3) from SFTSV(SPL121A)__AB985323.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctacttcccggcagaaaatagttattcccgatggtctggtctgctaagcccctgcgacgccgattggctcgggatgctggtggtcaaaaaggcgaaaggatccgacatgattgtgcctggcccatcatacaagggcaaggttttcttcgagcgtcccacatttgatgggtatgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacattcctggagctcaagagcttttcgcagtctgaatttccagatatctgcaaaatagacggaattgtatttaaccagtgtgagtccgaatcactgccgcaacccttcgatgttgcctggatggacgtgggccacagtcataagatcattatgcgggagcacaaaactaagtgggtccaggagagctcccctaaggattttgtgtgctacaaagaaggcaccgggccatgttctgagagcgaagagaagacatgcaaaacctcaggaagttgccgcggtgacatgcagttctgtaaggtggcaggctgcgaacacggggaggaggcctccgaagctaaatgtagatgcagcttagtccataagcccggagaggttgtggtatcttatggcggtatgagggtgcggcctaaatgttacgggttttcacgcatgatggcaactctggaagtcaatagtccagagcagcgaatcggccaatgcacaggatgtcaccttgaatgcatcaacggcggggtgagattgattaccctgacgagcgagctaaagtccgccactgtttgtgcttctcatttctgctcgagcgccacctccggaaagaaatcaacagagatacagttccacagtggttctctcgtgggcaagactgcgatccacgtcaaaggggcactggtggacggaaccgaatttacattcgagggcagctgtatgtttcccgatggttgcgacgccgtagattgcaccttctgtagggaatttcttaagaatccgcagtgctaccctgctaaaaagtggctgttcattatcatagttattttgctcgggtatgccggcctgatgttactgacgaacgtgctcaaggcaatcggagtctggggctcctgggtgatcgctcccgtcaaacttatgtttgccattatcaagaaactgatgcggtcagtgagctgtttgatggggaagctaatggaccgtggacgccaagttattcatgaggaaataggtgagaatagagagggcaaccaggatgacgtgaggatcgaaatggcgcggccacgacgcgtaagacactggatgtactctcctgtcattctgactatcctcgccatcgggctggcagagggatgcgatgaaatggtgcatgctgactccaaacttgttagttgtaagcagggcagcggtaatatgaaggagtgcgtgacaaccgggagggccctgttgcccgctgtcaacccaggccaggaggcctgtctccacttcactgcacccggatctcctgattccaaatgcctgaaggtgaaagtaaagcggattaatttaaaatgtaagaagtcaagtagctattttgtgccagacgcccgctcgagatgcacatccgttaggcgttgtcggtgggctggcgattgccaatctgggtgcccgagccatttcacctcaaacagtttttccgacgactgggcgggaaaaatggatcgagcaggcctgggtttctctgggtgtagcgacggatgcggcggtgccgcttgtggctgctttaatgccgcaccctcctgtatattctggagaaagtgggtcgaaaaccctcacgggatcatttggaaagtgtcaccatgcgccgcttgggtgcccagcgccgtcatcgagctaacgatgcctagtggagaagttaggaccttccacccaatgtctggcattcccacacaggtgtttaagggggtgtccgtaacttacctcggaagcgatatggaggtctcgggcctgaccgacctttgtgaaatggaggagttgaaatcaaagaaactggcactcgcgccgtgcaaccaggctggtatgggggtggttggaaaggtgggcgaaatccagtgttctagtgaggaatccgcccgcacaataaagaaagatggttgcatctggaatgcagacctggtcggcattgagcttcgggtggatgacgccgtttgttatagcaagatcacttctgtggaagctgtagccaactacagcgcaattcctaccacaatcgggggactgagattcgagaggtcccatgattcacaaggcaaaataagtgggagcccattggacattaccgctatccgcggatctttttccgtcaattatcgaggcctccggctgtcattaagtgagattactgccacgtgcacaggtgaagtgaccaacgtgagcgggtgctactcctgtatgactggagcgcgtgtctctatcaagctgcactcgagcaaaaattcaaccgcccatgttagatgcaagggcgatgagacagctttctccgtgctagaaggtgtacacagttacaccgtgtctctcagctttgaccacgcagtcgtggatgagcagtgtcagctgaactgcggcgggcatgaatcccaggttactcttaagggaaatttgatattcctggacgtgcccaaatttgtcgacggctcatatatgcaaacataccactctagcgtgcctacgggggccaacatccccagtccaaccgattggctcaatgctctgttcggaaacggcttatccaggtggattctgggtgttatcggggtgcttttgggaggcctcgccctgtttttcctaattatgagcctgtttaagctcggcactaaacaggtcttccgctctcggacaaagctggcatga

SEQ ID NO: 11558 - RNA, 3222 nt, synthetic construct
  misc_feature 1..3222: note = derived and/or modified CDS sequence (opt3) from SFTSV(SPL124A)__AB985324.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctacttcccggcagaaaatagttattcccgatggtctggtctgctaagcccctgcgacgccgattggctcgggatgctggtggtcaaaaaggcgaaaggatccgacatgattgtgcctggcccatcatacaagggcaaggttttcttcgagcgtcccacatttgatgggtatgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacattcctggagctgaagtccttttcgcagtctgaatttccagatatctgcaaaatagacggaattgtatttaaccagtgtgagtccgaatcactcccgcaacccttcgatgttgcctggatggacgtgggccacagtcataagatcattatgcgggagcacaaaactaagtgggtccaggagagctcctctaaggattttgtgtgctacaaagaaggcaccgggccttgtagcgagtcagaagagaagacatgcaaaaccagtggatcctgccgcggtgacatgcagttctgtaaggtggcaggctgcgaacacggggaggaggccagcgaagctaaatgtagatgctctttagtccataagccaggagaggttgtggtatcatatggcggtatgagggtgcggcccaaatgttacgggtttagtcgcatgatggcaactctggaagtcaatagccctgagcagcgaatcggccaatgcacaggatgtcaccttgaatgcatcaacggcggggtgagattgattaccctgacgtccgagctaaagtctgccactgtttgtgcttcgcatttctgcagctccgccacctcaggaaagaaaagtacagagatacagttccactctggtagcctcgtgggcaagactgcgatccacgtcaaaggggcactggtggacggaaccgaatttacattcgagggctcctgtatgtttccagatggttgcgacgccgtagattgcaccttctgtagggaatttcttaagaatccccagtgctacccggctaaaaagtggctgttcattatcatagttattttgctcgggtatgccggcctgatgttactgacgaacgtgctcaaggcaatcggagtctggggctcatgggtgatcgctcctgtcaaacttatgtttgccattatcaagaaactgatgcggagcgtgtcttgtttgatggggaagctaatggaccgtggacgccaagttattcatgaggaaataggtgagaatagagagggcaaccaggatgacgtgaggatcgaaatggcgcggccccgacgcgtaagacactggatgtactccccagtcattctgactatcctcgccatcgggctggcagagggatgcgatgaaatggtgcatgctgacagtaaacttgttagctgtaagcagggctctggtaatatgaaggagtgcgtgacaaccgggagggccctgttgcctgctgtcaaccccggccaggaggcctgtctccacttcactgcaccaggatcccccgattcaaaatgcctgaagattcgggtgaaacgcataaatttaaagtgtaaaaagagtagctcgtattttgtacctgacgccagatccaggtgcacatctgtgcgtcggtgtcgatgggctggcgattgccaaagcgggtgcccatcacatttcaccagtaactccttttctgacgactgggcgggaaagatggatagagcaggcctgggtttcagcgggtgttccgacggatgcggcggtgccgcttgtggctgctttaatgccgcaccgtcatgtatcttctggaggaaatgggttgaaaacccccacgggattatctggaaggtcagcccttgcgccgcttgggtgccaagtgccgtgattgagctaacgatgccctctggagaagtccgcaccttccaccctatgtccggcatcccaacacaggtttttaaaggggtgagcgtgacttacctcggatcggatatggaggtatcaggcctgaccgacctttgtgaaatagaggagttgaagtctaaaaagctggcactcgcgccctgcaaccaggctggtatgggggtcgtgggaaaagttggcgaaatccagtgtagttccgaggaaagcgcccggacaattaagaaggatggttgcatctggaatgcagacctggtgggcattgagcttagagtcgatgacgccgtgtgttattctaaaatcactagcgttgaagctgtggccaactactccgcaataccgaccacaattgggggactgaggttcgagcgctcacatgatagtcaaggcaagatcagcgggtctcctttggacattaccgctatccgaggatccttttcagtaaattatcggggcctccgtctgagtttaagcgagataactgccacgtgcacaggtgaagtcaccaacgtgtccgggtgctactcttgtatgactggagcgagagtgtcgatcaaactgcacagctcaaagaatagcaccgcccatgtcaggtgcaaaggcgatgagacagctttcagtgttctagaaggtgtgcactcttacaccgtaagcctctcctttgaccacgcagtggtcgatgagcagtgtcagctgaactgcggcgggcatgaatcacaggtgactcttaagggaaatttgattttcctggacgttccaaagtttgtggacggctcttatatgcaaacataccacagcagtgtccccacgggggccaacatcccttcccccaccgattggctcaatgctctgttcggaaacggcttaagccgctggattctgggtgtgatcggggttcttttgggaggcctcgccctgtttttcctaataatttctctgtttaaactcggcactaaacaggtgttccggtcaagaacaaagctggcatga

SEQ ID NO: 11559 - RNA, 3222 nt, synthetic construct
  misc_feature 1..3222: note = derived and/or modified CDS sequence (opt3) from SFTSV(SPL128A)__AB985325.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctacttcccggcagaaaatagttattcccgatggtctggtctgctaagcccctgcgacgccgattggctcgggatgctggtggtcaaaaaggcgaaaggatccgacatgattgtgcctggcccatcatacaagggcaaggttttcttcgagcgtcccacatttgatgggtatgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacattcctggagctgaagtccttttcgcagtctgaatttccagatatctgcaaaatagacggaattgtatttaaccagtgtgagtccgaatcactcccgcaacccttcgatgttgcctggatggacgtgggccacagtcataagatcattatgcgggagcacaaaactaagtgggtccaggagagctcctctaaggattttgtgtgctacaaagaaggcaccgggccttgtagcgagtcagaagagaagacatgcaaaaccagtggatcctgccgcggtgacatgcagttctgtaaggtggcaggctgcgaacacggggaggaggccagcgaagctaaatgtagatgctctttagtccataagccaggagaggttgtggtatcatatggcggtatgagggtgcggcccaaatgttacgggtttagtcgcatgatggcaactctggaagtcaatagccctgagcagcgaatcggccaatgcacaggatgtcaccttgaatgcatcaacggcggggtgagattgattaccctgacgtccgagctaaagtctgccactgtttgtgcttcgcatttctgcagctccgccacctcaggaaagaaaagtacagagatacagttccactctggtagcctcgtgggcaagactgcgatccacgtcaaaggggcactggtggacggaaccgaatttacattcgagggctcctgtatgtttccagatggttgcgacgccgtagattgcaccttctgtagggaatttcttaagaatccccagtgctacccggctaaaaagtggctgttcattatcatagttattttgctcgggtatgccggcctgatgttactgacgaacgtgctcaaggcaatcggagtctggggctcatgggtgatcgctcctgtcaaacttatgtttgccattatcaagaaactgatgcggagcgtgtcttgtttgatggggaagctaatggaccgtggacgccaagttattcatgaggaaataggtgagaatagagagggcaaccaggatgacgtgaggatcgaaatggcgcggccccgacgcgtaagacactggatgtactccccagtcattctgactatcctcgccatcgggctggcagagggatgcgatgaaatggtgcatgctgacagtaaacttgttagctgtaagcagggctctggtaatatgaaggagtgcgtgacaaccgggagggccctgttgcctgctgtcaaccccggccaggaggcctgtctccacttcactgcaccaggatcccccgattcaaaatgcctgaagattcgggtgaaacgcataaatttaaagtgtaaaaagagtagctcgtattttgtacctgacgccagatccaggtgcacatctgtgcgtcggtgtcgatgggctggcgattgccaaagcgggtgcccatcacatttcaccagtaactccttttctgacgactgggcgggaaagatggatagagcaggcctgggtttcagcgggtgttccgacggatgcggcggtgccgcttgtggctgctttaatgccgcaccgtcatgtatcttctggaggaaatgggttgaaaacccccacgggattatctggaaggtcagcccttgcgccgcttgggtgccaagtgccgtgattgagctaacgatgccctctggagaagtccgcaccttccaccctatgtccggcatcccaacacaggtttttaaaggggtgagcgtgacttacctcggatcggatatggaggtatcaggcctgaccgacctttgtgaaatagaggagttgaagtctaaaaagctggcactcgcgccctgcaaccaggctggtatgggggtcgtgggaaaagttggcgaaatccagtgtagttccgaggaaagcgcccggacaattaagaaggatggttgcatctggaatgcagacctggtgggcattgagcttagagtcgatgacgccgtgtgttattctaaaatcactagcgttgaagctgtggccaactactccgcaataccgaccacaattgggggactgaggttcgagcgctcacatgatagtcaaggcaagatcagcgggtctcctttggacattaccgctatccgaggatccttttcagtaaattatcggggcctccgtctgagtttaagcgagataactgccacgtgcacaggtgaagtcaccaacgtgtccgggtgctactcttgtatgactggagcgagagtgtcgatcaaactgcacagctcaaagaatagcaccgcccatgtcaggtgcaaaggcgatgagacagctttcagtgttctagaaggtgtgcactcttacaccgtaagcctctcctttgaccacgcagtggtcgatgagcagtgtcagctgaactgcggcgggcatgaatcacaggtgactcttaagggaaatttgattttcctggacgttccaaagtttgtggacggctcttatatgcaaacataccacagcagtgtccccacgggggccaacatcccttcccccaccgattggctcaatgctctgttcggaaacggcttaagccgctggattctgggtgccatcggggtgcttttgggaggcctcgcactgtttttcctaataatttctctgtttaaactcggcactaagcaggttttccggtcaagaacaaaactggcgtga

SEQ ID NO: 11560 - RNA, 3222 nt, synthetic construct
  misc_feature 1..3222: note = derived and/or modified CDS sequence (opt3) from SFTSV(SPL129A)__AB985326.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctactatccggcagaaaatagttactcccgatggtctggtctgctaagcccctgcgacgccgattggctcgggatgctggtggtcaaaaaggcgaaaggatccgacatgattgtgcctggcccatcatataagggcaaggttttctttgagcgtcccacattcgatgggtacgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacatttctggagctgaagtcattctcgcagtctgaatttccagatatctgcaaaatagacggaattgtattcaaccagtgtgagtccgaatcactcccgcaaccctttgatgttgcctggatggacgtgggccacagtcataagatcattatgcgggagcacaaaactaagtgggtccaggagagctcctctaaggatttcgtgtgctataaagaaggcaccgggccttgtagcgagtcagaagagaagacatgcaaaaccagtggatcctgccgcggtgacatgcagttttgtaaggtggcaggctgcgaacacggggaggaggccagcgaagctaaatgtagatgctctttagtccataagccaggagaggttgtggtatcatacggcggtatgagggtgcggcccaaatgttacgggttcagtcgcatgatggcaactctggaagtcaatcctccagagcagcgaatcggccaatgcacaggatgtcaccttgaatgcatcagcggcggggtgagattgattaccctgacgtccgagctaaagtctgccactgtttgtgcttcgcatttttgcagctccgccacctcaggaaagaaaagtacagagatacagttccactctggtagcctcgtgggcaaggcggcaatccacgtcaaaggggccctggtggacggaactgagttcacctttgaaggctcctgtatgttccccgatggttgcgacgctgtagattgcacattttgtagggagttccttaagaacccgcagtgctatcctgccaaaaagtggctgtttattatcatagttattttgctcgggtacgcaggcctgatgttactgaccaatgtgctcaaggctatcggagtctggggctcatgggtgatcgcccccgtcaaacttatgttcgcgattatgaagaaactgatgcggagcgtgtcttgtttgatggggaagctaatggaccgtggacgccaagttatccatgaagaaattggtgagaacagagagggcaatagggatgacgtgcggatagaaatggcccgaccacgcagagtaaggcactggatgtattcccctgtcatcctgacgattctcgcaatcgggctggctgagggatgcgatgaaatggtgcatgccgacagtaaacttgttagctgtcggcagggctctggtaacatgaaggagtgcgtgactacagggcgcgctctgttgcccgccgtcaatccaggccaggaggcatgtctccactttaccgcccccggatcccctgattcaaagtgcctgaaaatcaaggtgaaaagaattaacttaaagtgtaaaaagagtagctcgtacttcgtaccagacgctaggtcccgttgcacttctgtgcggcgatgtagatgggcgggcgattgccagagcgggtgcccgtcacattttacaagtaattccttctctgacgactgggcaggaaagatggatagggccggcctgggttttagcgggtgttccgacggatgcggcggtgctgcctgtggctgcttcaacgcagccccctcatgtatattttggcgcaaatgggttgaaaatcctcacgggatcatttggaaggtcagcccatgcgctgcctgggtgcccagtgcagtgatcgagctaaccatgccttctggagaagtccggacgttccacccaatgtccggcattcccacccaagttttcaaaggggtgagcgtgacatatctcggatcggatatggaggtatcaggcctgactgacctttgtgaaatcgaggagttgaagtctaaaaagctggcgctcgctccgtgcaaccaggccggtatgggggtcgtgggaaaagttggcgaaatacagtgtagttccgaggaaagcgcaagaaccatcaagaaggatggttgcatttggaacgccgacctggtgggcatcgagcttagggtcgatgacgctgtgtgttactctaaaattacaagcgttgaaactgtggccaattattccgcaatccctaccacaatagggggactgcgctttgagcgatcacatgatagtcagggcaagattagcgggtctccattggacatcaccgctattcggggatccttctcagtaaactaccgtggcctcagactgagtttaagcgagatcactgccacgtgcacaggtgaagtcaccaatgtgtccgggtgctactcttgtatgactggagcgaaagtgtcgataaagctgcacagcagcaaaaactccaccgcccatgtcaggtgcaaggaggatgaaacagcttttagtgttctagagggcgtgcactcttataccgtaagcctctccttcgaccacgcagtggtcgatgaacaatgtcagctgaattgcggtggccatgagtcacacgtgactcttaaggggaacttgatctttctggacgttcccaaattcgtggacggatcttacatgcagacatatcatagcagtgtccctacgggcgccaatattccctccccaaccgattggctcaacgctctgtttgggaatggattaagccgctggatcctgggcgtgatgggtgttcttctcgggggattggccctgttctttctaattatgtctctgttcaagctcggcactaaacaggtgtttcggtcaagaacaaagctggcatga

SEQ ID NO: 11561 - RNA, 3222 nt, synthetic construct
  misc_feature 1..3222: note = derived and/or modified CDS sequence (opt3) from SFTSV(YG1)__AB817987.1__GP
  source 1..3222: mol_type = other RNA
atgatgaaggtgatctggttcagctccctgatttgcctcgtcatacagtgttctggcgacaccgggcccatcatttgcgccggacctatccactcaaacaaaagtgctaatattccacatcttctgggttacagcgagaagatctgtcaaatagatagattgatccacgtttcctcttggttaaggaaccattcgcagtttcagggctatgtggggcagcggggaggccgctcacaagtaagctacttcccggcagaaaatagttattcccgatggtctggtctgctaagcccctgcgacgccgattggctcgggatgctggtggtcaaaaaggcgaaaggatccgacatgattgtgcctggcccatcatacaagggcaaggttttcttcgagcgtcccacatttgatgggtatgtgggatggggttgtggcagtgggaaaagcagaactgaatctggagagctttgctcctcagacagcggcacgagttctggtctgttgccttccgatagggtcctctggatcggggacgtggcttgtcagccaatgacccccattcctgaagagacattcctggagctgaagtcattttcgcagtctgaatttccagatatctgcaaaatagacggaattgtatttaaccagtgtgagtccgaatcactcccgcaacccttcgatgttgcctggatggacgtgggccacagtcataagatcattatgcgggagcacaaaactaagtgggtccaggagagctcctctaaggattttgtgtgctacaaagaaggcaccgggccttgtagcgagtcagaagagaagacatgcaaaaccagtggatcctgccgcggtgacatgcagttctgtaaggtggcaggctgcgaacacggggaggagactagcgaagccaaatgtagatgctctttagtccataagccaggagaggttgtggtatcatatggcggtatgagggtgcggcccaaatgttacgggtttagtcgcatgatggctacactggaagtcaatcctccagagcagcgaatcggccaatgcaccggatgtcaccttgaatgcatcaacggcggggtgagattgattacgctgactagcgagctaaagtccgcaaccgtttgtgcctctcatttctgctcgagcgctacatccggaaagaaatcaactgagatacagttccacagtggttctctcgtgggcaagaccgccatccacgtcaaaggggcgctggtggacggaacagaatttaccttcgagggcagctgtatgtttcccgatggttgcgacgcagtagattgcacgttctgtagggaatttcttaagaatccgcagtgctaccctgccaaaaagtggctgttcattatcatagttattttgctcgggtatgctggcctgatgttactgactaacgtgctcaaggccatcggaatctggggctcctgggtcattgcacccgtgaaacttatgtttgctatcattaagaaactgatgcggtcagtcagctgtttgatggggaagctaatggaccgtggacgccaagtgatacatgaggaaatcggtgagaatagagagggcaaccaggaagatgttaggattgagatggcccggccacgacgcgtgagacactggatgtactctcctgtaatcctggcgatcctcgccattgggctggcagaaggatgcgacgagatggtccatgctgattccaaacttgtgagttgtaagcagggcagcggtaatatgaaggagtgcgttacaaccgggagggccctgttgcccgctgtgaacccaggccaggaagcctgtctccacttcactgcacccggatctcctgactccaaatgcctgaagataaaagtcaagcggatcaatttaaaatgtaagaagtcaagtagctattttgtgccagatgcccgctcgagatgcacatccgtaaggcgttgtcggtgggctggcgactgccaatctgggtgcccgagccatttcacctcaaacagtttttccgatgactgggcgggaaaaatggaccgagcaggcctgggtttctctgggtgtagcgatggatgcggcggtgccgcttgtggctgctttaatgccgcaccctcctgtattttctggagaaagtgggtggagaaccctcacgggatcatttggaaagtttcaccatgcgccgcttgggtccccagcgccgtgatcgaactaacgatgcctagtggagaggtgaggaccttccacccaatgtctggcatacccacacaggtctttaagggggtttccgtgacttacctcggaagcgacatggaagtgtcgggcctgaccgatctttgtgagatcgaggaattgaaatcaaagaaactggcactcgcgccgtgcaaccaggctggtatgggggtagtcggaaaggtgggcgagattcagtgttctagtgaagagtccgcccgcacaatcaagaaagacggttgcatttggaatgcagatctggttggcatcgaacttcgggtggacgatgccgtctgttatagcaagataacttctgtggaggctgttgccaactacagcgcaattcctaccacaatcgggggactgagattcgagaggtcccatgactcacaaggcaaaattagtgggagcccattggatatcaccgctatacgcggatctttttccgtgaattatcgaggcctccggctgtcattaagtgaaatcactgccacgtgcacaggtgaggtaaccaacgtcagcgggtgctactcctgtatgactggagcgaaggtgtctattaaactgcactcgagcaagaatagcaccgcccatgtgcgttgcaagggcgacgaaacagctttctccgtcctagagggtgttcacagttacaccgtgtctctcagctttgatcacgcagtagtggacgaacagtgtcagctgaactgcggcgggcatgagtcccaggtcactcttaaaggaaatttgatcttcctggatgtgcccaagtttgttgacggctcatatatgcaaacataccactctagcgtgcctacgggggccaacattcccagtccaaccgactggctcaatgctctgttcggaaacggcttatccagatggatcctgggtgtcataggggtgcttttgggaggcctcgccctgtttttcctaattatgagcctgtttaaactcggcactaagcaggttttcaggtctcgcacaaaactggcatga

SEQ ID NO: 11562 - RNA, 3222 nt, synthetic construct
  misc_feature 1..3222: note = derived and/or modified CDS sequence (opt3) from SFTSV(SDTA_1)__KX641913.1__GP
  source 1..3222: mol_type = other RNA
atgatgaaggtgatctggttcagctccctgatttgcctcgtcatacagtgttctggcgactcagggcccatcatttgcgccggacctatccacagtaacaaaagcgctggtattccacatcttctgggctactccgagaagatctgtcaaatagatagattgatccacgtttcttcgtggttaaggaatcattcacagtttcaggggtatgtgggacagcggggcggtcgcagccaagtaagttactatccggcagaaaactcctactctcgatggagcgggctgctatccccctgcgacgccgattggctcggaatgctggtggtcaaaaaggcgcgtgagtcagacatgattgtgcctggcccaagttataaaggcaaggttttctttgaaagacccaccttcgatgggtacgtgggatggggttgtggcagcgggaagtctaggacagagtccggagaactttgctcaagcgacagtggcacttcttccggtctgttgcctagcgatcgggtcctctggatcggggacgtggcttgtcagctgatgacgccaattcccgaggagacctttctggaactcaaatcgttctctcagtccgagtttcctgatatctgcaagatagacggaattgtattcaatcagtgtgaaggcgagtcattaccacaaccgtttgatgttgcctggatggacgtgggccacagtcataaaatcattatgcgcgagcacaagacaaaatgggtccaggaaagctcctctaaggatttcgtgtgctataaggaggggactggaccctgtagcgaatcagaggaaaaagcatgcaagaccagtggttcctgcagaggcgacatgcagttttgtaaagtggccgggtgcgagcacggagaggaaacaagcgaggctaagtgtaggtgctctctggtccataaacctggcgaagttgtggtatcatacggtgggatgcgggtgcgcccaaagtgttacggcttcagtcgaatgatggcaacccttgaggtcaatccccctgaacagagaatcggacaatgcactggctgtcacttggagtgcatcaacgggggagtgaggctgattacactaaccagcgagctccggtccgccacggtttgtgcttctcatttttgctcgagcgcctcctcaggtaaaaagagtactgaaatacacttccactctggcagcctggtggggaagaccgcgatccatgtcaaaggagcacttgtggacggcacagagttcacttttgaaggttcctgtatgttcccagatgggtgcgacgccgtagattgcaccttttgtcgtgagttcctgaagaacccccagtgctatccggctaaaaagtggttgtttattatcatagttattctcctgggctacgccggattaatgctgctcacaaatgtgcttaaagcaatcggcgtctgggggtcatgggtgatcgctcctgtcaagctgatgttcgccattatcaagaaattgatgcgcaccgtgagctgtctagttggaaagctgatggacagaggtaggcaagtgattcacgaagagataggcgagaacggggaaggaaatcaggatgacgtacggatcgagattgcgcgaccccgcagagtcaggcattggatgtattctccagtgatcctcacgatcctggccattggccttgcagaaggttgcgatgagatggttcacgctgactccaaactggtgagttgtcggcaggggagcggcaacatgaaggagtgcataactacaggacgcgccttgctccctgctgtcaatcccggccaggaagcctgtctgcattttaccgcaccagggtctcccgattccaaatgcttaaagatcaaggtgaaaagaattaacctgaagtgtaaaaagtcaagtagctacttcgtacctgacgccaggtcgcgttgcacttccgtgcggcgatgtagatgggctggagattgccagtctggctgcccaccgcactttacaagcaattcattcagtgacgactgggcgggtaaaatggatagggcagggctaggattttccggctgttctgacggttgcggcggggccgcttgtggatgcttcaacgccgcacccagctgtatcttttggcgcaagtgggttgagaatcctcacggcattatctggaaggtctccccatgcgccgcttgggtgccctcagccgtgatagaactcaccatgcctagcggggaggtccggacgttccatccaatgagtggaatccccacccaagttttcaaaggcgtgtctgtgacatatctgggttccgatatggaagtaagcgggcttactgacttgtgtgagattgaggaactgaagtcgaaaaagctcgcactggcgccgtgcaaccaggctggaatgggcgtcgtgggtaaagttggcgagatccagtgttcatctgaagagagtgccagaaccattaagaaagatgggtgcatctggaacgcagaccttgtgggaatagaactgagggtcgatgacgccgtgtgttactccaagattacaagcgttgaggctgtggccaattattctgcaatccctactaccattggcgggttgcgctttgagcgaagccacgattcccagggaaagatctcaggcagtccactcgacataacagctatccggggtagcttctctgtaaactaccgtgggctgagattatccctgtcagaaattaccgccacttgcacgggagaggtcacaaatgtgagtggctgctacagctgtatgaccggtgcgaaagtgtccatcaagctacattcttcgaaaaacagcactgcccacgtcaggtgcaagggcgatgaaaccgctttttcagttctcgagggggtgcactcctatattgtaagtctgtctttcgaccatgcagtggtcgatgaacaatgtcagcttaattgcggaggccacgagagccaggtgacattgaaagggaacctgatctttctcgacgttcccaagttcgtggacggatcctacatgcagacctatcattcaactgtccctacaggcgccaatataccctctccaacggattggctgaacgctttatttggtaatgggctgagccgctggattcttggagtgatcggcgttttgctcggcgggctggccctattctttctgatcatgttcctcctgaaacttggaaccaagcaagtgtttcggagtagaactaagttggcatga

SEQ ID NO: 11563 - RNA, 3222 nt, synthetic construct
  misc_feature 1..3222: note = derived and/or modified CDS sequence (opt3) from SFTSV(SDTA_2)__KX641914.1__GP
  source 1..3222: mol_type = other RNA
atgatgaaggtgatctggttcagctccctgatttgcctcgtcatacagtgttctggcgactcagggcccatcatttgcgccggacctatccacagtaacaaaagcgctggtattccacatcttctgggctactccgagaagatctgtcagatagatagattgatccacgtttcttcgtggttaaggaatcattcacagtttcaggggtatgtgggacagcggggcggtcgcagccaagtaagttactatccggcagaaaactcctactctcgatggagcgggctgctatccccctgcgacgccgattggctcggaatgctggtggtcaaaaaggcgaaagagtcagacatgattgtgcctggcccaagttataagggcaaggttttctttgaacgtcccaccttcgatgggtacgtgggatggggttgtggcagcgggaaatctagaacagagtccggagaactttgctcaagcgacagtggcacttcttccggtctgttgcctagcgatagggtcctctggatcggggacgtggcttgtcagccaatgacgcccattcctgaggagacctttctggaactgaagtcgttctctcagtccgagtttccagatatctgcaaaatagacggaattgtattcaatcagtgtgaaggcgagtcactcccgcaaccctttgatgttgcctggatggacgtgggccacagtcataagatcattatgcgggagcacaaaacaaagtgggtccaggaaagctcctctaaggatttcgtgtgctataaagaggggactggaccttgtagcgaatcagaggaaaaggcatgcaaaaccagtggttcctgccgcggcgacatgcagttttgtaaggtggccgggtgcgagcacggagaggaagctagcgaggcaaaatgtagatgctctttagtccataagccaggcgaagttgtggtatcatacggtgggatgagggtgcggcccaaatgttacggcttcagtcgcatgatggccacactggaggtcaaccctccagaacacatgatcggacagtgcaccggctgtcatcttgagtgcatcaatgggggagtgcgattgattactctgacaagcgagctaagatccgctaccgtttgtgcctctcacttttgctcgagcgcgtcctcaggtaagaagagtacggaaatacacttccattctggcagcctcgtggggaaaactgcaatccacgtcaagggagccctggtggacggcaccgagttcacatttgaaggttcctgtatgttccccgatgggtgcgacgctgtagattgcactttttgtagggagttccttaaaaacccgcaatgctatcctgccaagaaatggctgtttattatcatagttattttgctcggctacgcaggactgatgttactgaccaatgtgctcaaggctatcggcgtctgggggtcatgggtgatcgcccccgtcaaacttatgttcgcgattatcaagaagctgatgcggacagtgagctgtttggttggaaaactaatggaccgtggtcgccaggtgattcatgaagagataggcgagaacggggaaggaaatcaggatgacgtaagaatcgagatggccaggccacggcgagtccgccactggatgtattctcctgtgattctgaccatcctcgcaatcggcctggctgaaggttgcgatgagatggttcatgccgactccaaacttgtgagttgtagacaagggagcggcaacatgaaggagtgcattacgactggaagggctctgttgcccgccgtcaatccaggccaggaagcatgtctccactttacagcccccgggtctcctgattccaagtgcctgaagataaaagtgaagcggatcaacttaaaatgtaagaaatcaagtagctacttcgtaccagacgctcgctcgagatgcacctccgtgaggcgttgtcggtgggcgggagattgccagtctggctgcccgccccactttactagcaattcattcagtgacgactgggcaggtaagatggatcgagccgggctgggattttccggctgttctgacggttgcggcggggctgcctgtggatgcttcaacgcagcccctagctgtatcttttggagaaagtgggttgagaatccacatggcattatttggaaagtctccccctgcgctgcctgggtgccttcagcagtgatcgaactaacaatgccaagcggggaggtcaggaccttccaccccatgagtggaataccgacgcaggttttcaagggcgtgtctgtgacctatctcggttccgatatggaagtaagcgggctgacagacctttgtgagatcgaggaattgaaatcgaagaaactggcgctcgctccttgcaaccaagccggaatgggcgtcgtgggtaaggttggcgagattcagtgttcatctgaagagagtgcacgcactatcaaaaaggatgggtgcatttggaacgccgacctggtgggaatcgaacttcgggtcgatgacgctgtgtgttactccaagataaccagcgttgaggccgtggcaaattattctgctattccaacaactatcggcgggctgagatttgagaggagccatgattcccagggaaaaatttcaggcagtcccttggacatcaccgccatacgcggtagcttctctgtaaactaccgagggctccggctgtccttatcagaaatcacagcgacctgcactggagaggtcacgaatgtgagtggctgctacagctgtatgacaggtgccaaggtgtccattaaactgcactcttcgaagaacagcaccgctcacgtccgttgcaaaggcgatgaaactgcattttcagttctagagggggtgcattcctatatcgtaagtctctctttcgaccacgccgtggtcgatgaacagtgtcaactgaattgcggaggccatgagagccaggtgacccttaaggggaacttgatttttctggacgttcctaagttcgtggacggatcctacatgcagacatatcactcaaccgtccccactggcgctaatatcccatctcctacagattggctcaacgccctgtttggtaatgggttaagcagatggatactgggagtgattggcgttcttttgggcgggctcgcactgttctttctaatcatgttcctgctcaaactgggaacgaagcaagtgtttaggagtcgcaccaaacttgcgtga

SEQ ID NO: 11564 - RNA, 3222 nt, synthetic construct
  misc_feature 1..3222: note = derived and/or modified CDS sequence (opt3) from SFTSV(SDTA_3)__KX641915.1__GP
  source 1..3222: mol_type = other RNA
atgatgaaggtgatctggttcagctccctgatttgcctcgtcatacagtgttctggcgactcagggcccatcatttgcgccggacctatccacagtaacaaaagcgctggtattccacatcttctgggctactccgagaagatctgtcaaatagatagattgatccacgtttcttcgtggttaaggaatcattcacagtttcaggggtatgtgggacagcggggcggtcgcagccaagtaagttactatccggcagaaaactcctactctcgatggagcgggctgctatccccctgcgacgccgattggctcggaatgctggtggtcaaaaaggcgaaagagtcagacatgattgtgcctggcccaagttataagggcaaggttttctttgaacgtcccaccttcgatgggtacgtgggatggggttgtggcagcgggaaatctagaacagagtccggagaactttgctcaagcgacagtggcacttcttccggtctgttgcctagcgatagggtcctctggatcggggacgtggcttgtcagccaatgacgcccattcctgaggagacctttctggaactgaagtcgttctctcagtccgagtttccagatatctgcaaaatagacggaattgtattcaatcagtgtgaaggcgagtcactcccgcaaccctttgatgttgcctggatggacgtgggccacagtcataagatcattatgcgggagcacaaaacaaagtgggtccaggaaagctcctctaaggatttcgtgtgctataaagaggggactggaccttgtagcgaatcagaggaaaaggcatgcaaaaccagtggttcctgccgcggcgacatgcagttttgtaaggtggccgggtgcgagcacggagaggaagctagcgaggcaaaatgtagatgctctttagtccataagccaggcgaagttgtggtatcatacggtgggatgagggtgcggcccaaatgttacggcttcagtcgcatgatggccacactggaggtcaaccctccagaacagcgaatcggacaatgcaccggctgtcaccttgagtgcatcaatgggggagtgagattgattactctgacaagcgagctaaggtccgctaccgtttgtgcctctcatttttgctcgagcgcgtcctcaggtaagaagagtacggaaatacacttccactctggcagcctcgtggggaaaactgcaatccatgtcaagggagccctggtggacggcaccgagttcacatttgaaggttcctgtatgttccccgatgggtgcgacgctgtagattgcactttttgtcgggagttccttaaaaacccgcagtgctatcctgccaagaaatggctgtttattatcatagttattttgctcggctacgcaggactgatgttactgaccaatgtgctcaaggctatcggcgtctgggggtcatgggtgatcgcccccgtcaaacttatgttcgcgattatcaagaagctgatgcgtacagtgagctgtttggttggaaaactaatggaccgcggtagacaggtgattcacgaagagataggcgagaacggggaaggaaatcaagatgacgtaaggatcgaggtcgcccggccacgacgcgtgagacattggatgtattctcctgttattctgaccatcctcgcaatcggcctggctgaaggttgcgatgagatggtgcacgccgactccaaacttgtcagttgtaggcaggggagcggcaacatgaaggagtgcattacgactggacgggctctgttgcccgccgtgaatccaggccaggaagcatgtctccattttacagcccccgggtctcctgattccaagtgcctgaagataaaagtaaagcgcatcaacttaaaatgtaagaaatcaagtagctacttcgtgccagacgctagatcgaggtgcacctccgttcgtcggtgtcgatgggcgggagattgccagtctggctgcccgccccactttactagcaattcattcagtgacgactgggcaggtaagatggatagagccgggctgggattttccggctgttctgacggttgcggcggggctgcctgtggatgcttcaacgcagcccctagctgtatcttttggaggaagtgggtcgagaatccacacggcattatttggaaagtgtccccctgcgctgcctgggtgccttcagcagtcatcgaactaacaatgccaagcggggaggttcgcaccttccatcccatgagtggaataccgacgcaagtgttcaagggcgtgtctgtaacctatctcggttccgatatggaagtcagcgggctgacagacctttgtgagatcgaggaattgaaatcgaagaaactggcgctcgctccttgcaaccaggccggaatgggcgtggttggtaaggtgggcgagattcagtgttcatctgaagagagtgcacggactatcaaaaaggatgggtgcatttggaacgccgacctggtcggaatcgaacttagagtggatgacgctgtttgttactccaagataaccagcgtggaggccgtagcaaattattctgctattccaacaactatcggcgggctgaggtttgagcgcagccacgattcccagggaaaaatttcaggcagtcccttggacatcaccgccatacgaggtagcttctctgtcaactaccgggggctccgtctgtccttatcagaaatcacagcgacctgcactggagaggtgacgaatgtgagtggctgctacagctgtatgacaggtgccaaggtctccattaaactgcattcttcgaagaacagcaccgctcacgttagatgcaaaggcgatgaaactgcattttcagtgctagagggggtacactcctatatcgtgagtctctctttcgaccatgccgtcgtggatgaacaatgtcagctgaattgcggaggccacgagagccaggttacccttaaggggaacttgatttttctggacgtgcctaagttcgtcgacggatcctacatgcagacatatcattcaaccgtgcccactggcgctaatatcccatctcctacagattggctcaacgccctgtttggtaatgggttaagtaggtggatactgggagttattggcgtgcttttgggcgggctcgcactgttctttctaatcatgttcctgctcaaactgggaacgaagcaagtctttcgcagccggaccaaacttgcgtga

SEQ ID NO: 11565 - RNA, 3222 nt, synthetic construct
  misc_feature 1..3222: note = derived and/or modified CDS sequence (opt3) from SFTSV(SDTA_4)__KX641916.1__GP
  source 1..3222: mol_type = other RNA
atgatgaaggtgatctggttcagctccctgatttgcctcgtcatacagtgttctggcgactcagggcccatcatttgcgccggacctatccacagtaacaaaagcgctggtattccacatcttctgggctactccgagaagatctgtcaaatagatagattgatccacgtttcttcgtggttaaggaatcattcacagtttcaggggtatgtgggacagcggggcggtcgcagccaagtaagttactatccggcagaaaactcctactctcgatggagcgggctgctatccccctgcgacgccgattggctcggaatgctggtggtcaaaaaggcgaaagagtcagacatgattgtgcctggcccaagttataagggcaaggttttctttgaacgtcccaccttcgatgggtacgtgggatggggttgtggcagcgggaaatctagaacagagtccggagaactttgctcaagcgacagtggcacttcttccggtctgttgcctagcgatagggtcctctggatcggggacgtggcttgtcagccaatgacgcccattcctgaggagacctttctggaactgaagtcgttctctcagtccgagtttccagatatctgcaaaatagacggaattgtattcaatcagtgtgaaggcgagtcactcccgcaaccctttgatgttgcctggatggacgtgggccacagtcataagatcattatgcgggagcacaaaacaaagtgggtccaggaaagctcctctaaggatttcgtgtgctataaagaggggactggaccttgtagcgaatcagaggaaaaggcatgcaaaaccagtggttcctgccgcggcgacatgcagttttgtaaggtggccgggtgcgagcacggagaggaagctagcgaggcaaaatgtagatgctctttagtccataagccaggcgaagttgtggtatcatacggtgggatgagggtgcggcccaaatgttacggcttcagtcgcatgatggccacactggaggtcaaccctccagaacagcgaatcggacaatgcaccggctgtcaccttgagtgcatcaatgggggagtgagattgattactctgacaagcgagctaaggtccgctaccgtttgtgcctctcatttttgctcgagcgcgacgtccggtaagaagtcaactgaaatacacttccacagtggctctctcgtggggaaaaccgcaatccatgtcaagggagccctggtggacggcacagagttcacttttgaaggtagctgtattttccccgatgggtgcgacgctgtagattgcaccttttgtcgggagttccttaaaaacccgcagtgctatcctgccaagaaatggctgtttatcataattgttatcttgctcggctacgcaggactgatgttactgacaaatgtgctcaaggctatcggcgtctgggggtcctgggtgattgcccccgtcaagttgatcttcgcgattatgaaaaagctgatgcgtaccgtgtcatgtttggttggaaaactaatggaccgcggtagacaggtgatacacgaagagatcggcgagaacggggaaggaaatcaagatgacgtaaggattgagatggcccggccacgacgcgtcagacattggatgtatagccctgtgatcctgacgatcctcgcaattggcctggctgaaggttgcgatgagatggttcacgccgactctaaacttgtgtcctgtaggcaggggagtggcaacatgaaggagtgcataactacaggaggcgctctgttgcccgccgtcaatccagggcaggaagcatgtctccattttaccgcccccggaagccctgattctaagtgcctgaagatcaaagtgaagcggattaacttaaaatgtaagaaatcctcaagttacttcgtaccagacgctcgcagcagatgcacttcggtgaggcgttgtcggtgggcgggcgattgccagtccggttgcccgccccactttacatctaatagcttctcagacgactgggcagggaagatggatcgagccggactgggctttagtggttgttccgacggctgcgggggagctgcctgtggctgcttcaacgcagccccttcttgtatcttttggagaaagtgggttgagaatccacacgggattatctggaaagtcagcccctgcgctgcctgggtgccttccgcagtgatagaactaaccatgccatcaggagaggtcaggacgttccatcccatgagcggcatcccgacccaagttttcaagggtgtgagtgtgacatatctcgggtctgatatggaagtatccggactgactgacctttgtgagattgaggaattgaaaagcaagaaactggcgctcgctccttgcaaccaggccggcatgggtgtcgtgggcaaggttggggagatccagtgttcgtcagaagagtctgcacgcaccattaaaaaggatggatgcatctggaacgccgacctggtgggcatagaacttcgggtcgatgacgctgtgtgttacagtaagattacatccgttgaggccgtggcaaattatagcgctatcccaactaccattgggggactgagatttgagaggtctcacgatagccagggcaaaatctccggttcacccttggacataacagccatccgcgggagtttcagcgtaaactaccgaggactccggctgtctttatccgaaattaccgcgacttgcacgggcgaggtcacaaatgtgtcaggttgctacagttgtatgaccggcgccaaggtgagcatcaaactgcattcctctaagaactcgactgctcacgtccgttgcaaaggggatgaaaccgcatttagcgttctagagggagtgcactcatatattgtatccctcagtttcgaccatgccgtggtcgatgaacaatgtcagctgaattgcggcgggcacgagtctcaggtgacacttaagggaaacttgatctttctggacgttcctaagttcgtggacggcagctacatgcagacctatcattccactgtccccacaggtgctaatataccatcacctacggattggctcaacgccctgtttgggaatggattatctagatggattctgggcgtgatcggcgttcttcttgggggactcgcactgttctttctaatcatgttcctgctcaaactgggtaccaagcaagtgtttaggagccgcactaaacttgcgtga

SEQ ID NO: 11566 - RNA, 3222 nt, synthetic construct
  misc_feature 1..3222: note = derived and/or modified CDS sequence (opt3) from SFTSV(HBGS13_human_2015)__KY440773.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcaatagggtcttgtggatcggggacgtggcttgtcagccaatgacgcccattcctgaagagaccttcctcgagctgaagtcgttttctcagtccgaatttccagatatctgcaaaatagacggaattgtatttaaccagtgtgagggcgaatcactgccgcaacccttcgatgttgcctggatggacgtgggccacagtcataagatcattatgcgggagcacaaaacaaagtgggtccaggagagctcctctaaggattttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaatcagcctgagcaacgaatcggacagtgcactggctgtcacctggaatgcatcaacgggggagtgagacttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggacggcactgaatttaccttcgagggtagctgtatgtttccagatgggtgcgacgccgtagattgcacattctgtagggaatttctgaagaatccccaatgctatccggctaaaaagtggcttttcattatcatagttattctgttgggctacgccggactcatgctgttaaccaacgtgctgaaggcaatcggcatctgggggtcctgggtcattgctcctgtgaaactcatctttgccattataaagaaacttatgcggacggtctcatgtctgatgggaaagttgatggaccgtggtcgccaggtgatccatgaggaaattggcgagaatagagaggggaaccaggatgacgttaggatcgaaatggcgcggccccgacgcgtgagacactggatgtatagcccagtaatcctaactattctggccataggaatcgcagagtcttgcgatgaaatggtccatgctgactccaaactcgtgagttgtaggcagggcagcggtaatatgaaggagtgcgttacaaccgggcgggccctgcttcctgctgtgaaccccggccaagaggcctgtctgcacttcactgcaccaggatctcccgattccaagtgcttgcgcattaaagtcaagagaatcaatctcaaatgtaagaaatcaagtagctactttgtgcctgacgccaggtcgcgttgcacatccgtacggcgatgtagatgggctggcgattgccagtctgggtgcccaccgcatttcaccagcaactcatttagtgacgactgggcgggaaagatggatagggcaggcctgggtttctccgggtgttctgacggatgcggcggtgccgcttgtggctgctttaatgccgcacccagctgtattttctggcgcaagtgggtggaaaaccctcacgggatcatatggaaagtttccccatgcgccgcttgggtcccctcagccgtgatcgagttaacgatgcctagcggagaagtgcggaccttccacccaatgagtggcattcccacacaggtctttaagggggtttctgtgacttatctgggatccgatatggaggtgagcggcctaaccgacctctgtgaaatcgaggagctgaaatcgaagaaacttgcattggcgccgtgcaaccaggctggtatgggggtagtcggaaaggtgggcgaaattcaatgttcatctgaggaaagtgccagaacaatcaaaaaggatggttgcatatggaatgcagacctggttggcattgagctcagggtggatgacgccgtctgttactccaagatcactagcgtggaagctgttgccaactattctgcaattcctaccacaatcgggggactgcgcttcgagcgaagccatgattcccagggcaaaatatcagggagtccacttgacatcaccgctattcggggcagcttttctgtgaattaccgtggactgagattgtccctctcagagatcactgccacgtgcacaggtgaagtaaccaacgtcagtgggtgctacagctgtatgactggagcgaaggtgtccattaaactgcactcttcgaagaatagcaccgcccatgtgaggtgcaaaggcgatgagacagctttctcagtcttagaaggtgttcactcctataccgtgagtctgtcttttgaccacgcagtagtggatgagcagtgtcagctaaactgcggcgggcatgaaagccaagtcactctcaagggaaatctgatcttccttgacgtgcccaagtttgttgacggctcctacatgcagacatatcactcaacggtgcctaccggggccaacataccctctccaactgattggttgaatgctctgttcggaaacggcctcagccgctggattctgggtgtcatgggggtgttactgggaggccttgccttgtttatcatcattatgagtctcttcaaactgggcacaaagcaggtttttcggtccagaaccaaactagcatga

SEQ ID NO: 11567 - RNA, 3222 nt, synthetic construct
  misc_feature 1..3222: note = derived and/or modified CDS sequence (opt3) from SFTSV(HBMC16_human_2015)__KY440776.1__GP
  source 1..3222: mol_type = other RNA
atgatgaaggtgatctggttcagctccctggtctgcctcgttattcagtgttctggcgactcagggcccataatctgcgccggacctattcacagtaacaaaagcgctggtatcccacatcttctgggctactccgagaagatttgtcaaatcgatagattgatacacgtgtcttcgtggttaaggaatcattcacagtttcaggggtatgtaggacagcggggcggtcgcagccaagtgagttactatccggcagaaaactcctactctcgatggagcgggctgctatccccctgcgacgccgattggctcggaatgctggtcgtgaaaaaggcgaaaggctcagacatgatcgttcctggcccaagttataaggggaaggtgttctttgagcgtcccaccttcgatggatacgtcggttggggctgtgggagcggaaaatctagaacagaatccggcgagctttgctcaagcgacagtggtacttcttccgggctgttgcctagcgatagggtgctctggattggagacgtagcttgtcagccaatgacgcccatccctgaagagacctttctggagctgaagtcgttctctcagtccgaatttccagatatttgcaaaatcgacggcatagttttcaatcagtgtgagggcgaatcactcccgcaaccctttgatgtggcctggatggacgtcgggcacagtcataagattatcatgcgggagcacaaaacaaagtgggtgcaggagagctcctctaaggatttcgtgtgctataaagaaggaactggtccttgtagcgagtcagaagagaaggcatgcaaaaccagtggctcctgccgcggggacatgcagttttgtaaggtcgccggatgcgaacacggcgaggaggctagcgaagcaaaatgtagatgctctttagttcataagccaggtgaggtggtagtgtcatacgggggcatgagggtccggcccaaatgttacggattcagtcgcatgatggccacaatggaagtgaaccctccagagcagcgaattggccaatgcaccgggtgtcacctggaatgcatcaatggaggtgttagacttatcactttgacaagcgagctgaagtccgctaccgtgtgtgcctctcatttttgctcgagcgcgacgtccggcaagaaatcaactgagattcacttccacagtgggtctctagtcggaaaggcagccatacatgtgaaaggcgctctcgtagacggtaccgaatttacatttgaggggagctgtatgttccccgatggctgcaacgccgttgactgcactttttgtagggagttcctgaagaatccgcagtgctatcctgccaaaaagtggctttttatcattatcgtgatactgttgggatacgctggcctcatgctgttaaccaacgtcctgaaggccattggggtgtggggatcctgggtcatcgcgcccgtgaaactcatgttcgccatcatgaagaaacttatgcggacagtttcatgtctggtgggtaagttgatggatcgtggccgccaggtaattcacgaagaaatcggggagaatggagagggcaaccaagacgatgtcagaattgaaatggcaaggccacggcgagtgcgccattggatgtatagccctgttatactaaccatcctggctattggtctcgccgaggggtgcgacgaaatggtgcacgctgattctaaactggtctcctgtagacagggcagtggaaatatgaaggagtgcgtgacgactggcagggcccttctgcccgcagtaaacccagggcaggaggcctgtttgcattttacagctcccggaagccctgactctaagtgcctcaaaatcaaggtgaaacggatcaatctgaagtgtaaaaagtcctcaagttacttcgttccagatgcgcgcagcagatgcacctcggtcaggcgttgtcggtgggcaggcgactgccagtccggttgcccgccccactttacttctaacagcttctcagatgactgggccgggaagatggaccgagctggattaggctttagtggttgttccgatggctgcgggggagccgcatgtggctgcttcaatgccgctccttcttgtattttctggagaaaatgggtggaaaacccacacgggataatctggaaggtgagcccctgcgccgcatgggtcccttccgcggttattgagctgacaatgccatcaggagaagtgaggaccttccatcccatgagcggcatcccgacgcaagtgttcaaaggtgtaagtgtcacctatctagggtctgacatggaggtgtccggactcacagatctgtgtgaaattgaggagcttaagagcaaaaagttggctctggccccttgcaaccaggcaggcatgggtgttgtgggcaaagtcggggaaatccagtgttcgtcagaggaatctgcccgcactataaagaaggacggatgcatctggaatgctgatctcgtgggcattgagctgcgggttgacgatgccgtgtgttacagtaaaatcacctccgtagaagcagtcgctaactatagcgccattccaacaactatcgggggacttagatttgagaggtctcacgacagccagggcaagatatccggttcacccctggatattaccgcgatccgcgggagtttcagcgtgaattaccgaggattgcggctctctctgtccgagattacagcaacctgcactggcgaagtgacgaacgtctcaggttgctacagttgtatgacaggcgctaaagttagcatcaagttacattcctctaaaaattcgaccgcacacgtgcgttgcaagggggacgagactgcctttagcgtactggaaggagtgcactcatataccgtctccctaagtttcgatcatgctgtggttgacgagcaatgtcagctcaactgcggcgggcacgaatctcaggtgacactgaagggaaatcttatatttttggatgtccctaaattcgtggacggcagctacatgcagacctatcattccactgttcccacaggtgccaacatcccatcacctacggactggctgaatgcactctttgggaacggactgtctagatggattttaggcgtgatcggcgtcctgcttgggggattggccctcttctttctgattatgttcctatttaagctgggtaccaaacaagtattcaggagccgcactaagctcgcgtga

SEQ ID NO: 11568 - RNA, 3222 nt, synthetic construct
  misc_feature 1..3222: note = derived and/or modified CDS sequence (opt3) from SFTSV(HBMC5_human_2016)__KY440770.1__GP
  source 1..3222: mol_type = other RNA
atgatgaaggtgatctggttcagctccctggtctgcctcgttattcagtgttctggcgactcagggcccataatctgcgccggacctattcacagtaacaaaagcgctggtatcccacatcttctgggctactccgagaagatttgtcaaatcgatagattgatacacgtgtcttcgtggttaaggaatcattcacagtttcaggggtatgtaggacagcggggcggtcgcagccaagtgagttactatccggcagaaaactcctactctcgatggagcgggctgctatccccctgcgacgccgattggctcggaatgctggtcgtgaaaaaggcgaaaggctcagacatgatcgttcctggcccaagttataaggggaaggtgcttttcgagcgtcccacctttgatggatacgtcggttggggctgtgggagcggaaaatctagaacagaatccggcgagctgtgctcaagcgacagtggtacttcttccgggttgctccctagcgatagggtgctgtggattggagacgtagcttgtcagccaatgacgcccatccctgaagagaccttcctggagctcaagtcgttttctcagtccgagttcccagatatttgcaaaatcgacggcatagtttttaatcagtgtgaaggcgaatcattaccgcaacccttcgatgtggcctggatggacgtcgggcacagtcataagattatcatgcgggagcacaaaacaaagtgggtgcaggagagctcctctaaggattttgtgtgctataaagaaggaactggtccttgtagcgagtcagaagagaaggcatgcaaaaccagtggctcctgccgcggggacatgcagttctgtaaggtcgccggatgcgaacacggcgaggaggctagcgaagcaaaatgtagatgctctctggttcataagccaggtgaggtggtagtgtcatacgggggcatgagggtccggcccaaatgttacggatttagtcgcatgatggccacaatggaagtgaaccctccagagcagcgaattggccaatgcaccgggtgtcaccttgaatgcatcaatggaggtgttagattgatcactctgacaagcgagctaaagtccgctaccgtgtgtgcctctcatttctgctcgagcgcgacgtccggcaagaaatcaactgagattcactttcacagtgggtctctcgtcggaaaggcagccatacatgtgaaaggcgctctggtagacggtaccgagttcacattcgaagggagctgtatgtttcccgatggctgcaacgccgttgactgcactttctgtagggaatttcttaagaatccgcagtgctatcctgccaaaaagtggctgttcatcattatcgtgatattgctcggatacgctggcctgatgttactgaccaacgtcctcaaggccattggggtgtggggatcctgggtcatcgcgcccgtgaaacttatgtttgccatcatgaagaaactgatgcggacagtttcatgtttggtgggtaagctaatggatcgtggccgccaggtaattcacgaggaaatcggggagaatggagagggcaaccaagacgatgtcagaattgaaatggcaaggccacggcgagtgcgccattggatgtatagccctgttatactgaccatcctcgctattggtctggccgaggggtgcgacgaaatggtgcacgctgattctaaacttgtctcctgtagacagggcagtggaaatatgaaggagtgcgtgacgactggcagggccctgttgcccgcagtaaacccagggcaggaggcctgtctccatttcacagctcccggaagccctgactctaagtgcctgaaaatcaaggtgaaacggatcaatttaaagtgtaaaaagtcctcaagttactttgttccagatgcgcgcagcagatgcacctcggtcaggcgttgtcggtgggcaggcgactgccagtccggttgcccgccccacttcacttctaacagcttttcagatgactgggccgggaagatggaccgagctggactgggcttcagtggttgttccgatggctgcgggggagccgcatgtggctgctttaatgccgctccttcttgtattttctggagaaaatgggtggaaaacccacacgggataatctggaaggtgagcccctgcgccgcatgggtcccttccgcggttattgagctaacaatgccatcaggagaagtgaggacctttcatcccatgagcggcatcccgacgcaagtgttcaaaggtgtaagtgtcacctatctcgggtctgacatggaggtgtccggactgacagatctttgtgaaattgaggagttgaaaagcaagaagctggctctcgccccttgcaaccaggcaggcatgggtgttgtgggcaaagtcggggaaatccagtgttcgtcagaggaatctgcccgcactataaagaaggacggatgcatctggaatgctgatctggtgggcattgagcttcgggttgacgatgccgtgtgttacagtaaaatcacctccgtagaagcagtcgctaactatagcgccattccaacaactatcgggggactgagattcgagaggtctcacgacagccagggcaagatatccggttcacccttggatattaccgcgatccgcgggagttttagcgtgaattaccgaggactccggctgtctttatccgagattacagcaacctgcactggcgaagtgacgaacgtctcaggttgctacagttgtatgacaggcgctaaagttagcatcaagctgcattcctctaaaaattcgaccgcacacgtgcgttgcaagggggacgagactgccttcagcgtactagaaggagtgcactcatataccgtctccctcagttttgatcatgctgtggttgacgagcaatgtcagctgaactgcggcgggcacgaatctcaggtgacacttaagggaaatttgatattcctggatgtccctaaatttgtggacggcagctacatgcagacctatcattccactgttcccacaggtgccaacatcccatcacctacggactggctcaatgcactgttcgggaacggattatctagatggattctgggcgtgatcggcgtccttctcgggggattggcgctgtttttcctaattatgtttctgttcaagctcggtaccaaacaagtatttaggagccgcactaagctggcctga

SEQ ID NO: 11569 - RNA, 3222 nt, synthetic construct
  misc_feature 1..3222: note = derived and/or modified CDS sequence (opt3) from SFTSV(HB29)__KP202164.1__GP
  source 1..3222: mol_type = other RNA
atgatgaaggtgatctggttcagctccctgatttgcctcgtcatacagtgttctggcgactcagggcccatcatttgcgccggacctatccacagtaacaaaagcgctggtattccacatcttctgggctactccgagaagatctgtcaaatagatagattgatccacgtttcttcgtggttaaggaatcattcacagtttcaggggtatgtgggacagcggggcggtcgcagccaagtaagttactatccggcagaaaactcctactctcgatggagcgggctgctatccccctgcgacgccgattggctcggaatgctggtggtcaaaaaggcgaaagagtcagacatgattgtgcctggcccaagttataagggcaaggttttctttgaacgtcccaccttcgatgggtacgtgggatggggttgtggcagcgggaaatctagaacagagtccggagaactttgctcaagcgacagtggcacttcttccggtctgttgcctagcgatagggtcctctggatcggggacgtggcttgtcagccaatgacgcccattcctgaggagacctttctggaactgaagtcgttctctcagtccgagtttccagatatctgcaaaatagacggaattgtattcaatcagtgtgaaggcgagtcactcccgcaaccctttgatgttgcctggatggacgtgggccacagtcataagatcattatgcgggagcacaaaacaaagtgggtccaggaaagctcctctaaggatttcgtgtgctataaagaggggactggaccttgtagcgaatcagaggaaaaggcatgcaaaaccagtggttcctgccgcggcgacatgcagttttgtaaggtggccgggtgcgagcacggagaggaagctagcgaggcaaaatgtagatgctctttagtccataagccaggcgaagttgtggtatcatacggtgggatgagggtgcggcccaaatgttacggcttcagtcgcatgatggccacactggaggtcaaccctccagaacagcgaatcggacaatgcaccggctgtcaccttgagtgcatcaatgggggagtgagattgattactctgacaagcgagctaaggtccgctaccgtttgtgcctctcatttttgctcgagcgcgtcctcaggtaagaagagtacggaaatacacttccactctggcagcctcgtggggaaaactgcaatccatgtcaagggagccctggtggacggcaccgagttcacatttgaaggttcctgtatgttccccgatgggtgcgacgctgtagattgcactttttgtcgggagttccttaaaaacccgcagtgctatcctgccaagaaatggctgtttattatcatagttattcacttgggctacgcaggactcatgctgttaaccaatgtgctgaaggctatcggcgtctgggggtcatgggtgatcgcccccgtcaagctcatgttcgcgattatcaaaaagttgatgcgtacagtgagctgtctggttggaaaattgatggaccgcggtagacaggtgattcatgaagagataggcgagaacggggaaggaaatcaagatgacgtaaggatcgagatggcccggccacgacgcgtcagacactggatgtattctcctgtgattctaaccatcctggcaatcggcctcgctgaaggttgcgatgagatggttcatgccgactccaagctggtgagttgtaggcaggggagcggcaacatgaaagagtgcattacgactggacgggcccttctgcccgctgtcaatccaggccaggaagcatgtttgcactttacagcccccgggtctcctgattccaagtgcctcaagataaaagtgaagcgcatcaacctgaaatgtaagaaatcaagtagctacttcgtaccagacgctagatcgaggtgcacctccgtgcgtcggtgtcgatgggcgggagattgccagtctggctgcccgccccactttactagcaattcattcagtgacgactgggcaggtaagatggatagagccgggttaggattttccggctgttctgacggttgcggcggggctgcctgtggatgcttcaacgcagcccctagctgtatcttttggaggaagtgggttgagaatccacatggcattatttggaaagtctccccctgcgctgcctgggtgccttcagcagtgatcgaactgacaatgccaagcggggaggtccgcaccttccaccccatgagtggaataccgacgcaagttttcaagggcgtgtctgtgacctatctaggttccgatatggaagtaagcgggctcacagacctgtgtgagatcgaggaacttaaatcgaagaaattggcgctggctccttgcaaccaggccggaatgggcgtcgtgggtaaggttggcgagattcagtgttcatctgaagagagtgcacggactatcaaaaaggatgggtgcatttggaacgccgacctcgtgggaatcgaactgagagtcgatgacgctgtgtgttactccaagataaccagcgttgaggccgtggcaaattattctgctattccaacaactatcggcgggcttaggtttgagcgcagccatgattcccagggaaaaatttcaggcagtcccctggacatcaccgccatacgaggtagcttctctgtaaactaccgggggttgcgtctctccctgtcagaaatcacagcgacctgcactggagaggtcacgaatgtgagtggctgctacagctgtatgacaggtgccaaggtgtccattaaattacactcttcgaagaacaataccgctcacgtcagatgcaaaggcgatgaaactgcatttagcgttctggagggggtgcattcatatatcgtatccctaagtttcgaccacgccgtggtcgatgaacaatgtcagctcaactgcggaggccatgagtctcaggtgaccctgaaggggaatcttatttttcttgacgttcctaagttcgtggacggaagctacatgcagacatatcactccaccgtccccactggcgctaacatcccatcacctacagattggctgaatgccctctttggtaacgggctgtctaggtggatattaggagtgattggcgttctgcttggcgggttggcactcttctttctgatcatgttcctactgaaactcggaacgaagcaagtgtttcgcagccggaccaaactggcgtga

SEQ ID NO: 11570 - RNA, 3222 nt, synthetic construct
  misc_feature 1..3222: note = derived and/or modified CDS sequence (opt3) from SFTSV(HNXY_115)__KC292312.1__GP
  source 1..3222: mol_type = other RNA
atgatgaaggtgatctggttcagctccctgatttactttgtcatacagtgctctggcgactcagggagtatcatttgtgccggacccatccacagcaacaaatccgctgatattcctcatctccttggttattctgagaagatctgccaaatagacagactgatccacgtttcgtcatggttgaggaatcatagccagttccagggctacgtggggcagcggggaggccgcagtcaagtatcctattacccagcagaaaactcttatagccgatggtccggtttactgtcaccgtgtgatgccgactggctagggatgctcgtggtcaaaaaggcgaaaggaagtgatatgattgtgcccggccctagctacaagggcaaggttttcttcgagcgtccaacctttgacgggtatgtgggatggggttgcggctctgggaaatccagaacagaatcaggagagctgtgtagcagtgattctggcacttccagcggtcttctgccctcggacagggtcttgtggatcggggatgtggcttgccagcctatgacgccaattcccgaagagaccttcctcgagctgaagtctttttcccagtcagaatttcctgacatctgtaaaatagatggaattgtatttaatcagtgcgagggcgaaagtctgccacaaccgttcgacgttgcctggatggatgtgggccacagccataagatcattatgcgggagcacaaaacaaagtgggtccaggagtcctctagcaaggactttgtgtgttacaaagaagggactggaccctgctcagagagtgaagagaagacctgtaaaacatccggtagctgccgcggcgacatgcagttctgcaaggtggcagggtgtgaacacggagaggaggcctctgaagctaaatgcagatgttcactcgtccataagcctggcgaggttgtggtaagttacggtgggatgagggtgcggccaaaatgctatggctttagccgcatgatggcaaccttagaagtcaaccagcccgagcaacgaatcggacagtgtactggctgccacctggaatgtatcaatgggggagtgagacttattacattgacctccgagctgaagtctgccacggtttgcgcttcgcatttctgtagctccgccacttcaggtaagaaaagtaccgagatacagttccactctggcagcctagtggggaagacagcgatccacgtcaaaggagcactcgtggatggcactgaatttaccttcgagggttcctgcatgtttcctgacgggtgtgatgccgtagactgcacattctgcagggaatttctgaagaacccacaatgttaccccgctaaaaagtggcttttcattatcatagttattctgttgggctatgccggactcatgctgttaaccaatgtgctgaaggcaatcggcatctgggggtcatgggtcattgctccggtgaaactcatctttgccattataaagaaacttatgcggacggtcagctgcctgatgggaaagttgatggatcgtggtcgccaggtgatccatgaggaaattggcgagaacagagaggggaatcaggacgatgttaggatcgaaatggcgcggcctcgacgcgtgagacactggatgtactctcccgtaatcctaactattctggccataggactcgcagagtcctgtgacgaaatggtccatgctgatagtaaactggtgagctgcaggcagggctctggtaacatgaaggagtgtgttacaaccgggcgggcccttctgccagctgtgaatcctggccaagaggcctgcttgcacttcactgcacccggatccccagactcaaagtgtctcaaaatcaaggtcaaacgcattaacctgaagtgcaaaaagagtagctcgtattttgtgcccgatgccagatccaggtgtacatctgtacgtcggtgccgatgggctggcgactgtcagagcgggtgccctccacatttcacctcaaatagtttttccgacgattgggcgggaaagatggacagagcaggcttaggtttctctgggtgcagcgatggatgtggcggtgccgcttgcggctgttttaacgccgcaccgtcctgcatcttctggaggaaatgggtggaaaatccccacgggattatctggaaggtttcaccttgtgccgcttgggtcccaagcgccgtgatagagctgacgatgcccagtggagaagtgcgcaccttccaccctatgtctggcatcccaacacaggtctttaaaggggtttccgtgacttacctaggaagcgacatggaggtgtcgggcctcaccgatctgtgcgaaattgaggagcttaagagcaaaaagttggcactggcgccctgtaaccaggctggtatgggggtagtcggaaaagtgggcgaaatccaatgctctagtgaggaatccgcccggacaattaagaaggacggttgtatctggaacgcagatctcgttggcatagagctgagagtggacgatgccgtctgctatagcaaaattacttctgtggaagctgttgccaattacagcgcaatcccgaccacaattgggggacttaggttcgagcgctcccatgactcacagggcaagatcagtgggagccctctggatataaccgctatccgaggatctttttccgtgaactaccggggcttgcgtctctcactgagtgagattactgccacgtgtacaggtgaagtaaccaatgtcagcgggtgctattcctgcatgactggagcgaaagtgtctatcaagttacactcgagcaaaaactcaaccgcccatgtgagatgtaagggcgacgagacagctttctccgtcctggaaggtgttcacagttacaccgtgtctctatcatttgatcacgcagtagtggacgagcagtgccagctcaattgtggcgggcatgaatcccaagtcactctgaagggaaaccttattttcttggacgtgccaaaatttgttgatggctcatatatgcagacataccactctacggtgcccaccggggccaatatccctagccccactgactggctgaacgctctcttcggaaatggcctgagtaggtggatattaggtgtcattggggtgctgcttggaggcttggccctctttttcatgatcatgtccctgtttaagctaggcacaaaacaggttttccgcagccggaccaagctggcatga

SEQ ID NO: 11571 - RNA, 3222 nt, synthetic construct
  misc_feature 1..3222: note = derived and/or modified CDS sequence (opt3) from SFTSV(HNXY_144)__KC292307.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaaccagcctgagcaacgaatcggacagtgcactggctgtcacctggaatgcatcaatgggggagtgagacttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggatggcactgaatttaccttcgagggtagctgtatgtttccagacgggtgcgatgccgtagactgcacattctgtagggaatttctgaagaacccccaatgctatccggctaaaaagtggcttttcattatcatagttattctgttgggctacgccggactcatgctgttaaccaatgtgctgaaggcaatcggcatctgggggtcctgggtcattgctcctgtgaaactcatctttgccattataaagaaacttatgcggacggtctcatgtctgatgggaaagttgatggatcgtggtcgccaggtgatccatgaggaaattggcgagaacagagaggggaatcaggacgatgttaggatcgaaatggcgcggccccgacgcgtgagacactggatgtatagcccagtaatcctaactattctggccataggactcgcagagtcttgcgacgaaatggtccatgctgattccaaactggtgagttgtaggcagggcagcggtaacatgaaggagtgcgttacaaccgggcgggcccttctgcctgctgtgaatcccggccaagaggcctgtttgcacttcactgcaccaggatctcccgactccaagtgcctcaaaatcaaggtcaaacgcattaacctgaagtgtaaaaagtcaagtagctactttgtgcctgatgccagatcgaggtgcacatccgtacgtcggtgtcgatgggctggcgactgccagtctgggtgcccaccgcatttcaccagcaattcatttagtgacgattgggcgggaaagatggacagagcaggcttaggtttctccgggtgttctgatggatgcggcggtgccgcttgtggctgctttaacgccgcacccagctgtatcttctggaggaaatgggtggaaaatcctcacgggattatctggaaggtttccccatgcgccgcttgggtcccctcagccgtgatagagctgacgatgcctagcggagaagtgcgcaccttccacccaatgagtggcatccccacacaggtctttaaaggggtttctgtgacttatctaggatccgacatggaggtgagcggcctcaccgatctgtgtgaaattgaggagcttaagtcgaaaaagttggcactggcgccgtgcaaccaggctggtatgggggtagtcggaaaagtgggcgaaatccaatgttcatctgaggaaagtgcccggacaattaagaaggacggttgcatctggaacgcagatctcgttggcatagagctgagagtggacgatgccgtctgttactccaaaattactagcgtggaagctgttgccaattattctgcaatccctaccacaattgggggacttaggttcgagcgcagccatgactcccagggcaagatctcagggagtccactggatataaccgctatccgaggcagcttttctgtgaactaccggggattgcgtctctccctgtcagagattactgccacgtgcacaggtgaagtaaccaatgtcagtgggtgctacagctgtatgactggagcgaaagtgtccatcaagttacactcttcgaaaaacagcaccgcccatgtgagatgcaagggcgacgagacagctttctcagtcctggaaggtgttcactcctataccgtgagtctatcttttgatcacgcagtagtggacgagcagtgtcagctcaattgcggcgggcatgaaagccaagtcactctgaagggaaaccttattttcttggacgtgcccaaatttgttgatggctcctacatgcagacatatcactcaacggtgcctaccggggccaatatcccctctccaactgactggctgaacgctctcttcggaaatggcctgagtaggtggatattaggtgtcatgggggtgctgcttggaggcttggccctctttttcatgattatgagcctgtttaagctaggcacaaaacaggttttccgctcccggaccaagctggcatga

SEQ ID NO: 11572 - RNA, 3222 nt, synthetic construct
  misc_feature 1..3222: note = derived and/or modified CDS sequence (opt3) from SFTSV(HNXY_157)__KC292305.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcaatagggtcttgtggatcggggacgtggcttgtcagccaatgacgcccattcctgaagagaccttcctcgagctgaagtcgttttctcagtccgaatttccagatatctgcaaaatagacggaattgtatttaaccagtgtgagggcgaatcactgccgcaacccttcgatgttgcctggatggacgtgggccacagtcataagatcattatgcgggagcacaaaacaaagtgggtccaggagagctcctctaaggattttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaatcagcctgagcaacgaatcggacagtgcactggctgtcacctggaatgcatcaacgggggagtgagacttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggacggcactgaatttaccttcgagggtagctgtatgtttccagatgggtgcgacgccgtagattgcacattctgtagggaatttctgaagaatccccaatgctatccggctaaaaagtggcttttcattatcatagttattctgttgggctacgccggactcatgctgttaaccaacgtgctgaaggcaatcggcatctgggggtcctgggtcattgctcctgtgaaactcatctttgccattataaagaaacttatgcggacggtctcatgtctgatgggaaagttgatggaccgtggtcgccaggtgatccatgaggaaattggcgagaatagagaggggaaccaggatgacgttaggatcgaaatggcgcggccccgacgcgtgagacactggatgtatagcccagtaatcctaactattctggccataggactcgcagagtcttgcgatgaaatggtccatgctgactccaaactggtgagttgtaggcagggcagcggtaatatgaaggagtgcgttacaaccgggcgggcccttctgcctgctgtgaaccccggccaagaggcctgtttgcacttcactgcaccaggatctcccgattccaagtgcctccgcatcaaagtcaagagaattaatctgaaatgtaagaaatcaagtagctactttgtgcctgacgccaggtcgcgttgcacatccgtacggcgatgtagatgggctggcgattgccagtctgggtgcccaccgcatttcaccagcaactcatttagtgacgactgggcgggaaagatggatagggcaggcttaggtttctccgggtgttctgacggatgcggcggtgccgcttgtggctgctttaatgccgcacccagctgtatcttctggcgcaagtgggtggaaaaccctcacgggattatctggaaagtttccccatgcgccgcttgggtcccctcagccgtgatagagctgacgatgcctagcggagaagtgcggaccttccacccaatgagtggcatccccacacaggtctttaagggggtttctgtgacttatctaggatccgatatggaggtgagcggcctcaccgacctgtgtgaaattgaggagcttaaatcgaagaaattggcactggcgccgtgcaaccaggctggtatgggggtagtcggaaaggtgggcgaaatccaatgttcatctgaggaaagtgccagaacaattaaaaaggatggttgcatctggaatgcagacctcgttggcatagagctgagggtggatgacgccgtctgttactccaagattactagcgtggaagctgttgccaactattctgcaatccctaccacaattgggggacttcgcttcgagcgaagccatgattcccagggcaaaatctcagggagtccactggacataaccgctatccggggcagcttttctgtgaattaccgtggattgagactctccctgtcagagattactgccacgtgcacaggtgaagtaaccaacgtcagtgggtgctacagctgtatgactggagcgaaggtgtccatcaaattacactcttcgaagaatagcaccgcccatgtgaggtgcaaaggcgatgagacagctttctcagtcctggaaggtgttcactcctataccgtgagtctatcttttgaccacgcagtagtggatgagcagtgtcagctcaactgcggcgggcatgaaagccaagtcactctgaagggaaatcttattttcttggacgtgcccaagtttgttgacggctcctacatgcagacatatcactcaacggtgcctaccggggccaacatcccctctccaactgattggctgaatgctctcttcggaaacggcctgagccgctgggtcttaggtgtgatgggggttctgcttggaggcttggccctctttttcatgataatgagtctgtttaaactaggcacaaaacaggtgttccggtccagaaccaagctggcatga

SEQ ID NO: 11573 - RNA, 3222 nt, synthetic construct
  misc_feature 1..3222: note = derived and/or modified CDS sequence (opt3) from SFTSV(HNXY_170)__KC292304.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcaatagggtcttgtggatcggggacgtggcttgtcagccaatgacgcccattcctgaagagaccttcctcgagctgaagtcgttttctcagtccgaatttccagatatctgcaaaatagacggaattgtatttaaccagtgtgagggcgaatcactgccgcaacccttcgatgttgcctggatggacgtgggccacagtcataagatcattatgcgggagcacaaaacaaagtgggtccaggagagctcctctaaggattttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaatcagcctgagcaacgaatcggacagtgcactggctgtcacctggaatgcatcaacgggggagtgagacttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggacggcactgaatttaccttcgagggtagctgtatgtttccagatgggtgcgacgccgtagattgcacattctgtagggaatttctgaagaatccccaatgctatccggctaaaaagtggcttttcattatcatagttattctgttgggctacgccggactcatgctgttaaccaacgtgctgaaggcaatcggcatctgggggtcctgggtcattgctcctgtgaaactcatctttgccattataaagaaacttatgcggacggtctcatgtctgatgggaaagttgatggaccgtggtcgccaggtgatccatgaggaaattggcgagaatagagaggggaaccaggatgacgttaggatcgaaatggcgcggccccgacgcgtgagacactggatgtatagcccagtaatcctaactattctggccataggactcgcagagtcttgcgatgaaatggtccatgctgactccaaactggtgagttgtaggcagggcagcggtaatatgaaggagtgcgttacaaccgggcgggcccttctgcctgctgtgaaccccggccaagaggcctgtttgcacttcactgcaccaggatctcccgattccaagtgcctccgcatcaaagtcaagagaattaatctgaaatgtaagaaatcaagtagctactttgtgcctgacgccaggtcgcgttgcacatccgtacggcgatgtagatgggctggcgattgccagtctgggtgcccaccgcatttcaccagcaactcatttagtgacgactgggcgggaaagatggatagggcaggcttaggtttctccgggtgttctgacggatgcggcggtgccgcttgtggctgctttaatgccgcacccagctgtatcttctggcgcaagtgggtggaaaaccctcacgggattatctggaaagtttccccatgcgccgcttgggtcccctcagccgtgatagagctgacgatgcctagcggagaagtgcggaccttccacccaatgagtggcatccccacacaggtctttaagggggtttctgtgacttatctaggatccgatatggaggtgagcggcctcaccgacctgtgtgaaattgaggagcttaaatcgaagaaattggcactggcgccgtgcaaccaggctggtatgggggtagtcggaaaggtgggcgaaatccaatgttcatctgaggaaagtgccagaacaattaaaaaggatggttgcatctggaatgcagacctcgttggcatagagctgagggtggatgacgccgtctgttactccaagattactagcgtggaagctgttgccaactattctgcaatccctaccacaattgggggacttcgcttcgagcgaagccatgattcccagggcaaaatctcagggagtccactggacataaccgctatccggggcagcttttctgtgaattaccgtggattgagactctccctgtcagagattactgccacgtgcacaggtgaagtaaccaacgtcagtgggtgctacagctgtatgactggagcgaaggtgtccatcaaattacactcttcgaagaatagcaccgcccatgtgaggtgcaaaggcgatgagacagctttctcagtcctggaaggtgttcactcctataccgtgagtctatcttttgaccacgcagtagtggatgagcagtgtcagctcaactgcggcgggcatgaaagccaaattactctgaagggaaatcttatcttcttggacgtccccaagtttgtggacggctcctacatgcagacatatcactcaacggttcctaccggggccaacataccctctccaactgattggctgaatgctctcttcggaaacggcctgagccgctgggtgttaggtgtcattggggtgctgcttggaggcttggccctctttttcatgatcatgagtctgtttaaactaggcacaaagcaggttttccggtccagaaccaaactggcatga

SEQ ID NO: 11574 - RNA, 3222 nt, synthetic construct
  misc_feature 1..3222: note = derived and/or modified CDS sequence (opt3) from SFTSV(HNXY_174)__KC292306.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgccggatagatggaattgtatttaatcagtgtgagggcgaatcactgccgcaacccttcgacgttgcctggatggatgtgggccacagtcataaaatcattatgcgcgagcacaagacaaaatgggtccaggagagctcctctaaggactttgtgtgctataaggaagggactggaccttgtagcgagtcagaagagaaaacctgcaagacaagtggttcctgcagaggcgacatgcagttctgtaaagtggcagggtgcgaacacggagaggaggccagcgaagctaagtgtaggtgctctctcgtccataaaccaggcgaggttgtggtatcatacggtgggatgcgggtgcgccccaagtgttacggctttagtcgaatgatggcaaccttagaagtcaaccagcctgagcaaagaatcggacagtgcactggctgtcacctggaatgcatcaatgggggagtgaggcttattacattgaccagcgagctgaaatccgccacggtttgtgcttctcatttctgctcgagcgccacttccggtaagaagtcaaccgagatacagttccacagtggctctctagtggggaaaacagcgatccacgtcaagggagcactcgtggatggcactgaatttaccttcgagggtagctgtatgtttccagacgggtgcgatgccgtagactgcacattctgtcgggaatttctgaaaaacccccaatgctatccggctaagaaatggcttttcattatcatagttattctgttgggctacgccggactcatgctgttaaccaatgtgctgaaggcaatcggcatctgggggtcctgggtcattgctcctgtgaagctcatctttgccattataaagaaacttatgcgtacggtctcatgtctgatgggaaaattgatggatcgcggtagacaggtgatccatgaggaaattggcgagaacagggaggggaatcaggacgatgttcggatcgaaatggcgcgaccccgcagagtgaggcactggatgtatagcccagtaatcctaactattctggccataggactcgcagagtcttgcgacgaaatggtccatgctgattccaagctggtgagttgtcggcagggcagcggtaacatgaaagagtgcgttacaaccgggcgcgcccttctgcctgctgtgaatcccggccaagaggcctgtttgcacttcactgcaccaggatctcccgactccaagtgcctcagaatcaaggtcaaaaggattaacctgaagtgtaaaaagtcaagtagctactttgtgcctgatgcccgttcgcggtgcacatccgtacgaagatgtaggtgggctggcgactgccagtctgggtgcccaccgcatttcaccagcaattcatttagtgacgattgggcgggaaaaatggaccgcgcaggcttaggtttctccgggtgttctgatggatgcggcggtgccgcttgtggctgctttaacgccgcacccagctgtatcttctggcggaagtgggtggaaaatcctcacgggattatctggaaggtttccccatgcgccgcttgggtcccctcagccgtgatagagctgacgatgcctagcggagaagtgagaaccttccacccaatgagtggcatccccacacaggtctttaaaggggtttctgtgacttatctaggatccgacatggaggtgagcggcctcaccgatctgtgtgaaattgaggagcttaagtcgaaaaagttggcactggcgccgtgcaaccaggctggtatgggggtagtcggaaaagtgggcgaaatccaatgttcatctgaggaaagtgccaggacaattaagaaagacggttgcatctggaacgcagatctcgttggcatagagctgcgcgtggacgatgccgtctgttactccaagattactagcgtggaagctgttgccaattattctgcaatccctaccacaattgggggacttcgattcgagcggagccatgactcccagggcaagatctcagggagtccactggatataaccgctatccgtggcagcttttctgtgaactacagaggattgaggctctccctgtcagagattactgccacgtgcacaggtgaagtaaccaatgtcagtgggtgctacagctgtatgactggagcgaaagtgtccatcaagttacactcttcgaaaaacagcaccgcccatgtgcgctgcaagggcgacgagacagctttctcagtcctggaaggtgttcactcctataccgtgagtctatcttttgatcacgcagtagtggacgagcagtgtcagctcaattgcggcgggcatgaaagccaagtcactctgaaaggaaaccttattttcttggacgtgcccaagtttgttgatggctcctacatgcagacatatcactcaacggtgcctaccggggccaatatcccctctccaactgactggctgaacgctctcttcggaaatggcatgagccggtggatactgggtgtcatgggggtgttactgggaggccttgccttgtttttcatgattatgagtctctttaagctgggcacaaaacaggttttcagatccaggaccaagctagcatga

SEQ ID NO: 11575 - RNA, 3222 nt, synthetic construct
  misc_feature 1..3222: note = derived and/or modified CDS sequence (opt3) from SFTSV(HNXY_182)__KC292324.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccaaggttactccgagaagatctgtcagatagacagacttatccacgtttcttcgtggctgaggaatcattcacagttccagggctatgtggggcaacggggaggccgcagccaggtaagttactatccggcagaaaactcctactctcgatggagcggtttgttatccccctgcgatgccgactggctggggatgctagtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctctgctcaagcgatagtggcacttcttccggtctgcttcctagcgacagggtcctgtggatcggggatgtggcttgtcagccaatgacgcccattcctgaagagaccttcttggagctcaagtcgttttctcagtccgaatttccagacatctgcaaaatagatggaattgtatttaatcaatgtgagggcgaatcactgccgcagcccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctggtccataagccaggcgaggttgtggtatcatacggtgggatgagggtgcggcccaaatgttacggctttagtcgcatgatggcaaccctcgaagtcaaccaacctgagcagcgaatcggacagtgcactggctgtcacttagaatgcatcaatgggggagtgagactgattacacttaccagcgagttgaagtccgccacggtttgtgcttctcatttctgctcgagcgccacttccggtaagaaatcaaccgagatacaattccacagtggctctctggtggggaagacagcgatccacgtcaaaggagcacttgtggatggcactgaatttaccttcgagggtagctgtatgtttccagacgggtgcgatgccgtagactgcacattctgtagggaatttctcaagaacccccagtgctatccggctaaaaagtggctgttcattatcatagttattcttctgggctacgccggattgatgctcctgaccaatgtgttaaaggcaatcggcatctgggggtcctgggtcattgctcctgtgaaactgatctttgccattataaagaaactcatgcggacggtctcatgtcttatgggaaagctgatggatcgtggtcgccaggtgatccatgaggaaattggcgagaacagagaggggaatcaggacgatgttaggatcgaaatggcgcggccccgacgcgtgagacactggatgtatagcccagtaatcttgactattctagccataggactggcagagtcttgcgacgaaatggtccatgctgattccaaactcgtgagttgtaggcaaggcagcggtaacatgaaggagtgcgttacaaccgggcgggccctgcttcctgctgtgaatcccggccaggaggcctgtctgcacttcactgcaccaggatctcccgactccaagtgcttgaaaatcaaggtcaaacgcattaacctcaagtgtaaaaagtcaagtagctactttgtgcctgatgccagatcgaggtgcacatccgtacgtcggtgtcgatgggctggcgactgccagtctgggtgcccaccgcatttcaccagcaattcatttagtgacgattgggcgggaaagatggacagagcaggcctgggtttctccgggtgttctgatggatgcggcggtgccgcttgtggctgctttaacgccgcacccagctgtatcttctggaggaaatgggtggaaaatcctcacgggattatctggaaggtttccccatgcgccgcttgggtcccctcagccgtgatagagttaacgatgcctagcggagaagtgcgcaccttccacccaatgagtggcatccccacacaggtctttaaaggggtttctgtgacttatctgggatccgacatggaggtgagcggcctaaccgatctctgtgaaattgaggagctgaagtcgaaaaagctagcattggcgccgtgcaaccaagctggtatgggggtagtcggaaaagtgggcgaaatccagtgttcatctgaggaaagtgcccggacaattaagaaggacggttgcatctggaacgcagatctggttggcatagagctcagagtggacgatgccgtctgttactccaaaattactagcgtggaagctgttgccaattattctgcaatccctaccacaattgggggactgaggttcgagcgcagccatgactcccagggcaagatctcagggagtccacttgatataaccgctatccgaggcagcttttctgtgaactaccggggactgcgtttgtccctctcagagattactgccacgtgcacaggtgaagtaaccaatgtcagtgggtgctacagctgtatgactggagcgaaagtgtccatcaagctgcactcttcgaaaaacagcaccgcccatgtgagatgcaagggcgacgagacagctttctcagtcttagaaggtgttcactcctataccgtgagtctgtcttttgatcacgcagtagtggacgagcagtgtcaactaaattgcggcgggcatgaaagccaggtcactctcaagggaaacctgattttccttgacgtgcccaaatttgttgatggctcctacatgcagacatatcactcaacggtgcctaccggggccaatatcccctctccaactgactggttgaacgctctgttcggaaatggcctcagtaggtggatactgggtttaattggggtcctgcttggaggcttggccctctttttcatgatcatgagcctgtttaagctaggcacaaaacaggtgttccgctcccggaccaagctggcatga

SEQ ID NO: 11576 - RNA, 3222 nt, synthetic construct
  misc_feature 1..3222: note = derived and/or modified CDS sequence (opt3) from SFTSV(HNXY_188)__KC292301.1__GP
  source 1..3222: mol_type = other RNA
atgatgaaggtgatctggttcagctccctgatttgcctcgtcatacagtgtggcgggggaaccggtcccatcatttgcgccggccctatccactctaacaaatcagctgacattccacatcttctggggtacagtgagaagatctgtcaaatagatagattgatccacgttagctcctggttaaggaatcattctcagtttcagggatatgtgggccagcggggtgggcgctcgcaagtatcatactatccggcagaaaacagctacagtcgatggtccggactgctatctccctgcgacgccgattggctcggcatgctggtggtcaaaaaggcgaaaggcagcgacatgattgtgcctgggccatcctataagggaaaggttttctttgagcgtcccacattcgatggttacgtgggctgggggtgtggatcaggcaaaagtagaactgaaagcggtgagctttgcagttccgactcagggacgagcagtggactgttgccttctgatagggtcctctggatcggcgacgtggcttgtcagccaatgacccccattcctgaagagacatttctggagctgaagtccttcagccagtcggaatttccagatatctgcaaaatagacggcattgtattcaatcagtgtgagggggaatctctcccgcaaccctttgatgttgcctggatggacgtgggacactcccataagatcattatgcgggagcacaaaactaagtgggtccaggagtcaagtagcaaggatttcgtgtgctataaagaaggtaccggcccttgttccgagtctgaagagaagacatgcaaaaccagcgggtcatgccgcggagacatgcagttttgtaaggtggcaggctgcgaacacggtgaggaggccagtgaagctaaatgtagatgctccttagtccataagccaggggaggttgtggtaagctacggcggaatgagggtgcggcccaaatgttacggcttctctcgcatgatggcaactctggaagtctcacagcctgagcaacgaatcgggcagtgcacaggatgtcaccttgaatgcatcaacggtggcgtgagattgattaccctgacgagtgagctaaagagcgccactgtttgtgcttcccatttttgttcttcggccaccagcgggaagaaatccacagagatacagttccactcaggaagtctcgtgggcaagactgcgatccacgtcaaaggtgcactggtggacgggaccgagttcacatttgaaggctcttgcatgttcccagatggatgcgacgccgtagattgcaccttttgtagggagttccttaagaatccccaatgctatccggctaaaaagtggctgtttattatcatagttattttgctcggctacgccgggctgatgttactgacgaacgtgctcaaggcaatcggagtctggggtagctgggtgatcgctcctgtcaaacttgtgttcgccattatcaagaaactgatgcgggcggtttcctgtttgatgggcaagctaatggaccgtgggcgccaggtgattcatgaagaaataggagagaatagagagggcaaccaggatgacgtaaggatcgaaatggcccggccccgacgcgtcagacactggatgtattcaccagtgattctgactatcctcgcaatcggtctggctgaggggtgcgatgaaatggttcatgccgacagcaaacttgtgtcttgtaggcagggctccggaaatatgaaggagtgcgtcacaaccggccgggctctgttgcctgccgtgaaccccgggcaagaggcatgtctccactttactgccccaggaagtcccgatagcaagtgcctgaaaattaaggtaaaacgcataaatttaaagtgtaaaaagtcttcctcatacttcgtgcctgacgctagaagtaggtgcacaagcgttcgtcggtgtcgatgggcgggcgattgccagtcgggttgcccaccgcattttacctccaactctttcagcgacgactgggcagggaagatggatagagccggactgggcttttcaggttgtagtgacggctgcgggggagctgcctgtggctgcttcaatgcagccccctcctgtatcttttggaggaaatgggtcgaaaaccctcacgggattatctggaaggtgtctccatgcgctgcctgggtgcccagcgcagtcattgagctaacgatgccttccggagaagttcgcaccttccacccaatgtcaggcatccccacacaggtgttcaaaggtgtgagcgtaacttatctcgggagtgatatggaggtctctggactgaccgacctttgtgaaatagaggagttgaagtccaaaaagctggcgctcgctccgtgcaatcaggccggcatgggtgtggttggcaaagtgggggaaatccaatgtagctcggaggaatcagcacggacaattaagaaggatggatgcatctggaacgccgacctggtcggcattgagcttagagtggatgacgctgtttgttactctaaaatcacttctgtggaagccgtagcaaactattccgctatacctaccacaattgggggactgaggtttgagcgcagccatgattctcagggcaagatcagcggttccccattggacattaccgccatccgagggtcattcagtgtcaattaccggggactccgtctgagcttatctgagataactgcgacgtgcacaggcgaagtgaccaacgtgtccggttgctactcatgtatgactggcgccaaagtcagtatcaagctgcacagctccaaaaattctaccgctcatgttagatgcaagggggatgagacagcattttcggtgctagaaggagtacacagctattcagtgtccctcagtttcgaccacgccgtcgtggatgagcagtgtcagctgaactgcggcgggcatgaatctcaagttacccttaggggaaatttgatttttctggacgtgcccaagttcgtcgacggcagctacatgcagacttatcactccacagtgcctacgggtgctaacatcccctcaccaaccgattggctcaatgccctgtttgggaacggattatctcgctggattctgggcgttatcggcgtgcttctcgggggattggcactgttctttctaataatgagcctgttcaaactcggtactaagcagatttttcggagtagaacaaaactggcgtga

SEQ ID NO: 11577 - RNA, 3222 nt, synthetic construct
  misc_feature 1..3222: note = derived and/or modified CDS sequence (opt3) from SFTSV(HNXY_191)__KC292323.1__GP
  source 1..3222: mol_type = other RNA
atgatgaaggtgatctggttcagctccctgatttgcctcgtcatacagtgtggcggggacaccggacccatcatttgcgccggtcctacacactctaacaaatcagctgatatcccacatcttctgggctacagtgagaagatttgtcaaatcgacagattgatacacgttagctcctggttaaggaatcattctcagtttcaggggtatgtgggacagcggggcggtcgctcgcaagtatcatactatccggcagaaaacagctacagtcgatggtccgggctgctatctccctgcgatgccgactggctcggaatgctggtggtcaaaaaggcgaaaggcagcgatatgatcgtgcctggcccatcctataaggggaaggttttctttgagcgtcccactttcgacggatacgtgggttggggctgtgggtcaggaaaaagtagaacggaaagcggcgagctttgcagttccgattcaggtaccagcagtgggctgttgccttctgacagggtcctctggattggagatgtggcttgtcagccaatgacacccatccctgaagagacttttctggagctgaagtccttcagccagtcggaatttccagacatttgcaaaatcgatggcatagtattcaatcagtgtgagggcgaatctctcccgcaaccctttgacgttgcctggatggatgtggggcactcccataagattatcatgcgggagcacaaaaccaagtgggtccaggagtcaagtagcaaggacttcgtgtgctataaagaaggaacaggtccttgttccgagtctgaagagaagacctgcaaaactagcggctcatgccgcggggacatgcagttttgtaaggtggcaggatgcgaacacggcgaggaggccagtgaagctaaatgtagatgctccttagtccataagccaggtgaggttgtggtaagctacgggggcatgagggtgcggcccaaatgttacggattctctcgcatgatggcaacactggaagtctcacagcctgagcaacgaattggccagtgcaccgggtgtcaccttgaatgcatcaacggaggtgtgagattgatcacgctgacttctgagctaaagagcgccaccgtttgtgcttcccatttttgttcttcggccacaagcggcaagaaatccactgagattcagttccactcagggagtctcgtgggaaagaccgcgatacacgtcaaaggcgcactggtggatggtacagagttcacctttgaagggtcttgcatgttcccagacggctgcgatgccgtagactgcacgttttgtagggagttccttaagaatccccaatgctatccggctaaaaagtggctgtttatcattatcgttatattgctcggatacgccggcctgatgttactgactaacgtgctcaaggcaattggggtctggggaagctgggtgatcgctcctgtcaaacttgtgttcgccatcattaagaaactgatgcgggcggtttcctgtttgatgggtaagctaatggatcgtggccgccaggtgatccatgaagaaattggggagaatagagagggaaaccaggacgatgtaaggatagaaatggcccggccccgacgcgtcagacactggatgtattcaccagtgatcctgacaattctcgcaatcggcctggctgagggttgcgacgaaatggttcatgccgatagcaaacttgtgtcttgtaggcaggggtccggcaatatgaaggagtgcgtcaccactggacgggctctgttgcctgccgtgaaccccggccaagaggcatgtctccactttacagccccagggagtcccgacagcaagtgcctgaaaatcaaggtaaaacgcattaatttaaagtgtaaaaagtcttcctcatacttcgtgcctgatgctagaagtaggtgcaccagcgttcgtcggtgtcgatgggcgggagactgccagtcgggctgcccaccgcattttacgtccaactctttcagcgacgattgggcaggtaagatggacagagccgggctgggattttcaggctgtagtgatggttgcggcggggctgcctgtggatgcttcaatgcagccccctcctgtatattttggaggaaatgggtcgaaaaccctcacggcatcatttggaaggtgtctccatgcgctgcctgggtgcccagcgcagtcatcgagctaaccatgccttccggggaagttcgcacattccacccaatgtcaggcattcccactcaggtgttcaaaggagtgagcgtaacctatctcggtagtgacatggaggtctctgggctgacagatctttgtgaaatcgaggagttgaagtccaaaaagctggcgctcgctccgtgcaatcaggccggaatgggcgtggttggtaaagtgggcgaaatacaatgtagctcggaggaatcagcacggactatcaagaaggacgggtgcatttggaacgccgatctggtcggaatcgagcttagagtggacgatgctgtttgttactctaaaattaccagtgtggaagccgtagcaaactattccgctatccctacaaccataggcgggctgaggtttgagcgcagccatgactctcagggaaagattagcggctccccattggatatcactgccattcgaggttcattcagtgtcaattaccgggggctccgtctgagcttatctgagatcacggcgacatgcaccggagaagtgactaacgtgtccggctgctactcatgtatgaccggtgccaaagtcagtataaagctgcacagctccaaaaattctacagctcatgttagatgcaagggcgacgagaccgcattttcggtgctagaaggggtacacagctattcagtgtccctcagtttcgatcacgccgtcgtggacgagcagtgtcagctgaactgcggaggccatgaatctcaagttactcttagggggaatttgatctttctggacgtgcccaagttcgtcgatggaagctacatgcagacatatcactccacggtgcctaccggcgctaacattccctcaccaactgactggctcaatgccctgtttggtaacgggttatctcgctggatcctgggagttattggcgtgcttttgggcgggctcgcactgttctttctaatcatgagcctgttcaaactcggaacaaagcagatatttcggagtagaaccaaactggcgtga

SEQ ID NO: 11578 - RNA, 3222 nt, synthetic construct
  misc_feature 1..3222: note = derived and/or modified CDS sequence (opt3) from SFTSV(HNXY_195)__KC292326.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccaaggttactccgagaagatctgtcagatagacagacttatccacgtttcttcgtggctgaggaatcattcacagttccagggctatgtggggcaacggggaggccgcagccaggtaagttactatccggcagaaaactcctactctcgatggagcggtttgttatccccctgcgatgccgactggctggggatgctagtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctctgctcaagcgatagtggcacttcttccggtctgcttcctagcgacagggtcctgtggatcggggatgtggcttgtcagccaatgacgcccattcctgaagagaccttcttggagctcaagtcgttttctcagtccgaatttccagacatctgcaaaatagatggaattgtatttaatcaatgtgagggcgaatcactgccgcagcccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctggtccataagccaggcgaggttgtggtatcatacggtgggatgagggtgcggcccaaatgttacggctttagtcgcatgatggcaaccctcgaagtcaaccaacctgagcagcgaatcggacagtgcactggctgtcacttagaatgcatcaatgggggagtgagactgattacacttaccagcgagttgaagtccgccacggtttgtgcttctcatttctgctcgagcgccacttccggtaagaaatcaaccgagatacaattccacagtggctctctggtggggaagacagcgatccacgtcaaaggagcacttgtggatggcactgaatttaccttcgagggtagctgtatgtttccagacgggtgcgatgccgtagactgcacattctgtagggaatttctcaagaacccccagtgctatccggctaaaaagtggctgttcattatcatagttattcttctgggctacgccggattgatgctcctgaccaatgtgttaaaggcaatcggcatctgggggtcctgggtcattgctcctgtgaaactgatctttgccattataaagaaactcatgcggacggtctcatgtcttatgggaaagctgatggatcgtggtcgccaggtgatccatgaggaaattggcgagaacagagaggggaatcaggacgatgttaggatcgaaatggcgcggccccgacgcgtgagacactggatgtatagcccagtaatcttgactattctagccataggactggcagagtcttgcgacgaaatggtccatgctgattccaaactcgtgagttgtaggcaaggcagcggtaacatgaaggagtgcgttacaaccgggcgggccctgcttcctgctgtgaatcccggccaggaggcctgtctgcacttcactgcaccaggatctcccgactccaagtgcttgaaaatcaaggtcaaacgcattaacctcaagtgtaaaaagtcaagtagctactttgtgcctgatgccagatcgaggtgcacatccgtacgtcggtgtcgatgggctggcgactgccagtctgggtgcccaccgcatttcaccagcaattcatttagtgacgattgggcgggaaagatggacagagcaggcctgggtttctccgggtgttctgatggatgcggcggtgccgcttgtggctgctttaacgccgcacccagctgtatcttctggaggaaatgggtggaaaatcctcacgggattatctggaaggtttccccatgcgccgcttgggtcccctcagccgtgatagagttaacgatgcctagcggagaagtgcgcaccttccacccaatgagtggcatccccacacaggtctttaaaggggtttctgtgacttatctgggatccgacatggaggtgagcggcctaaccgatctctgtgaaattgaggagctgaagtcgaaaaagctagcattggcgccgtgcaaccaagctggtatgggggtagtcggaaaagtgggcgaaatccagtgttcatctgaggaaagtgcccggacaattaagaaggacggttgcatctggaacgcagatctggttggcatagagctcagagtggacgatgccgtctgttactccaaaattactagcgtggaagctgttgccaattattctgcaatccctaccacaattgggggactgaggttcgagcgcagccatgactcccagggcaagatctcagggagtccacttgatataaccgctatccgaggcagcttttctgtgaactaccggggactgcgtttgtccctctcagagattactgccacgtgcacaggtgaagtaaccaatgtcagtgggtgctacagctgtatgactggagcgaaagtgtccatcaagctgcactcttcgaaaaacagcaccgcccatgtgagatgcaagggcgacgagacagctttctcagtcttagaaggtgttcactcctataccgtgagtctgtcttttgatcacgcagtagtggacgagcagtgtcaactaaattgcggcgggcatgaaagccaggtcactctcaagggaaacctgattttccttgacgtgcccaaatttgttgatggctcctacatgcagacatatcactcaacggtgcctaccggggccaatatcccctctccaactgactggttgaacgctctgttcggaaatggcctcagtaggtggatactgggtgtcattggggtgttactgggaggccttgccttgtttttcatgatcatgagcctctttaagctgggcacaaaacaggttttccgctcccggaccaagctagcatga

SEQ ID NO: 11579 - RNA, 3222 nt, synthetic construct
  misc_feature 1..3222: note = derived and/or modified CDS sequence (opt3) from SFTSV(HNXY_2)__KC292318.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaaccagcctgagcaacgaatcggacagtgcactggctgtcacctggaatgcatcaatgggggagtgagacttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggatggcactgaatttaccttcgagggtagctgtatgtttccagacgggtgcgatgccgtagactgcacattctgtagggaatttctgaagaacccccaatgctatccggctaaaaagtggcttttcattatcatagttattctgttgggctacgccggactcatgctgttaaccaatgtgctgaaggcaatcggcatctgggggtcctgggtcattgctcctgtgaaactcatctttgccattataaagaaacttatgcggacggtctcatgtctgatgggaaagttgatggatcgtggtcgccaggtgatccatgaggaaattggcgagaacagagaggggaatcaggacgatgttaggatcgaaatggcgcggccccgacgcgtgagacactggatgtatagcccagtaatcctaactattctggccataggactcgcagagtcttgcgacgaaatggtccatgctgattccaaactggtgagttgtaggcagggcagcggtaacatgaaggagtgcgttacaaccgggcgggcccttctgcctgctgtgaatcccggccaagaggcctgtttgcacttcactgcaccaggatctcccgactccaagtgcctcaaaatcaaggtcaaacgcattaacctgaagtgtaaaaagtcaagtagctactttgtgcctgatgccagatcgaggtgcacatccgtacgtcggtgtcgatgggctggcgactgccagtctgggtgcccaccgcatttcaccagcaattcatttagtgacgattgggcgggaaagatggacagagcaggcttaggtttctccgggtgttctgatggatgcggcggtgccgcttgtggctgctttaacgccgcacccagctgtatcttctggaggaaatgggtggaaaatcctcacgggattatctggaaggtttccccatgcgccgcttgggtcccctcagccgtgatagagctgacgatgcctagcggagaagtgcgcaccttccacccaatgagtggcatccccacacaggtctttaaaggggtttctgtgacttatctaggatccgacatggaggtgagcggcctcaccgatctgtgtgaaattgaggagcttaagtcgaaaaagttggcactggcgccgtgcaaccaggctggtatgggggtagtcggaaaagtgggcgaaatccaatgttcatctgaggaaagtgcccggacaattaagaaggacggttgcatctggaacgcagatctcgttggcatagagctgagagtggacgatgccgtctgttactccaaaattactagcgtggaagctgttgccaattattctgcaatccctaccacaattgggggacttaggttcgagcgcagccatgactcccagggcaagatctcagggagtccactggatataaccgctatccgaggcagcttttctgtgaactaccggggattgcgtctctccctgtcagagattactgccacgtgcacaggtgaagtaaccaatgtcagtgggtgctacagctgtatgactggagcgaaagtgtccatcaagttacactcttcgaaaaacagcaccgcccatgtgagatgcaagggcgacgagacagctttctcagtcctggaaggtgttcactcctataccgtgagtctatcttttgatcacgcagtagtggacgagcagtgtcagctcaattgcggcgggcatgaaagccaagtcactctgaagggaaaccttattttcttggacgtgcccaaatttgttgatggctcctacatgcagacatatcactcaacggtgcctaccggggccaatatcccctctccaactgactggctgaacgctctcttcggaaatggcatgagtaggtggatactgggtgtcattggggtgttactgggaggccttgccttgtttttcatgatcatgagcctctttaagctgggcacaaaacaggttttccgctcccggaccaagctagcatga

SEQ ID NO: 11580 - RNA, 3222 nt, synthetic construct
  misc_feature 1..3222: note = derived and/or modified CDS sequence (opt3) from SFTSV(HNXY_202)__KC292325.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcaatagggtcttgtggatcggggacgtggcttgtcagccaatgacgcccattcctgaagagaccttcctcgagctgaagtcgttttctcagtccgaatttccagatatctgcaaaatagacggaattgtatttaaccagtgtgagggcgaatcactgccgcaacccttcgatgttgcctggatggacgtgggccacagtcataagatcattatgcgggagcacaaaacaaagtgggtccaggagagctcctctaaggattttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaatcagcctgagcaacgaatcggacagtgcactggctgtcacctggaatgcatcaacgggggagtgagacttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggacggcactgaatttaccttcgagggtagctgtatgtttccagatgggtgcgacgccgtagattgcacattctgtagggaatttctgaagaatccccaatgctatccggctaaaaagtggcttttcattatcatagttattctgttgggctacgccggactcatgctgttaaccaacgtgctgaaggcaatcggcatctgggggtcctgggtcattgctcctgtgaaactcatctttgccattataaagaaacttatgcggacggtctcatgtctgatgggaaagttgatggaccgtggtcgccaggtgatccatgaggaaattggcgagaatagagaggggaaccaggatgacgttaggatcgaaatggcgcggccccgacgcgtgagacactggatgtatagcccagtaatcctaactattctggccataggactcgcagagtcttgcgatgaaatggtccatgctgactccaaactggtgagttgtaggcagggcagcggtaatatgaaggagtgcgttacaaccgggcgggcccttctgcctgctgtgaaccccggccaagaggcctgtttgcacttcactgcaccaggatctcccgattccaagtgcctccgcatcaaagtcaagaaaattaatctgaagtgtaaaagatcaagtagctactttgtgcctgacgccaggtcgcgttgcacatccgtacggcgatgtagatgggctggcgattgccagtctgggtgcccaccgcatttcaccagcaactcatttagtgacgactgggcgggaaagatggatagggcaggcttaggtttctccgggtgttctgacggatgcggcggtgccgcttgtggctgctttaatgccgcacccagctgtatcttctggcgcaagtgggtggaaaaccctcacgggattatctggaaagtttccccatgcgccgcttgggtcccctcagccgtgatagagctgacgatgcctagcggagaagtgcggaccttccacccaatgagtggcatccccacacaggtctttaagggggtttctgtgacttatctaggatccgatatggaggtgagcggcctcaccgacctgtgtgaaattgaggagcttaaatcgaagaaattggcactggcgccgtgcaaccaggctggtatgggggtagtcggaaaggtgggcgaaatccaatgttcatctgaggaaagtgccagaacaattaaaaaggatggttgcatctggaatgcagacctcgttggcatagagctgagggtggatgacgccgtctgttactccaagattactagcgtggaagctgttgccaactattctgcaatccctaccacaattgggggacttcgcttcgagcgaagccatgattcccagggcaaaatctcagggagtccactggacataaccgctatccggggcagcttttctgtgaattaccgtggattgagactctccctgtcagagattactgccacgtgcacaggtgaagtaaccaacgtcagtgggtgctacagctgtatgactggagcgaaggtgtccatcaaattacactcttcgaagaatagcaccgcccatgtgaggtgcaaaggcgatgagacagctttctcagtcctggaaggtgttcactcctataccgtgagtctatcttttgaccacgcagtagtggatgagcagtgtcagctcaactgcggcgggcatgaaagccaagtcactctgaagggaaatcttattttcttggacgtgcccaagtttgttgacggctcctacatgcagacatatcactcaacggtgcctaccggggccaacatcccctctccaactgattggctgaatgctctcttcggaaacggcctgagccgctggatattaggtgtcatgggggtgctgcttggaggcttggccctctttttcatgattatgagtctgtttaaactaggcacaaagcaggttttccggtccagaaccaaactggcatga

SEQ ID NO: 11581 - RNA, 3222 nt, synthetic construct
  misc_feature 1..3222: note = derived and/or modified CDS sequence (opt3) from SFTSV(HNXY_206)__KC292302.1__GP
  source 1..3222: mol_type = other RNA
atgatgaaggtgatctggttcagctccctgatttgcctcgtcatacagtgtggcggggacaccggacccatcatttgcgccggtcctatccactctaacaaatcagctgatattccacatcttctgggctacagtgagaagatctgtcaaatagacagattgatccacgttagctcctggttaaggaatcattctcagtttcaggggtatgtgggacagcggggcggtcgctcgcaagtatcatactatccggcagaaaacagctacagtcgatggtccgggctgctatctccctgcgatgccgactggctcggaatgctggtggtcaaaaaggcgaaaggcagcgatatgattgtgcctggcccatcctataaggggaaggttttctttgagcgtcccacattcgacggatacgtgggttggggctgtgggtcaggaaaaagtagaactgaaagcggcgagctttgttcttccgattcaggtacgagcagtgggctgttgccttctgacagggtcctctggatcggagatgtggcttgccagccaatgacccccattcctgaagagacatttctggagctgaagtccttcagccagtcggaatttccagacatctgcaaaatagatggcattgtattcaatcagtgtgagggcgaatctctcccgcaaccctttgacgttgcctggatggatgtggggcactcccataagatcattatgcgggagcacaaaactaagtgggtccaggagtcaagtagcaaggacttcgtgtgctataaagaaggaaccggtccttgttccgagtctgaagagaagacatgcaaaaccagcggctcatgccgcggggacatgcagttttgtaaggtggcaggatgcgaacacggcgaggaggccagtgaagctaaatgtagatgctccttagtccataagccaggtgaggttgtggtaagctacgggggcatgagggtgcggcccaaatgttacggattctctcgcatgatggcaactctggaagtctcacagcctgagcaacgaatcggccagtgcacagggtgtcaccttgaatgcatcaacggaggtgtgagattgattaccctgacgagtgagctaaagagcgccactgtttgtgcttcccatttttgttcttcggccaccagcggcaagaaatccacagagatacagttccactcagggagtctcgtgggaaagactgcgatccacgtcaaaggcgcactggtggatggtaccgaatttacatttgaggggtcttgcatgttcccagacggctgcgatgccgtagactgcaccttttgtagggagttccttaagaatccccaatgctatccgacgaaaaagtggctgtttattatcatagttattttgctcggatacgctggcctgatgttactgactaacgtgctcaaggccatcggggtctggggaagctgggtgatcgcacctgtcaaacttgtgttcgctattatcaagaaactgatgcgggccgtttcctgtttgatgggtaagctaatggatcgtggccgccaggtgattcatgaagaaataggggagaatagagagggaaaccaggacgatatcaggattgaaatggcgcggccccgacgcgtaagacactggatgtattcaccagtcatcctgacaatcctcgccattggcctggcagagggttgcgacgaaatggtgcatgctgatagcaaacttgtttcttgtaggcaggggtccggcaatatgaaggagtgcgtgaccactggacgggccctgttgcctgctgtcaaccccggccaagaggcctgtctccactttacaaccccagggagtcccgacagcaagtgcctgaaaataaaggtgaaacgcatcaatttaaagtgtaaaaagtcttcctcatacttcgtacctgatgcaagaagtaggtgcacgagcgtgcgtcggtgtcgatgggccggagactgccagtcgggctgcccaccgcattttacctccaactctttcagcgacgattgggctggtaagatggacagagcggggctgggattttcaggctgtagtgatggttgcggcggggcagcctgtggatgcttcaatgctgccccctcctgtattttctggaggaaatgggttgaaaaccctcacggcatcatttggaaggtctctccatgcgcagcctgggtgcccagcgctgtgatcgagctaacaatgccttccggggaagtccgcactttccacccaatgtcaggaatacccacccaggttttcaaaggcgtgagcgtgacatatctcggtagtgacatggaggtatctgggctgactgatctttgtgaaatcgaggagttgaagtccaaaaagctggccctcgcaccgtgcaatcaggcgggaatgggcgtcgtgggtaaagttggcgaaattcaatgtagctcggaggaatcagctcggaccatcaagaaggacgggtgcatttggaacgccgatctggtgggaatcgagcttagagtcgacgatgcagtgtgttactctaaaataacaagtgttgaagccgtggctaactattccgccattcctaccactatcggcgggctgaggtttgagcgcagccatgactctcagggaaagattagcggctccccattggatatcacggcaatacgaggttcattcagtgtaaattaccgggggctccgtctgagcttatctgagatcacagctacctgcactggagaagtcaccaacgtgtccggctgctactcatgtatgacaggtgccaaagtgagtattaagctgcacagctccaaaaattctaccgcgcatgtcagatgcaagggcgacgagactgccttttcggttctagaaggggtgcacagctattcagtatccctcagtttcgatcacgctgtggtcgacgagcagtgtcagctgaactgcggaggccatgaatctcaagtgacacttagggggaatttgatctttctggacgttcccaagttcgtggatggaagctacatgcagacgtatcactccaccgtccctactggcgcaaacattccctcaccaacagactggctcaatgccctgtttggtaacgggttatctcgctggatcctgggagtgataggcgttcttttgggcgggctcgctctgttctttctaattatgagcctgttcaaactcggaaccaagcagatctttcggagtagaacaaaactggcctga

SEQ ID NO: 11582 - RNA, 3222 nt, synthetic construct
  misc_feature 1..3222: note = derived and/or modified CDS sequence (opt3) from SFTSV(HNXY_207)__KC292315.1__GP
  source 1..3222: mol_type = other RNA
atgatgaaggtgatctggttccccagcctgatttgctttgtcatacagtgttccggcgactctgggcctatcatttgcgccggaccaatccactcaaacaaaagtgctgatattccgcatctccttggttacagcgagaagatctgtcaaatagacagactgatccacgtttcctcttggttgaggaatcattcgcagttccagggctatgtggggcagcggggaggccgctcacaagtaagctactatcccgcagaaaacagttactcccgatggtctggtttactgagcccttgcgatgccgactggctagggatgctcgtggtcaaaaaggcgaaaggatccgatatgattgtgccaggcccctcatataagggcaaggttttcttcgagcgtcctacctttgacgggtacgtgggatggggttgtggcagtgggaaaagcagaacagaatctggagagctgtgctcctcagatagcggcactagctctggtcttctgccatccgacagggtcttgtggatcggggatgtggcttgtcagcccatgacgcctattccagaagagaccttcctcgagctgaagagtttttcgcagtctgaatttccggacatctgcaaaatagatggaattgtatttaatcagtgtgagggcgaatccctgccccaacctttcgacgttgcctggatggatgtgggccactcacataagatcattatgcgggagcacaaaacaaagtgggtccaggagagtagctccaaggactttgtgtgctataaagaagggactggaccatgttctgagagcgaagagaagacctgcaaaacatcaggtagttgccgcggcgacatgcagttctgtaaggtggcagggtgcgaacacggagaggaggcctccgaagctaaatgtagatgcagcctcgtccataagcccggcgaggttgtggtatcttacggtgggatgagggtgcggcctaaatgttacggcttttcacgcatgatggcaaccttagaagtcaaccagccagagcaacgaatcggacagtgcactggctgtcacctggaatgcatcaatgggggagtgagacttattacattgaccagtgagctaaagagcgccacggtttgtgcttcccatttctgcagctcggccactagcggtaagaaatccaccgagatacagttccactcaggcagtctggtggggaagacagcgatccacgtcaaaggagcactcgtggatggcactgaatttaccttcgagggttcttgtatgtttcccgacgggtgcgatgccgtagactgcacattctgtagggaatttctgaagaacccgcaatgctatcctgctaaaaagtggcttttcattatcatagttattctgttgggctacgccggactcatgctgttaaccaatgtgctgaaggcaatcggcatctgggggagctgggtcattgctcccgtgaaactcatgtttgccatcattaagaaacttatgcggacggtctcctgtctgatgggaaagttgatggatcgtggtcgccaggtgatacatgaggaaatcggcgagaacagagaggggaatcaggacgatgttaggattgaaatggcgcggccacgacgcgtgagacactggatgtattcacctgtaatcctaactatcctggccattggactcgcagagagctgcgacgaaatggtccatgctgattctaaactggtgtcctgtaggcagggcagtggtaacatgaaggagtgcgttacaaccgggcgggcccttctgcccgctgtgaatccaggccaagaggcctgtttgcacttcactgcacccggaagccctgactctaagtgcctcaaaataaaggtcaaacgcatcaacctgaagtgtaaaaagtcctcaagttactttgtgccagatgccagatctaggtgcacatcggtacgtcggtgtcgatgggctggcgactgccagtccgggtgcccgccccatttcacctctaatagcttttcagacgattgggcgggaaagatggacagagcaggcttaggtttcagtgggtgttccgatggatgcggcggtgccgcttgtggctgctttaacgccgcaccttcttgtattttctggaggaaatgggtggaaaatccacacgggatcatttggaaggttagcccctgcgccgcttgggtcccttccgccgtgatcgagctgacgatgccatcaggagaagtgcgcaccttccaccccatgagcggcataccgacacaggtctttaaaggggttagtgtgacttatctaggatctgacatggaggtgtccggcctcaccgatctgtgtgaaatcgaggagcttaagagcaaaaagttggcactggcgccttgcaaccaggctggtatgggggtagtcggaaaagtgggcgaaattcaatgttcgtcagaggaatctgcccggacaatcaagaaggacggttgcatttggaacgcagatctcgttggcatcgagctgagagtggacgatgccgtctgttacagtaaaataacttccgtggaagctgttgccaattatagcgcaattccaaccacaatcgggggacttaggttcgagcgctctcatgacagccagggcaagatttccgggtcacccctggatatcaccgctatacgaggaagttttagcgtgaactaccggggcttgcgtctctctctgtccgagatcactgccacgtgcacaggtgaagtaaccaatgtctcagggtgctacagttgtatgactggagcgaaagtgagcattaagttacactcctctaaaaactcgaccgcccatgtgagatgcaagggcgacgagacagctttcagcgtcctggaaggtgttcactcatataccgtgtccctaagttttgatcacgcagtagtggacgagcagtgtcagctcaattgcggcgggcatgaatctcaagtcactctgaagggaaaccttatcttcttggacgtgcctaaatttgttgatggcagctacatgcagacatatcactccacggtgcccaccggggccaatattccatcacctactgactggctgaacgctctcttcggaaatggcctgtctaggtggatcttaggtgtcataggggtgctgcttggaggcttggccctctttttcatgattatgagcctgtttaagctaggcacaaaacaggttttccgcagtcggaccaagctggcatga

SEQ ID NO: 11583 - RNA, 3222 nt, synthetic construct
  misc_feature 1..3222: note = derived and/or modified CDS sequence (opt3) from SFTSV(HNXY_224)__KC292317.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaaccagcctgagcaacgaatcggacagtgcactggctgtcacctggaatgcatcaatgggggagtgagacttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggatggcactgaatttaccttcgagggtagctgtatgtttccagacgggtgcgatgccgtagactgcacattctgtagggaatttctgaagaacccccaatgctatccggctaaaaagtggcttttcattatcgttgtgatactgttgggctacgccggactcatgctgttaaccaatgtcctgaaggcaattggcatctgggggtcctgggtgatcgctcctgtcaaactcatgtttgccattatcaagaaacttatgcggacggtgtcatgtctgatgggaaagttgatggatcgtggtcgccaggttattcatgaggaaataggcgagaacagagaggggaatcaggacgatgtgaggatcgaaatggcgcggccccgacgcgtaagacactggatgtatagcccagtcattctaactatcctggccatcggactcacagagtcttgcgacgaaatggtgcatgcagattccaaactggttagttgtaggcagggcagcggtaacatgaaggagtgcgtgaccactgggcgggcccttctgcctgctgtcaatcccggccaagaggcttgtttgcacttcacagccccaggatctcccgactccaagtgcctcaaaattaaggtgaaacgcataaacctgaagtgtaaaaagtcaagtagctactttgtacctgatgcaagatcgaggtgcacctccgtgcgtcggtgtcgatgggccggcgactgcgaatctgggtgcccaccgcatttcacgagcaattcatttagtgacgattgggctggaaagatggacagagcgggcttaggtttctccgggtgttctgatggatgcggcggtgcagcctgtggctgctttaacgctgcccccagctgtatcttctggaggaaatgggttgagaatcctcacgggattatctggaaggtctccccatgcgcagcctgggtgccctcagctgtgattgaactgaccatgcctagcggagaggtccgcacattccagccaatgagtggcatccccactcaggtttttaaaggggtgtctgtgacctatctaggatccgacatggaagtaagcggcctcacagatctgtgtgagatagaggaacttaagtcgaaaaagttggccctggcaccgtgcaaccaggcgggtatgggggtcgtgggaaaagttggcgagatccaatgttcatctgaagagagtgctcggactattaagaaggacggttgcatctggaacgccgatctcgtgggcattgaactgagagtcgacgatgcagtgtgttactccaaaatcaccagcgttgaggccgtggctaattattctgccatacctacaaccattgggggacttaggttcgagcgcagccacgactcccagggcaagatctcagggagtccactggatattactgcaatccgaggcagcttttctgtaaactaccggggattgcgtctctccctgtcagaaataacggctacatgcaccggtgaggtcactaatgtgagtgggtgctacagctgtatgaccggagccaaagtgtccatcaagttacattcttcgaaaaacagcacagcgcacgtcagatgcaagggcgacgaaaccgccttctcagttctggagggtgtgcattcctatactgtaagtctatcttttgatcacgctgtggtcgacgaacagtgtcagctcaattgcggcgggcacgagagccaagtgacactgaagggaaaccttattttcttggacgttcccaaatttgtggatggctcctacatgcagacgtatcattcaaccgtccctactggggcaaatatcccctctccaacagactggctgaacgccctcttcggaaatggcctgagtaggtggattttaggtgtgatcggggttctgcttggaggcttggctctctttttcatgataatgagcctgtttaagctaggcaccaaacaggtgttccgctcccggacaaagctggcctga

SEQ ID NO: 11584 - RNA, 3222 nt, synthetic construct
  misc_feature 1..3222: note = derived and/or modified CDS sequence (opt3) from SFTSV(HNXY_231)__KC292313.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctggtattccacatctccttggctactccgagaagatctgtcaaatagatagactgatccacgtttcttcgtggttgaggaatcattcacagttccaggggtatgtgggacagcggggcggtcgcagccaagtaagttactatccggcagaaaactcctactctcgatggagcgggttactgtccccctgcgacgccgattggctaggaatgctcgtggtcaaaaaggcgaaaggctcagacatgattgtgcctggcccaagttataaggggaaggttttcttcgagcgtcccacctttgatggatacgtgggttggggctgtgggagcggaaaatctagaacagaatccggcgagctgtgctcaagcgacagtggtacttcttccgggcttctgcctagcgatagggtcttgtggatcggagacgtggcttgtcagccaatgacgcccattcctgaagagaccttcctcgagctgaagtcgttttctcagtccgaatttccagatatctgcaaaatagacggcattgtatttaatcagtgtgagggcgaatcactgccgcaacccttcgatgttgcctggatggacgtggggcacagtcataagatcattatgcgggagcacaaaacaaagtgggtccaggagagctcctctaaggattttgtgtgctataaagaaggaactggtccttgtagcgagtcagaagagaagacctgcaaaacaagtggctcctgccgcggggacatgcagttctgtaaggtggcaggatgcgaacacggcgaggaggccagcgaagctaaatgtagatgctctctcgtccataagccaggtgaggttgtggtatcatacgggggcatgagggtgcggcccaaatgttacggatttagtcgcatgatggcaaccttagaagtcaaccagcctgagcaacgaatcggccagtgcactgggtgtcacctggaatgcatcaatggaggtgtgagacttattacattgaccagcgagctgaagtccgccacggtttgtgcttctcatttctgctcgagcgccacttccggcaagaaatcaaccgagatacagttccacagtgggtctctagtgggaaagacagcgatccacgtcaaaggcgcactcgtggacggtactgaatttaccttcgaggggagctgtatgtttccagatggctgcgacgccgtagattgcacattctgtagggaatttctgaagaacccccaatgctatccggctaaaaagtggcttttcattatcatagttattctgttgggatacgccggcctcatgctgttaaccaatgtgctgaaggcaatcgggatctggggatcctgggtcattgctcctgtgaaactcatctttgccattataaagaaacttatgcggacggtctcatgtctgatgggtaagttgatggaccgtggccgccaggtgatccatgaggaaattggggagaacagagagggaaatcaggatgacgttaggatcgaaatggcgcggccccgacgcgtgagacactggatgtatagcccagtaatcctaactattctggccataggcctcgcagagtcttgcgatgaaatggtccatgctgactccaaactggtgagttgtaggcagggtagcgggaacatgaaggagtgcgttacaaccggccgggcccttctgcctgctgtgaatcccggacaagaggcctgtttgcacttcactgcaccaggctctcccgattccaagtgcctcaaaatcaaggtcaaacgcattaacctgaagtgtaaaaagtcaagtagctactttgtgcctgacgccagatcgaggtgcacatccgtacgtcggtgtcgatgggctggggattgccagtctggatgcccaccgcatttcaccagcaattcatttagtgacgactgggcgggcaagatggatagagcaggtttagggttctccggatgttctgacggctgcggtggcgccgcttgtgggtgctttaacgccgcacccagctgtatcttctggaggaaatgggtggaaaatcctcacggaattatctggaaggtttccccatgcgccgcttgggtcccctcagccgtgatagagctgacgatgcctagcggcgaagtgcgcaccttccacccaatgagtgggatccccacacaggtctttaaaggagtttctgtgacttatctaggctccgatatggaggtgagcggtctcaccgacctgtgtgaaattgaggagcttaagtcgaaaaagttggcactggcgccgtgcaaccaggctgggatgggagtagtcggcaaagtgggtgaaatccaatgttcatctgaggaaagtgcccggacaattaagaaggatggctgcatctggaacgcagacctcgttgggatagagctgagagtggatgacgccgtctgttactccaaaattactagcgtggaagctgttgccaattattctgcaatccctaccacaattggaggccttaggttcgagcgcagccatgattcccaggggaagatctcaggaagtccactggacataaccgctatccgaggcagcttttctgtgaactaccggggtttgcgtctctccctgtcagagattactgccacgtgcacaggggaagtaaccaatgtcagtggatgctacagctgtatgactggcgcgaaagtgtccatcaagttacactcttcgaaaaacagcaccgcccatgtgagatgcaagggtgatgagacagctttctcagtcctggaaggcgttcactcctataccgtgagtctatcttttgaccacgcagtagtggatgagcagtgtcagctcaattgcgggggacatgaaagccaagtcactctgaagggcaaccttattttcttggacgtgcccaaatttgttgacgggtcctacatgcagacatatcactcaacggtgcctaccggagccaatatcccctctccaactgattggctgaacgctctcttcggcaatggtctgagtaggtggatattaggggtcattggagtgctgcttggcggcttggccctctttttcatgatcatgagcctgtttaagctagggacaaaacaggttttccgctcccggaccaagctggcatga

SEQ ID NO: 11585 - RNA, 3222 nt, synthetic construct
  misc_feature 1..3222: note = derived and/or modified CDS sequence (opt3) from SFTSV(HNXY_245)__KC292320.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcaatagggtcttgtggatcggggacgtggcttgtcagccaatgacgcccattcctgaagagaccttcctcgagctgaagtcgttttctcagtccgaatttccagatatctgcaaaatagacggaattgtatttaaccagtgtgagggcgaatcactgccgcaacccttcgatgttgcctggatggacgtgggccacagtcataagatcattatgcgggagcacaaaacaaagtgggtccaggagagctcctctaaggattttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaatcagcctgagcaacgaatcggacagtgcactggctgtcacctggaatgcatcaacgggggagtgagacttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggacggcactgaatttaccttcgagggtagctgtatgtttccagatgggtgcgacgccgtagattgcacattctgtagggaatttctgaagaatccccaatgctatccggctaaaaagtggcttttcattatcatagttattctgttgggctacgccggactcatgctgttaaccaacgtgctgaaggcaatcggcatctgggggtcctgggtcattgctcctgtgaaactcatctttgccattataaagaaacttatgcggacggtctcatgtctgatgggaaagttgatggaccgtggtcgccaggtgatccatgaggaaattggcgagaatagagaggggaaccaggatgacgttaggatcgaaatggcgcggccccgacgcgtgagacactggatgtatagcccagtaatcctaactattctggccataggactcgcagagtcttgcgatgaaatggtccatgctgactccaaactggtgagttgtaggcagggcagcggtaatatgaaggagtgcgttacaaccgggcgggcccttctgcctgctgtgaaccccggccaagaggcctgtttgcacttcactgcaccaggatctcccgattccaagtgcctccgcatcaaagtcaagagaattaatctgaaatgtaagaaatcaagtagctactttgtgcctgacgccaggtcgcgttgcacatccgtacggcgatgtagatgggctggcgattgccagtctgggtgcccaccgcatttcaccagcaactcatttagtgacgactgggcgggaaagatggatagggcaggcttaggtttctccgggtgttctgacggatgcggcggtgccgcttgtggctgctttaatgccgcacccagctgtatcttctggcgcaagtgggtggaaaaccctcacgggattatctggaaagtttccccatgcgccgcttgggtcccctcagccgtgatagagctgacgatgcctagcggagaagtgcggaccttccacccaatgagtggcatccccacacaggtctttaagggggtttctgtgacttatctaggatccgatatggaggtgagcggcctcaccgacctgtgtgaaattgaggagcttaaatcgaagaaattggcactggcgccgtgcaaccaggctggtatgggggtagtcggaaaggtgggcgaaatccaatgttcatctgaggaaagtgccagaacaattaaaaaggatggttgcatctggaatgcagacctcgttggcatagagctgagggtggatgacgccgtctgttactccaagattactagcgtggaagctgttgccaactattctgcaatccctaccacaattgggggacttcgcttcgagcgaagccatgattcccagggcaaaatctcagggagtccactggacataaccgctatccggggcagcttttctgtgaattaccgtggattgagactctccctgtcagagattactgccacgtgcacaggtgaagtaaccaacgtcagtgggtgctacagctgtatgactggagcgaaggtgtccatcaaattacactcttcgaagaatagcaccgcccatgtgaggtgcaaaggcgatgagacagctttctcagtcctggaaggtgttcactcctataccattagtctatcttttgaccacgcagtggtagatgagcagtgtcagctcaactgcggcgggcatgaaagccaagtgactctgaagggaaatcttatcttcttggacgtccccaagtttgtggacggctcctacatgcagacatatcactcaacggttcctaccggggccaacataccctctccaactgattggctgaatgctctcttcggaaacggcctgagccgctggattttaggtgtgatgggggtcctgcttggaggcttggccctctttttcatgatcatgagtctgtttaaactaggcacaaaacaggtgttccggtccagaaccaagctggcatga

SEQ ID NO: 11586 - RNA, 3222 nt, synthetic construct
  misc_feature 1..3222: note = derived and/or modified CDS sequence (opt3) from SFTSV(HNXY_262)__KC292309.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccgagtaagttactatccggcagaaaactcctactctcgttggagcggtttactgtccccctgcgatgccgactggctagggatgctcgtggtcaaaaaggcgaaaggatcagatatgattgtgcctggcccaagttataagggcaaggttttcttcgagagacccacctttgacgggtacgtgggatggggttgtggcagcgggaaatctaggacagaatccggagagctgtgctcaagcgatagtggcacttcttccggtcttctgcctagcgaccgggtcttgtggatcggggatgtggcttgtcaaccaatgacgcccattcctgaagagaccttcctcgagctgaagtcgttttctcagtccgaatttccagacatctgcaaaatagatggaattgtatttaatcagtgtgagggcgaatcactgccgcagcccttcgacgttgcctggatggatgtgggccacagtcataagatcattatgcgcgagcacaaaacaaagtgggtccaagagagctcctctaaggactttgtgtgctataaagaagggactggaccttgtagcgagtcagaagagaagacctgcaaaacaagtggttcctgcagaggcgacatgcagttctgtaaggtggcagggtgcgaacacggagaggaggccagcgaagctaaatgtaggtgctctctcgtccataagccaggcgaggttgtggtatcatacggtgggatgcgggtgcgccccaaatgttacggctttagtcgaatgatggcaaccttagaagtcaaccagcctgagcagagaatcggacaatgcactggctgtcacctggaatgcatcaatgggggagtgaggcttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggatggcactgaatttaccttcgagggtagctgtatgtttccagacgggtgcgatgccgtagactgcacattctgtcgggaatttctgaagaacccccagtgctatccggctaaaaagtggcttttcattatcatagttattctgttgggctacgccggactcatgctgttaaccaatgtgctgaaggcaatcggcatctgggggtcctgggtcattgctcctgtgaaactcatctttgccattataaagaaacttatgcgtacggtctcatgtctgatgggaaagttgatggatcgcggtagacaagtgatccatgaggaaattggcgagaacagggaggggaatcaggacgatgttcggatcgaaatggcgcgaccccgcagagtgaggcactggatgtatagcccagtaatcctaactattctggccataggactcgcagagtcttgcgacgaaatggtccatgctgattccaaactggtgagttgtcggcagggcagcggtaacatgaaggagtgcgttacaaccgggcgcgcccttctgcctgctgtgaatcccggccaggaggcctgtttgcacttcactgcaccaggatctcccgactccaagtgcctcaaaatcaaggtcaaaagaattaacctgaagtgtaaaaagtcaagtagctactttgtgcctgatgccaggtcgcgttgcacatccgtacggcgatgtagatgggctggcgactgccaatctgggtgcccaccgcatttcaccagcaattcatttagtgacgattgggcgggaaagatggacagggcaggcttaggtttctccgggtgttctgatggatgcggcggtgccgcttgtggctgctttaacgccgcacccagctgtatcttctggcgcaaatgggtggaaaatcctcacgggattatctggaaggtttccccatgcgccgcttgggtcccctcagccgtgatagagctgacgatgcctagcggagaagtgcggaccttccacccaatgagtggcatccccacacaggtctttaaaggggtttctgtgacttatctaggatccgacatggaggtgagcggcctcaccgatctgtgtgaaattgaggagcttagatcgaagaaattggcactggcgccgtgcaaccaggctggtatgggggtagtcggaaaggtgggcgaaatccagtgttcatctgaggaaagtgccaggacaattaaaaaggacggttgcatctggaacgcagatctcgttggcatagagctgcgcgtggacgatgccgtctgttactccaagattactagcgtggaagctgttgccaattattctgcaatccctaccacaattgggggacttcgattcgagcggagccatgactcccaaggcaaaatctcagggagtccactggatataaccgctatccgtggcagcttttctgtgaactacagaggattgaggctctccctgtcagagattactgccacgtgcacaggtgaagtaaccaatgtcagtgggtgctacagctgtatgactggagcgaaggtgtccatcaaattacactcttcgaagaacagcaccgcccatgtgcgctgcaaaggcgacgagacagctttctcagtcctggaaggtgttcactcctataccgtgagtctatcttttgatcacgcagtagtggacgagcagtgtcagctcaattgcggcgggcatgaaagccaggtcactctgaagggaaaccttattttcttggacgtgcccaagtttgttgatggctcctacatgcaaacatatcactcaacggtgcctaccggggccaatatcccctctccaactgactggctgaacgctctcttcggaaatggcctgagccggtggatattaggtgtcatgggggtgctgcttggaggcttggccctctttttcatgattatgagtctgtttaaactaggcacaaagcaggttttcagatccaggaccaaactggcatga

SEQ ID NO: 11587 - RNA, 3222 nt, synthetic construct
  misc_feature 1..3222: note = derived and/or modified CDS sequence (opt3) from SFTSV(HNXY_278)__KC292322.1__GP
  source 1..3222: mol_type = other RNA
atgatgaaggtgatctggttcagctccctgatttgcctcgtcatacagtgtggcggggacaccggacccatcatttgcgccggtcctacacactctaacaaatcagctgatatcccacatcttctgggctacagtgagaagatttgtcaaatcgacagattgatacacgttagctcctggttaaggaatcattctcagtttcaggggtatgtgggacagcggggcggtcgctcgcaagtatcatactatccggcagaaaacagctacagtcgatggtccgggctgctatctccctgcgatgccgactggctcggaatgctggtggtcaaaaaggcgaaaggcagcgatatgatcgtgcctggcccatcctataaggggaaggttttctttgagcgtcccactttcgacggatacgtgggttggggctgtgggtcaggaaaaagtagaacggaaagcggcgagctttgcagctccgattcaggtaccagcagtgggctgttgccttctgacagggtcctctggattggagatgtggcttgtcagccaatgacacccatccctgaagagacttttctggagctgaagtccttcagccagtcggaatttccagacatttgcaaaatcgatggcatagtattcaatcagtgtgagggcgaatctctcccgcaaccctttgacgttgcctggatggatgtggggcactcccataagattatcatgcgggagcacaaaaccaagtgggtccaggagtcaagtagcaaggacttcgtgtgctataaagaaggaacaggtccttgttccgagtctgaagagaagacctgcaaaactggcgggagctgccgcggagacatgcagttttgtaaggtggcaggctgcgaacacggtgaggaggcctcagaagctaaatgtagatgcagtttagtccataagccaggggaggttgtggtatcctacggcggaatgagggtgcggcccaaatgttacggcttcagccgcatgatggcaacactggaagtctctcagcctgagcaacgaattgggcagtgcaccggatgtcaccttgaatgcatcaacggtggcgtgagattgatcacgctgacttcagagctaaagagtgccaccgtttgtgctagccatttttgctcctctgccacatcggggaagaaaagcactgagattcagttccactccggatcactcgtgggcaagaccgcgatacacgtcaaaggtgcactggtggatgggacagagttcacctttgaaggcagttgtatgttcccagacggatgcgatgccgtagactgcacgttttgtagggagttccttaagaatccccaatgctatccggctaaaaagtggctgtttatcattatcgttatattgctcggctacgccgggctgatgttactgactaacgtgctcaaggcaattggagtctggggttcttgggtgatcgctcctgtcaaacttgtgttcgccatcattaagaaactgatgcgggcggttagctgtttgatgggcaagctaatggatcgtgggcgccaggtgatccatgaagaaattggagagaatagagagggcaaccaggacgatgtaaggatagaaatggcccggccccgacgcgtcagacactggatgtattccccagtgatcctgacaattctcgcaatcggtctggctgaggggtgcgacgaaatgatccatgccgattcaaaacttgttagctgtaggcagggctctggaaatatgaaggagtgcgtgaccactggccgggctctgttgcctgccgtcaaccccgggcaagaggcatgtctccactttacagccccaggatcccccgacagtaagtgcctgaaaattaaggtgaaacgcataaatttaaagtgtaaaaagtcttcttcctacttcgtacctgatgctagatcaaggtgcaccagtgtgcgtcggtgtcgatgggcgggcgactgccagagcggttgcccaccgcattttacgcccaactcgttctccgacgattgggcagggaagatggacagagccggactgggcttttctggttgtagcgatggctgcgggggagctgcctgtggctgcttcaatgcagccccttcatgtatcttttggaggaaatgggttgaaaacccacacgggattatctggaaggtcagtccctgcgctgcctgggtgccttccgcagtgattgagctaaccatgccatctggagaagtccgcacattccaccccatgagcggcatcccgactcaggttttcaaaggtgtgtccgtgacctatctcgggtcagacatggaggtaagcggactgacagatctttgtgaaatagaggagttgaagagtaaaaagctggcgctcgctccttgcaatcaggccggcatgggtgtcgtgggcaaagttggggaaatccaatgttcttccgaggaaagcgcacggactattaagaaggacggatgcatctggaacgccgatctggtgggcattgagcttagagtcgacgatgctgtgtgttactcgaaaatcacctcagttgaagccgtggcaaactattctgctataccaacaaccattgggggactgaggtttgagcgcagtcatgactcccagggcaagatcagcggttctcccttggatattactgccatccgagggagcttctccgtaaattaccggggactccgtctgtcattaagtgagataacggcgacatgcaccggcgaagtcactaacgtgagcggttgctactcttgtatgaccggcgccaaagtgtccatcaagctgcactcaagtaaaaatagcacagctcatgtcagatgcaagggggacgagaccgcattttccgttctagaaggagtgcactcttattcggtaagcctctcattcgatcacgccgtggtcgacgagcagtgtcagctgaactgcggcgggcatgaatcccaagtgactcttaggggaaatttgatttttctggacgttcctaagttcgtggatggcagttacatgcagacatatcactctacggtccccaccggtgctaacatcccaagccctactgactggctcaatgccctgtttgggaacggattatcccgctggattctgggcgtgatcggcgttcttctcgggggattggcactgttctttctaataatgtcactgttcaaactcggtacaaagcagatttttcggtctagaaccaaactggcgtga

SEQ ID NO: 11588 - RNA, 3222 nt, synthetic construct
  misc_feature 1..3222: note = derived and/or modified CDS sequence (opt3) from SFTSV(HNXY_31)__KC292310.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaaccagcctgagcaacgaatcggacagtgcactggctgtcacctggaatgcatcaatgggggagtgagacttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggatggcactgaatttaccttcgagggtagctgtatgtttccagacgggtgcgatgccgtagactgcacattctgtagggaatttctgaagaacccccaatgctatccggctaaaaagtggcttttcattatcatagttattctgttgggctacgccggactcatgctgttaaccaatgtgctgaaggcaatcggcatctgggggtcctgggtcattgctcctgtgaaactcatctttgccattataaagaaacttatgcggacggtctcatgtctgatgggaaagttgatggatcgtggtcgccaggtgatccatgaggaaattggcgagaacagagaggggaatcaggacgatgttaggatcgaaatggcgcggccccgacgcgtgagacactggatgtatagcccagtaatcctaactattctggccataggactcgcagagtcttgcgacgaaatggtccatgctgattccaaactggtgagttgtaggcagggcagcggtaacatgaaggagtgcgttacaaccgggcgggcccttctgcctgctgtgaatcccggccaagaggcctgtttgcacttcactgcaccaggatctcccgactccaagtgcctcaaaatcaaggtcaaacgcattaacctgaagtgtaaaaagtcaagtagctactttgtgcctgatgccagatcgaggtgcacatccgtacgtcggtgtcgatgggctggcgactgccagtctgggtgcccaccgcatttcaccagcaattcatttagtgacgattgggcgggaaagatggacagagcaggcttaggtttctccgggtgttctgatggatgcggcggtgccgcttgtggctgctttaacgccgcacccagctgtatcttctggaggaaatgggtggaaaatcctcacgggattatctggaaggtttccccatgcgccgcttgggtcccctcagccgtgatagagctgacgatgcctagcggagaagtgcgcaccttccacccaatgagtggcatccccacacaggtctttaaaggggtttctgtgacttatctaggatccgacatggaggtgagcggcctcaccgatctgtgtgaaattgaggagcttaagtcgaaaaagttggcactggcgccgtgcaaccaggctggtatgggggtagtcggaaaagtgggcgaaatccaatgttcatctgaggaaagtgcccggacaattaagaaggacggttgcatctggaacgcagatctcgttggcatagagctgagagtggacgatgccgtctgttactccaaaattactagcgtggaagctgttgccaattattctgcaatccctaccacaattgggggacttaggttcgagcgcagccatgactcccagggcaagatctcagggagtccactggatataaccgctatccgaggcagcttttctgtgaactaccggggattgcgtctctccctgtcagagattactgccacgtgcacaggtgaagtaaccaatgtcagtgggtgctacagctgtatgactggagcgaaagtgtccatcaagttacactcttcgaaaaacagcaccgcccatgtgagatgcaagggcgacgagacagctttctcagtcctggaaggtgttcactcctatagtgtgtctctcagctttgatcacgcagtagtggacgagcagtgtcagctaaattgcggcgggcatgaatcccaagtcaccctgaggggaaaccttattttcttggacgtgcccaagtttgttgatggctcatacatgcagacttatcactctacagtgcctacgggggccaatatccccagcccaaccgactggctgaacgctctcttcggaaatggcctgagtcgctggatattaggtgtcattggggtgctgcttggaggcttggccctctttttcatgatcatgtccctgtttaaactaggcactaagcaggttttccggagcagaacaaaactggcatga

SEQ ID NO: 11589 - RNA, 3222 nt, synthetic construct
  misc_feature 1..3222: note = derived and/or modified CDS sequence (opt3) from SFTSV/FTLSV(2011YGS5)__KF711925.1__GP
  source 1..3222: mol_type = other RNA
atgatgaaggtgatctggttcagctccctggtctgcctcgttattcagtgttctggcgactcagggcccataatctgcgccggacctattcacagtaacaaaagcgctgcaatcccacatcttctgggttactccgagaagatttgtcaaatcgatagattgatacacgtgtcttcgtggttaaggaatcattcacagtttcagggctatgtagggcagcggggaggccgcagccaagtgagttactatccggccgaaaactcctactctcgatggagcggtctgctatccccctgcgacgcggattggctcgggatgctggtcgtgaaaaaggctaaaggatcagacatgatcgttcctggcccaagttataagggcaaggtgttctttgagcgtcccaccttcgatgggtacgtcggatggggttgtggcagcgggaaatctagaacagaatccggagagctttgctcaagcgacagtggcacttcttccggtctgttgcctagcgatagggtgctctggattggggacgtagcctgtcagccaatgacgcccatccctgaagagacctttctggagctgaagtcgttctctcagtccgaatttccagatatttgcaaaatcgacggaatagttttcaatcagtgtgagggcgaatcactcccgcaaccctttgatgtggcatggatggacgtcggccacagtcataagattatcatgcgggagcacaaaacaaagtgggtgcaggagagctcctctaaggatttcgtgtgctataaagaagggactggaccttgtagcgagtcagaagagaaggcctgcaaaaccagtggttcctgccgcggcgacatgcagttttgtaaggtcgctgggtgcgaacacggagaggaggcaagcgaagccaaatgtagatgctctttagttcataagccaggcgaggtggtagtgtcatacggtgggatgagggtccggcccaaatgttacggcttcagtcgcatgatggctacaatggaagtgaaccctccagagcagcgaattggacaatgcaccggctgtcacctggaatgcatcaatgggggagttagacttatcactttgacaagcgagctgaagtccgccaccgtgtgtgcgtctcatttttgctcgagcgcaacgtccggtaagaaatcaactgagattcacttccacagtggctctctagtcgggaagaccgccatacatgtgaaaggagctctcgtagacggcacagaatttacttttgagggtagctgtatgttccccgatgggtgcaacgccgttgactgcaccttttgtagggagttcctgaagaatccgcagtgctatcctgcgaaaaagtggctttttatcattatcgtgatactgttgggctacgctggactcatgctgttaacaaacgtcctgaaggccattggcgtgtgggggtcctgggtcatcgcgcccgtgaaactcatgttcgccatcatgaagaaacttatgcggaccgtttcatgtctggtgggaaagttgatggatcgtggtcgccaggtaattcacgaagaaatcggcgagaatggggagggaaaccatgacgatgtcagaattgaaatggcaaggccacggcgagtgcgccactggatgtatagccctgttatactaacgatcctggctattggcctcgccgagggttgcgacgaaatggtgcatgctgattctaaactggtctcctgtagacaagggagtggcaatatgaaggagtgcgtgactacaggaagggcccttctgcccgcagtaaacccaggccaggaggcctgtttgcactttaccgctcccgggagccctgactctaagtgcctcaaaatcaaggtgaaacggatcaatctgaagtgtaaaaagtcctcaagttacttcgttccagatgcgcgcaacagatgcactagcgtcaggcgttgtcggtgggcaggagactgccagtcgggctgcccgccccactttacatccaattctttcagcgatgactgggccggtaagatggaccgagctgggttaggattttcaggctgtagtgatggttgcggcggggccgcatgtggatgcttcaacgccgctccttcctgtattttctggagaaaatgggtggaaaactctcatggcataatctggaaggtgagcccatgcgccgcatgggtcccctccgcggttattgagctgaccatgccttcaggggaagtgaggacgttccacccaatgagcggaatccccacccaggtgttcaaaggcgtaagtgtcacatatctaggttctgacatggaggtgtccgggctcactgatctgtgtgaaattgaggagcttaagagcaaaaagttggctctggccccgtgcaatcaagcaggaatgggcgttgtgggtaaagtcggcgaaatccagtgttcgtcagaggaatctgcccgcaccataaagaaggacgggtgcatctggaacgctgatctcgtgggaattgagctgcgggttgacgatgccgtgtgttacagtaaaatcacatccgtagaagcagtcgctaattatagcgccattcctactaccatcggcgggcttagatttgagaggtctcatgacagccagggaaagatatccggctcaccactggatattacagcgatccgcggtagtttcagcgtgaactaccgagggttgcggctctctctgtccgagattaccgccacttgcacgggagaagtgacaaatgtctcaggctgctacagttgtatgaccggtgctaaagttagcatcaagttacactcctctaaaaactcgactgcacacgtgcgttgcaagggcgacgagaccgcctttagcgtactggaaggggtgcattcatatacagtctccctaagtttcgatcacgctgtggttgacgagcagtgtcaactcaattgcggaggccatgaatctcaggtgaccctgaaggggaaccttatatttttggatgtccccaaattcgtggacggaagctacatgcagacttatcactccacagttcctacgggcgccaatatcccctcaccaaccgactggctgaacgcactctttggtaatgggctgtctagatggattttaggagtgatcggcgtcctgcttggcgggttggcactcttctttctgattatgttcctatttaagctgggaactaaacaggtattcaggagccgcacaaagctcgcctga

SEQ ID NO: 11590 - RNA, 3222 nt, synthetic construct
  misc_feature 1..3222: note = derived and/or modified CDS sequence (opt3) from SFTSV/FTLSV(2011YGS7)__KF711922.1__GP
  source 1..3222: mol_type = other RNA
atgatgaaggtgatctggttcagctccctggtctgcctcgttattcagtgttctggcgactcagggcccataatctgcgccggacctattcacagtaacaaaagcgctgcaatcccacatcttctgggttactccgagaagatttgtcaaatcgatagattgatacacgtgtcttcgtggttaaggaatcattcacagtttcagggctatgtagggcagcggggaggccgcagccaagtgagttactatccggccgaaaactcctactctcgatggagcggtctgctatccccctgcgacgcggattggctcgggatgctggtcgtgaaaaaggctaaaggatcagacatgatcgttcctggcccaagttataagggcaaggtgttctttgagcgtcccaccttcgatgggtacgtcggatggggttgtggcagcgggaaatctagaacagaatccggagagctttgctcaagcgacagtggcacttcttccggtctgttgcctagcgatagggtgctctggattggggacgtagcctgtcagccaatgacgcccatccctgaagagacctttctggagctgaagtcgttctctcagtccgaatttccagatatttgcaaaatcgacggaatagttttctatcagtgtgagggcgaatcactcccgcaaccctttgatgtggcatggatggacgtcggccacagtcataagattatcatgcgggagcacaaaacaaagtgggtgcaggagagctcctctaaggatttcgtgtgctacaaagaagggactggaccttgtagcgagtcagaagagaaggcctgcaaaaccagtggttcctgccgcggcgacatgcagttttgtaaggtcgctgggtgcgaacacggagaggaggcaagcgaagccaaatgtagatgctctttagttcataagccaggcgaggtggtagtgtcatacggtgggatgagggtccggcccaaatgttatggcttcagtcgcatgatggctacaatggaagtgaatcctccagagcagcgaattggacaatgcaccggctgtcacctggaatgcatcaacgggggagttagacttatcactttgacaagcgagctgaagtccgccaccgtgtgtgcgtctcatttttgctcgagcgcaacgtccggtaagaaatcaactgagattcacttccacagtggctctctagtcgggaagaccgccatacatgtgaaaggagctctcgtagacggcacagaatttacttttgagggtagctgtatgttccccgatgggtgcaatgccgttgactgcaccttttgtagggagttcctgaagaacccgcagtgctaccctgctaaaaagtggctttttatcattatcgtgatactgttgggctatgcaggactcatgctgttaacaaatgtcctgaaggccattggcgtgtgggggtcctgggtcatcgcgcccgtgaaactcatgttcgccatcatgaagaaacttatgcggaccgtttcatgtctggtgggaaagttgatggatcgtggtcgccaggtaattcacgaagaaatcggcgagaacggggagggaaatcatgacgatgtcagaattgaaatggcaaggccacggcgagtgcgccactggatgtacagccctgttatactaacgatcctggctattggcctcgccgagggttgcgacgaaatggtgcatgctgattctaaactggtctcctgtagacaagggagtggcaacatgaaggagtgcgtgactacaggaagggcccttctgcccagcgtaaatccaggccaggaggcatgtttgcactttaccgcccccgggtctcctgactccaagtgcctcaaaatcaaggtgaaacggatcaacctgaagtgtaaaaagtcaagtagctatttcgttccagatgctcgcaatagatgcacttcggtcaggcgttgtcggtgggcgggagactgccagtccggctgcccgccccactttacatctaacagcttctcagatgactgggcaggtaagatggaccgagccgggttaggatttagtggctgttccgatggttgcggcggggctgcctgtggatgcttcaatgcagccccttcttgtattttctggagaaaatgggtggaaaacagccatggcataatctggaaggtgtccccatgcgctgcctgggtcccctcagcagttattgagctgaccatgcctagcggggaagtgaggacgttccacccaatgagtggaatccccacccaggtgttcaaaggcgtatctgtcacatacctaggttccgacatggaggtgagcgggctcactgatctgtgtgaaattgaggagcttaagtcgaaaaagttggcgctggctccgtgcaaccaagccggaatgggcgttgtgggtaaagtcggcgaaatccagtgttcatctgaggaaagtgcacgcaccataaagaaggacgggtgcatctggaatgccgatctcgtgggaattgagctgcgggttgacgatgctgtgtgttattccaaaatcacaagcgtagaagccgtcgcaaactactctgctattcctactaccatcggcgggcttagatttgagaggagccatgactcccagggaaagatatcaggcagtccactggatattacagccatccgcggtagcttctctgtgaattaccgagggttgcggctctccctgtcagagattaccgcgacttgcacgggagaagtgacaaacgtcagtggctgctatagctgtatgaccggtgccaaagtttccatcaagttacactcttcgaaaaatagcactgctcacgtgcgttgcaagggcgacgagaccgcattttcagtactggaaggggtgcattcctacacagtcagtctatctttcgatcacgccgtggttgacgagcagtgtcaactcaactgcggaggccatgaaagccaggtgaccctgaaggggaatcttatatttttggatgtccccaaattcgtggacggatcctatatgcagacttaccactcaacagttcctacgggcgctaacatcccctctccaaccgactggctgaatgccctctttggtaacgggctgagcagatggattttaggagtgatcggcgtcctgcttggcgggttggcactcttctttctgattatgttcctatttaagctgggaactaaacaggtattcaggagtcgcacaaagctcgcgtga

SEQ ID NO: 11591 - RNA, 3222 nt, synthetic construct
  misc_feature 1..3222: note = derived and/or modified CDS sequence (opt3) from SFTSV/FTLSV(2011YPQ11)__KF711926.1__GP
  source 1..3222: mol_type = other RNA
atgatgaaggtgatctggttcagctccctggtctgcctcgttattcagtgttctggcgactcagggcccataatctgcgccggacctattcacagtaacaaaagcgctgcaatcccacatcttctgggttactccgagaagatttgtcaaatcgatagattgatacacgtgtcttcgtggttaaggaatcattcacagtttcagggctatgtagggcagcggggaggccgcagccaagtgagttactatccggccgaaaactcctactctcgatggagcggtctgctatccccctgcgacgcggattggctcgggatgctggtcgtgaaaaaggctaaaggatcagacatgatcgttcctggcccaagttataagggcaaggtgttctttgagcgtcccaccttcgatgggtacgtcggatggggttgtggcagcgggaaatctagaacagaatccggagagctttgctcaagcgacagtggcacttcttccggtctgttgcctagcgatagggtgctctggattggggacgtagcctgtcagccaatgacgcccatccctgaagagacctttctggagctgaagtcgttctctcagtccgaatttccagatatttgcaaaatcgacggaatagttttcaatcagtgtgagggcgaatcactcccgcaaccctttgatgtggcatggatggacgtcggccacagtcataagattatcatgcgggagcacaaaacaaagtgggtgcaggagagctcctctaaggatttcgtgtgctataaagaagggactggaccttgtagcgagtcagaagagaaggcctgcaaaaccagtggttcctgccgcggcgacatgcagttttgtaaggtcgctgggtgcgaacacggagaggaggcaagcgaagccaaatgtagatgctctttagttcataagccaggcgaggtggtagtgtcatacggtgggatgagggtccggcccaaatgttacggcttcagtcgcatgatggctacaatggaagtgaaccctccagagcagcgaattggacaatgcaccggctgtcacctggaatgcatcaatgggggagttagacttatcactttgacaagcgagctgaagtccgccaccgtgtgtgcgtctcatttttgctcgagcgcaacgtccggtaagaaatcaactgagattcacttccacagtggctctctagtcgggaagaccgccatacatgtgaaaggagctctcgtagacggcacagaatttacttttgagggtagctgtatgttccccgatgggtgcaacgccgttgactgcaccttttgtagggagttcctgaagaatccgcagtgctatcctgctaaaaagtggctttttatcattatcgtgatactgttgggctacgcaggactcatgctgttaacaaacgtcctgaaggccattggcgtgtgggggtcctgggtcatcgcgcccgtgaaactcatgttcgccatcatgaagaaacttatgcggaccgtttcatgtctggtgggaaagttgatggatcgtggtcgccaggtaattcacgaagaaatcggcgagaatggggagggaaaccatgacgatgtcagaattgaaatggcaaggccacggcgagtgcgccactggatgtatagccctgttatactaacgatcctggctattggcctcgccgagggttgcgacgaaatggtgcatgctgattctaaactggtctcctgtagacaagggagtggcaatatgaaggagtgcgtgactacaggaagggcccttctgcccagcgtaaacccaggccaggaggcatgtttgcactttaccgcccccgggtctcctgactccaagtgcctcaaaatcaaggtgaaacggatcaatctgaagtgtaaaaagtcaagtagctacttcgttccagatgctcgctatagatgcacttcggtcaggcgttgtccgtgggcgggagactgccagtccggctgtccccctcactttacatctaacagcttctcagatgactgggcaggtaagatggaccgggccgggttaggatttagtggctgctccgatggttgcggcggggctgcctgtggatgcttcaatgcagccccatcttgtattttctggcgaaaatgggtggaaaacagccatggcataatctggaaggtgtccccctgcgctgcctgggtcccttcagcagttattgagctgaccatgccaagcggggaagtgagaacgttccaccccatgagtggaatcccgacccaggtgttcaaaggcgtatctgtcacatacctaggttccgacatggaggtgagcgggctcactgatctgtgtgaaattgaggagcttaagtcgaaaaagttggcgctggctccttgcaaccaagccggaatgggcgttgtgggtaaagtcggcgaaatccagtgttcatctgaggaaagtgcaaggaccataaagaaggacgggtgcatctggaatgccgatctcgtgggaattgagctgcgcgttgacgatgctgtgtgttattccaaaatcacaagcgtagaagccgtcgcaaactactctgctattccaactaccatcggcgggcttcggtttgagagaagccatgactcccagggaaagatatcaggcagtcccctggatattacagccatcaggggtagcttctctgtgaattaccgcgggttgcgactctccctgtcagagattaccgcgacttgcacgggagaagtgacaaacgtcagtggctgctatagctgtatgaccggtgccaaagtttccatcaagttacactcttcgaaaaatagcactgctcacgtgcggtgcaagggcgacgagaccgcattttcagtactggaaggggtgcattcctacacagtcagtctatctttcgatcacgccgtggttgacgagcagtgtcaactcaactgcggaggccatgaaagccaggtgaccctgaaggggaatcttatatttttggatgtccctaaattcgtggacggatcctatatgcagacttaccactcaacagttcccacgggcgctaacatcccatctcctaccgactggctgaatgccctctttggtaacgggatgagccgttggattctgggagtgatcggcgtcttactgggcgggcttgcattgttctttctcattatgttcctgtttaagctaggaactaaacaggtattcagaagtaggacaaagctggcgtga

SEQ ID NO: 11592 - RNA, 3222 nt, synthetic construct
  misc_feature 1..3222: note = derived and/or modified CDS sequence (opt3) from SFTSV/FTLSV(2011YPQ12)__KF711930.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcaatagggtcttgtggatcggggacgtggcttgtcagccaatgacgcccattcctgaagagaccttcctcgagctgaagtcgttttctcagtccgaatttccagatatctgcaaaatagacggaattgtatttaaccagtgtgagggcgaatcactgccgcaacccttcgatgttgcctggatggacgtgggccacagtcataagatcattatgcgggagcacaaaacaaagtgggtccaggagagctcctctaaggattttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcagccagcctgagcaacgaatcggacagtgcactggctgtcacctggaatgcatcaatgggggagtgagacttattacattgacctccgagctgaagtctgccacggtttgtgcttcgcatttctgcagctccgccacttcaggtaagaaaagtaccgagatacagttccactctggcagcctagtggggaagacagcgatccacgtcaaaggagcactcgtggacggcactgaatttaccttcgagggttcctgtatgtttccagatgggtgcgacgccgtagattgcacattctgtagggaatttctgaagaacccccaatgctatccggctaaaaagtggcttttcattatcatagttattctgttgggctacgccggactcatgctgttaaccaatgtgctgaaggcaatcggcgtctgggggtcatgggtgatcgctcctgtcaaactcgtgtttgccattatcaagaaacttatgcgggcggttagctgtctgatgggaaagttgatggaccgtggtcgccaggtgattcatgaggaaataggcgagaacagagaggggaatcaggatgacgtaaggatcgaaatggcccggccccgacgcgtcagacactggatgtattctccagtgattctaacgatcctggcaatcggactcgctgagggctgcgatgaaatggttcatgccgactccaaactggtgagttgtaggcagggtagcgggaacatgaaggagtgcgtcactacaggccgggcccttctgcctgctgtgaatcccggacaagaggcatgtttgcacttcaccgccccaggctctcccgattccaagtgcctcaaaattaaggtaaaacgcataaacctgaagtgtaaaaagtcaagtagctactttgtgcctgttgctagatataggtgcacttcggtccgtcggtgtcgatgggcgggggactgccagtccggatgcccaccgcatttcacatctaatagcttttcagatgactgggcaggcaagatggacagagccggtttagggttcagtggatgttccgatggctgcggtggcgctgcctgtgggtgctttaacgcagccccctcttgtatcttctggaggaaatgggtggaaaatcctcacggaattatctggaaggtgagcccatgcgctgcctgggtcccctccgcagttattgagctgaccatgccttcaggcgaagtgcgcacgttccacccaatgagcgggatccccacccaggtgtttaaaggagtaagtgtcacatacctaggctctgacatggaggtgtccggtctcactgatctgtgtgaaatagaggagcttaagagcaaaaagttggcgctggctccgtgcaaccaggccgggatgggagttgtgggcaaagtcggtgaaatccaatgttcgtcagaggaatctgcacggaccattaagaaggacggctgcatctggaacgccgatctcgtggggattgagctgagagttgacgatgctgtgtgttatagtaaaatcacatccgtagaagccgtcgcaaattacagcgctatacctactaccattggaggccttaggttcgagcgctctcatgacagccaggggaagatctccggatcaccactggatattacagccatccgaggcagttttagcgtgaactaccggggtttgcgtctctctctgtccgagataaccgcgacttgcacgggggaagtgacaaatgtctcaggatgctatagttgtatgaccggcgccaaagttagcatcaagttacactcctctaaaaactcgactgctcatgtgagatgcaagggtgacgagaccgcattcagcgtactggaaggcgtgcactcatactccgtcagtctatcttttgatcacgccgtggttgacgagcagtgtcagctcaattgcgggggacatgaaagccaagtgacactgaggggcaaccttattttcttggatgtccccaagtttgtggacgggtcctatatgcagacctaccactcaactgttcctacaggagctaatatcccctctccaacggactggctgaacgccctcttcggcaatggtctgagccgctggattttaggggtgatcggagtcctgcttggcggcttggcactctttttcctgataatgagtctatttaaactggggaccaagcagattttccggtccagaactaaactcgcgtga

SEQ ID NO: 11593 - RNA, 3222 nt, synthetic construct
  misc_feature 1..3222: note = derived and/or modified CDS sequence (opt3) from SFTSV/FTLSV(2011YPQ17)__KF711923.1__GP
  source 1..3222: mol_type = other RNA
atgatgaaggtgatctggttcagctccctggtctgcctcgttattcagtgttctggcgactcagggcccataatctgcgccggacctattcacagtaacaaaagcgctgcaatcccacatcttctgggttactccgagaagatttgtcaaatcgatagattgatacacgtgtcttcgtggttaaggaatcattcacagtttcagggctatgtagggcagcggggaggccgcagccaagtgagttactatccggccgaaaactcctactctcgatggagcggtctgctatccccctgcgacgcggattggctcgggatgctggtcgtgaaaaaggctaaaggatcagacatgatcgttcctggcccaagttataagggcaaggtgttctttgagcgtcccaccttcgatgggtacgtcggatggggttgtggcagcgggaaatctagaacagaatccggagagctttgctcaagcgacagtggcacttcttccggtctgttgcctagcgatagggtgctctggattggggacgtagcctgtcagccaatgacgcccatccctgaagagacctttctggagctgaagtcgttctctcagtccgaatttccagatatttgcaaaatcgacggaatagttttcaatcagtgtgagggcgaatcactcccgcaaccctttgatgtggcatggatggacgtcggccacagtcataagattatcatgcgggagcacaaaacaaagtgggtgcaggagagctcctctaaggatttcgtgtgctataaagaagggactggaccttgtagcgagtcagaagagaaggcctgcaaaaccagtggttcctgccgcggcgacatgcagttttgtaaggtcgctgggtgcgaacacggagaggaggcaagcgaagccaaatgtagatgctctttagttcataagccaggcgaggtggtagtgtcatacggtgggatgagggtccggcccaaatgttacggcttcagtcgcatgatggctacaatggaagtgaaccctccagagcagcgaattggacaatgcaccggctgtcacctggaatgcatcaatgggggagttagacttatcactttgacaagcgagctgaagtccgccaccgtgtgtgcgtctcatttttgctcgagcgcaacgtccggtaagaaatcaactgagattcacttccacagtggctctctagtcgggaagaccgccatacatgtgaaaggagctctcgtagacggcacagaatttacttttgagggtagctgtatgttccccgatgggtgcaacgccctggactgcaccttttgtagggagttccttaagaatccgcactgctatcctgctaaaaagtggctgtttatcattatcgttatattgctcggctacgcaggactgatgttactgacaaacgtgctcaaggccattggcgtctgggggtcctgggtgatcgcgcccgtcaaacttatgttcgccatcatgaagaaactgatgcggaccgtgtcatgtttggttggaaagctaatggatcgtggtcgccaggtgattcatgaagaaatcggcgagaatggggagggaaaccacgacgatgtaagaattgaaatggcaaggccacggcgagtccgccattggatgtatagccctgtgatactgacgatcctcgctattggcctggccgagggttgcgacgaaatggttcacgctgattctaaacttgtgtcctgtagacaggggagtggcaatatgaaggagtgcgtcactacaggaagggccctgttgcccagcgtgaacccaggccaagaggcatgtctccactttaccgcccccgggtctcctgactccaagtgcctgaaaatcaaggtaaaacggatcaatttaaagtgtaaaaagtcaagtagctacttcgtgccagatgctcgcaacagatgcacttcggttaggcgttgtcggtgggcgggagactgccagtccggctgcccgccccattttacatctaatagcttctcagatgactgggcaggtaagatggaccgagccgggctgggatttagtggctgttccgatggttgcggcggggctgcctgtggatgcttcaacgcagccccttcttgtattttctggagaaaatgggtcgaaaacagccacggcataatctggaaggtgtccccatgcgctgcctgggtgccctcagcagtcattgagctaaccatgcctagcggggaagttaggacgttccatccaatgagtggaatccccacccaggtgttcaaaggcgtgtctgtaacatatctcggttccgacatggaggtcagcgggctgactgatctttgtgaaattgaggagttgaagtcgaaaaagctggcgctcgctccgtgcaatcaggccggaatgggcgtggttggtaaagtgggcgaaatccaatgttcatctgaggaaagtgcacgcaccataaagaaggacgggtgcatctggaacgccgatctggtcggaattgagcttcgggtggacgatgctgtttgttactccaaaatcacaagcgtggaagccgtagcaaattattctgctattcctactaccatcggcgggctgagatttgagaggagccacgactcccagggaaagatatcaggcagtccattggatattacagccatccgcggtagcttctctgtcaactaccgagggctccggctgtccttatcagagattaccgcgacttgcacgggagaagtgacaaatgtgagtggctgctacagctgtatgaccggtgccaaagtctccatcaagctgcactcttcgaaaaacagcactgctcatgttcgttgcaagggcgacgagaccgcattttcagtgctagaaggggtacactcctatacagtgagtctctctttcgatcatgccgtcgtggacgagcagtgtcagctgaattgcggaggccacgaaagccaagttacccttaaggggaacttgatatttctggatgtgcccaaattcgtcgacggatcctacatgcagacttatcattcaacagtgcctacgggcgctaatatcccctctccaaccgactggctcaacgccctgtttggtaatgggttaagcagatggattctgggagttatcggcgtgcttttgggcgggctcgcactgttctttctaattatgttcctgtttaagctcggaactaaacaggtcttcaggagtcgcacaaagctggcgtga

SEQ ID NO: 11594 - RNA, 3222 nt, synthetic construct
  misc_feature 1..3222: note = derived and/or modified CDS sequence (opt3) from SFTSV/FTLSV(2011YSC22)__KF711927.1__GP
  source 1..3222: mol_type = other RNA
atgatgaaggtgatctggttcagctccctggtctgcctcgttattcagtgttctggcgactcagggcccataatctgcgccggacctattcacagtaacaaaagcgctgcaatcccacatcttctgggttactccgagaagatttgtcaaatcgatagattgatacacgtgtcttcgtggttaaggaatcattcacagtttcagggctatgtagggcagcggggaggccgcagccaagtgagttactatccggccgaaaactcctactctcgatggagcggtctgctatccccctgcgacgcggattggctcgggatgctggtcgtgaaaaaggctaaaggatcagacatgatcgttcctggcccaagttataagggcaaggtgttctttgagcgtcccaccttcgatgggtacgtcggatggggttgtggcagcgggaaatctagaacagaatccggagagctttgctcaagcgacagtggcacttcttccggtctgttgcctagcgatagggtgctctggattggggacgtagcctgtcagccaatgacgcccatccctgaagagacctttctggagctgaagtcgttctctcagtccgaatttccagatatttgcaaaatcgacggaatagttttcaatcagtgtgagggcgaatcactcccgcaaccctttgatgtggcatggatggacgtcggccacagtcataagattatcatgcgggagcacaaaacaaagtgggtgcaggagagctcctctaaggatttcgtgtgctataaagaagggactggaccttgtagcgagtcagaagagaaggcctgcaaaaccagtggttcctgccgcggcgacatgcagttttgtaaggtcgctgggtgcgaacacggagaggaggcaagcgaagccaaatgtagatgctctttagttcataagccaggcgaggtggtagtgtcatacggtgggatgagggtccggcccaaatgttacggcttcagtcgcatgatggctacaatggaagtgaaccctccagagcagcgaattggacaatgcaccggctgtcacctggaatgcatcaatgggggagttagacttatcactttgacaagcgagctgaagtccgccaccgtgtgtgcgtctcatttttgctcgagcgcaacgtccggtaagaaatcaactgagattcacttccacagtggctctctagtcgggaagaccgccatacatgtgaaaggagctctcgtagacggcacagaatttacttttgagggtagctgtatgttccccgatgggtgcaacgccgttgactgcaccttttgtagggagttcctgaagaatccgcagtgctatcctgctaaaaagtggctttttatcattatcgtgatactgttgggctacgcaggactcatgctgttaacaaacgtcctgaaggccattggcgtgtgggggtcctgggtcatcgcgcccgtgaaactcatgttcgccatcatgaagaaacttatgcggaccgtttcatgtctggtgggaaagttgatggatcgtggtcgccaggtaattcacgaagaaatcggcgagaatggggagggaaaccatgacgatgtcagaattgaaatggcaaggccacggcgagtgcgccactggatgtatagccctgttatactaacgatcctggctattggcctcgccgagggttgcgacgaaatggtgcatgctgattctaaactggtctcctgtagacaagggagtggcaatatgaaggagtgcgtgactacaggaagggcccttctgcccagcgtaaacccaggccaggaggcatgtttgcactttaccgcccccgggtctcctgactccaagtgcctcaaaatcaaggtgaaacggatcaatgttaagtgtaaaaagtcaagtagctacttcgtcccagatgctcgcaacagatgcacttcggtgaggcgttgtcggtgggcgggagactgccagtccggctgcccgccccactttacatctaatagcttctcagatgactgggcaggtaagatggaccgagccgggctgggatttagtggctgttccgatggttgcggcggggctgcctgtggatgcttcaacgcagccccttcttgtattttctggagaaaatgggtggaaaacagccatggcataatctggaaggtctccccatgcgctgcctgggttccctcagcagtgattgagttaaccatgcctagcggggaagtgaggacgttccacccaatgagtggaatccccacccaggtattcaaaggcgtctctgtgacatatctgggttccgacatggaggttagcgggctaactgatctctgtgaaattgaggagctgaagtcgaaaaagttggcgcttgctccgtgcaatcaagccggaatgggcgtggtcggtaaagtgggcgaaatccagtgttcatctgaggaaagtgcacgcaccataaagaaggacgggtgcatctggaacgccgatctggttggaattgagctccgggtggacgatgctgtatgttactccaaaatcacaagcgtcgaagccgtggcaaattattctgctattcctactaccatcggcgggctgagatttgagaggagccatgactcccagggaaagatatcaggcagtccacttgatattacagccatccgcggtagcttctctgtgaactaccgagggctgcggttgtccctctcagagattaccgcgacttgcacgggagaagtcacaaatgttagtggctgctacagctgtatgaccggtgccaaagtgtccatcaagctgcactcttcgaaaaacagcactgctcacgtacgttgcaagggcgacgagaccgcattttcagtgttagaaggggtccattcctatacagtgagtctgtctttcgatcacgccgttgtggacgagcagtgtcaactaaattgcggaggccatgaaagccaggtcaccctcaaggggaacctgatatttcttgatgtgcccaaattcgttgacggatcctacatgcagacttatcactcaacagtgcctacgggcgctaatatcccctctccaaccgactggttgaacgccctgctcggtaatgggatgagcagatggattctgggagtcatcggcgtattactgggcgggcttgcattgtttttcctcattatgtttctgttcaagctaggaactaaacaggtgtttaggagtcgcacaaagctggcgtga

SEQ ID NO: 11595 - RNA, 3222 nt, synthetic construct
  misc_feature 1..3222: note = derived and/or modified CDS sequence (opt3) from SFTSV/FTLSV(2011YSC60)__KF711945.1__GP
  source 1..3222: mol_type = other RNA
atgatgaaggtgatctggttcagctccctgatttgcctcgtcatacagtgtggcggggacaccggacccatcatttgcgccggtcctatccactctaacaaatcagctgatattccacatcttctgggctacagtgagaagatctgtcaaatagacagattgatccacgttagctcctggttaaggaatcattctcagtttcaggggtatgtgggacagcggggcggtcgctcgcaagtatcatactatccggcagaaaacagctacagtcgatggtccgggctgctatctccctgcgatgccgactggctcggaatgctggtggtcaaaaaggcgaaaggcagcgatatgattgtgcctggcccatcctataaggggaaggttttctttgagcgtcccacattcgacggatacgtgggttggggctgtgggtcaggaaaaagtagaactgaaagcggcgagctttgttcttccgattcaggtacgagcagtgggctgttgccttctgacagggtcctctggatcggagatgtggcttgccagccaatgacccccattcctgaagagacatttctggagctgaagtccttcagccagtcggaatttccagacatctgcaaaatagatggcattgtattcaatcagtgtgagggcgaatctctcccgcaaccctttgacgttgcctggatggatgtggggcactcccataagatcattatgcgggagtataaaactaagtgggtccaggagtcaagtagcaaggacttcgtgtgctacaaagaaggaaccggtccttgttccgagtctgaagagaagacatgcaaaaccagcggctcatgccgcggggacatgcagttttgtaaggtggcaggatgcgaacacggcgaggaggccagtgaagctaaatgtagatgctccttagtccacaagccaggtgaggttgtggtaagctacgggggcatgagggtgcggcccaaatgttatggattctctcgcatgatggcaactctggaagtcaaccagcctgagcaacgaatcggccagtgcacagggtgtcatcttgaatgcatcaatggaggtgtgagattgattaccctgacgtcagagctaaagagtgccactgtttgtgctagccacttttgctcctctgccacctcgggcaagaaaagcacagagatacagttccattccgggtcactcgtgggaaagactgcgatccacgtcaaaggcgcactggtggatggtaccgagttcacatttgaagggagttgtatgttcccagacggctgcgatgccgtagactgcaccttttgtagggagttccttaagaacccccaatgctacccggctaaaaagtggctgtttattatcatagttattttgctcggatatgccggcctgatgttactgacgaatgtgctcaaggcaatcgggatctggggatcttgggtcattgctcctgtgaaacttatcttcgccattataaagaaactgatgcggactgtcagctgtttgatgggtaagctaatggatcgtggccgccaggtgatccacgaagaaattggggagaacagagagggaaatcaggacgatgttaggatcgaaatggcgcggccccgacgcgtgagacattggatgtactccccagtaatcctgacaattctcgccataggcctggcagagtcatgcgacgaaatggtccacgctgatagcaaacttgtgtcttgtaggcagggttccgggaacatgaaggagtgcgttaccactggccgggccctgttgcctgctgtgaatcccggacaagaggcctgtctccattttacagcaccaggcagtcccgacagcaagtgcctgcgcatcaaagtcaagagaattaacttaaaatgtaagaaatcttcctcatatttcgtgcctgatgccaggaatcgttgcaccagtgtacggcgatgtagatgggctggggactgccagagcggatgcccaccgcactttacgtcgaactccttctctgacgattgggcgggcaagatggacagggcaggtctggggtttagcggatgttcagatggctgcggtggcgccgcttgtgggtgcttcaatgccgcacccagttgtatcttttggcgcaagtgggtggaaaaccctcatggaattatctggaaagtttccccatgcgccgcttgggtcccctctgccgtgatagagctaaccatgcctagcggcgaagtgcggacattccacccaatgtccgggatccccactcaggtcttcaagggagtttcagtgacctacctcggcagcgacatggaggtgagtggtctgacagatctttgtgaaattgaggagttgaaatctaagaaactggcactcgcgccgtgcaaccaggctgggatgggagtagtcggcaaggtgggtgaaatccaatgttccagcgaggaatcggccagaactattaaaaaggacggctgcatctggaatgcagatctggttgggatagagcttagggtggacgatgccgtctgttattcaaagattacctctgtggaagctgttgccaactacagtgcaatccctacaaccattggaggcctgcgctttgagcgatcccacgacagccaggggaaaatctctggaagcccattggatataactgctatccggggctccttctcagtgaattaccgtggtctcagactgagtttaagcgagattacggccacatgcaccggggaagtaactaacgtctctggatgctattcctgtatgaccggcgcgaaggtgtcaatcaaactgcatagtagcaaaaattccacagcccacgtgaggtgcaagggtgacgagaccgctttttctgtcctagaaggcgttcattcgtacactgtgagcctctcattcgatcacgcagtagtggacgagcagtgtcagctgaactgcgggggacacgaatcccaagtcacacttaagggcaatttgatttttctggacgtgcccaagttcgttgatgggagttatatgcagacgtaccattctaccgtgcctactggagccaacatccccagcccaacagactggctcaatgctctgtttggcaacggtttatcccgctgggtcctgggggtgatgggagttcttttgggcggcctcgccctgttctttatgataatgtcactattcaaactggggaccaaacaggtgtttcggtctagaacaaagctcgcatga

SEQ ID NO: 11596 - RNA, 3222 nt, synthetic construct
  misc_feature 1..3222: note = derived and/or modified CDS sequence (opt3) from SFTSV/FTLSV(2011YSH45)__KF711947.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaaccagcctgagcaacgaatcggacagtgcactggctgtcacctggaatgcatcaatgggggagtgagacttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggatggcactgaatttaccttcgagggtagctgtatgtttccagacgggtgcgatgccgtagactgcacattctgtagggaatttctgaagaacccccaatgctatccggctaaaaagtggcttttcattatcatagttattctgttgggctacgccggactcatgctgttaaccaatgtgctgaaggcaatcggcatctgggggtcctgggtcattgctcctgtgaaactcatctttgccattataaagaaacttatgcggacggtctcatgtctgatgggaaagttgatggatcgtggtcgccaggtgatccatgaggaaattggcgagaacagagaggggaatcaggacgatgttaggatcgaaatggcgcggccccgacgcgtgagacactggatgtatagcccagtaatcctaactattctggccataggactcgcagagtcttgcgacgaaatggtccatgctgattccaaactggtgagttgtaggcagggcagcggtaacatgaaggagtgcgttacaaccgggcgggcccttctgcctgctgtgaatcccggccaagaggcctgtttgcacttcactgcaccaggatctcccgactccaagtgcctcaaaatcaaggtcaaacgcattaacctggaatgtaagaaatcaagtagctactttgtgcctgatgccagaaataggtgcacatcggtacgtcggtgtcgatgggctggcgactgccagtccgggtgcccaccgcatttcacctctaacagcttttcagacgattgggcgggaaagatggacagagcaggcttaggtttcagtgggtgttccgatggatgcggcggtgccgcttgtggctgctttaatgccgcaccctcttgtatcttctggaggaagtgggtggagaaccctcacgggattatctggaaagttagcccatgcgccgcttgggtcccctccgccgtgatagaactgacgatgccttcaggagaggtgcgcaccttccacccaatgagcggcatccccacacaggtctttaagggggttagtgtgacttatctaggatctgacatggaagtgtccggcctcaccgatctgtgtgagattgaggaacttaaaagcaagaaattggcactggcgccgtgcaaccaggctggtatgggggtagtcggaaaggtgggcgagatccaatgttcgtcagaagagtctgcccggacaattaaaaaggacggttgcatctggaatgcagatctcgttggcatagaactgagagtggacgatgccgtctgttacagtaagattacttccgtggaggctgttgccaactatagcgcaatccctaccacaattgggggacttaggttcgagcgctctcatgacagccagggcaaaatctccgggtcaccactggatataaccgctatccgaggaagttttagcgtgaattaccggggcttgcgtctctctctgtccgaaattactgccacgtgcacaggtgaggtaaccaacgtctcagggtgctacagttgtatgactggagcgaaggtgagcatcaaattacactcctctagaaattcgaccgcccatgtgaggtgcaagggcgacgaaacagctttcagcgtcctggagggtgttcactcatataccgtgtccctaagttttgatcacgcagtagtggacgaacagtgtcagctcaactgcggcgggcatgagtctcaagtcactctgaaaggaaatcttattttcttggacgtgcccaagtttgttgatggcagctacatgcagacatatcactccacggtgcctaccggggccaacatcccctcaccaactgactggctgaatgctctcttcggaaacggcctgtctcgctgggtcttaggtgtgatgggggttctgcttggaggcttggccctctttttcatgataatgagcctgtttaagctaggcacaaaacaggtgttccggagtagaaccaagctggcatga

SEQ ID NO: 11597 - RNA, 3222 nt, synthetic construct
  misc_feature 1..3222: note = derived and/or modified CDS sequence (opt3) from SFTSV/FTLSV(2011YSH52)__KF711928.1__GP
  source 1..3222: mol_type = other RNA
atgatgaaggtgatctggttcagctccctgatttgcctcgtcatacagtgtggcggggacaccggacccatcatttgcgccggtcctatccactctaacaaatcagctgatattccacatcttctgggctacagtgagaagatctgtcaaatagacagattgatccacgttagctcctggttaaggaatcattctcagtttcaggggtatgtgggacagcggggcggtcgctcgcaagtatcatactatccggcagaaaacagctacagtcgatggtccgggctgctatctccctgcgatgccgactggctcggaatgctggtggtcaaaaaggcgaaaggcagcgatatgattgtgcctggcccatcctataaggggaaggttttctttgagcgtcccacattcgacggatacgtgggttggggctgtgggtcaggaaaaagtagaactgaaagcggcgagctttgttcttccgattcaggtacgagcagtgggctgttgccttctgacagggtcctctggatcggagatgtggcttgccagccaatgacccccattcctgaagagacatttctggagctgaagtccttcagccagtcggaatttccagacatctgcaaaatagatggcattgtattcaatcagtgtgagggcgaatctctcccgcaaccctttgacgttgcctggatggatgtggggcactcccataagatcattatgcgggagcacaaaactaagtgggtccaggagtcaagtagcaaggacttcgtgtgctataaagaaggaaccggtccttgttccgagtctgaagagaagacatgcaaaaccagcggctcatgccgcggggacatgcagttttgtaaggtggcaggatgcgaacacggcgaggaggccagtgaagctaaatgtagatgctccttagtccataagccaggtgaggttgtggtaagctacgggggcatgagggtgcggcccaaatgttacggattctctcgcatgatggcaactctggaagtctcacagcctgagcaacgaatcggccagtgcacagggtgtcaccttgaatgcatcaacggaggtgtgagattgattaccctgacgagtgagctaaagagcgccactgtttgtgcttcccatttttgttcttcggccaccagcggcaagaaatccacagagatacagttccactcagggagtctcgtgggaaagactgcgatccacgtcaaaggcgcactggtggatggtaccgaatttacatttgaggggtcttgcatgttcccagacggctgcgatgccgtagactgcaccttttgtagggagttccttaagaatccccaatgctatccggctaaaaagtggctgtttattatcatagttattttgctcggatacgccggcttcatgctgttaacgaacgtgctgaaggcaatcggggtctggggaagctgggtgatcgctcctgtcaaactcgtgtttgccattatcaagaaacttatgcgggcggtttcctgtctgatgggtaagttgatggatcgtggccgccaggtgattcatgaagaaataggggagaatagagagggaaaccaggacgatgtaaggatcgaaatggcccggccccgacgcgtcagacactggatgtattcaccagtgattctaactatcctggcaatcggcctcgctgagggttgcgacgaaatggttcatgccgatagcaaactggtgtcttgtaggcaggggtccggcaatatgaaggagtgcgtcacaaccggacgggcccttctgcctgctgtgaaccccggccaagaggcatgtttgcacttcactgccccagggagtcccgacagcaagtgcctcaaaattaaggtaaaacgcataaataagaaatgtaagaagtcttcctcatactttgtgcctgatgctagatataggtgcacaagtgttcgtcggtgtcgatgggcgggagactgccagagcggctgcccaccgcatttcacctcgaactccttttctgacgattgggcaggtaaaatggacagagccgggctgggattcagcggctgttcagatggttgcggcggggctgcctgtggatgctttaatgcagcccccagttgtatcttctggaggaagtgggtcgaaaaccctcacggcattatctggaaagtgtccccatgcgctgcctgggtgccctctgcagtcattgagttaacgatgcctagcggggaagttcgcaccttccacccaatgtccggaatccccacacaggtgtttaagggcgtgtcagtaacttacctgggtagcgacatggaggtcagtgggctatctgatctctgtgaaatagaggagcttaattccaaaaagctggcgttggctccgtgcaaccaggccggaatgggcgtggttggtaaagtgggcgaaatccaatgtagctcggaggaatcagcacggaccattaagaaggacgggtgcatcagaaacgccgatctggtcggaattgaggtgagggttgacgatgctgtgttctattttaaaatcacatctgtagaagccgtcgcaaattacagtgctatacctactaccattggcgggctccgcttcgagcgatcccatgacagccagggaaagatctctggcagcccactggatattacagccatccggggttccttttcagtgaactaccgtgggcttagactgagtttgagcgagataaccgcgacttgtacgggagaagtgacaaatgtctctggctgctattcctgcatgaccggtgccaaagtttcaatcaagctccacagtagcaaaaactccactgctcatgtgaggtgtaagggcgacgagaccgcattctctgtactggaaggggtgcactcgtacagcgtctcattatcctttgatcacgccgtggttgacgagcagtgccagctgaattgtggaggccatgaaagtcaagtgacactacgcgggaacctcattttcctggacgtccccaagtttgtggatggatcttatatgcagacctaccacagcactgttcctacaggcgctaatatcccctccccaacggactggcttaacgccttgttcggtaatgggctgtcacggtggattctcggagtgatcggcgtcctgttaggcgggctggcacttttcttcttgatactctctctgtttaaactaggaaccaagcagattttcagaagcaggactaaactggcgtga

SEQ ID NO: 11598 - RNA, 3222 nt, synthetic construct
  misc_feature 1..3222: note = derived and/or modified CDS sequence (opt3) from SFTSV/FTLSV(2011YXX9)__KF711924.1__GP
  source 1..3222: mol_type = other RNA
atgatgaaggtgatctggttcagctccctggtctgcctcgttattcagtgttctggcgactcagggcccataatctgcgccggacctattcacagtaacaaaagcgctgcaatcccacatcttctgggttactccgagaagatttgtcaaatcgatagattgatacacgtgtcttcgtggttaaggaatcattcacagtttcagggctatgtagggcagcggggaggccgcagccaagtgagttactatccggccgaaaactcctactctcgatggagcggtctgctatccccctgcgacgcggattggctcgggatgctggtcgtgaaaaaggctaaaggatcagacatgatcgttcctggcccaagttataagggcaaggtgttctttgagcgtcccaccttcgatgggtacgtcggatggggttgtggcagcgggaaatctagaacagaatccggagagctttgctcaagcgacagtggcacttcttccggtctgttgcctagcgatagggtgctctggattggggacgtagcctgtcagccaatgacgcccatccctgaagagacctttctggagctgaagtcgttctctcagtccgaatttccagatatttgcaaaatcgacggaatagttttcaatcagtgggagggcgaatcactcccgcaaccctttgatgtggcatggatggacgtcggccacagtcataagattatcatgcgggagcacaaaacaaagtgggtgcaggagagctcctctaaggatttcgtgtgttataaagaagggactggaccttgcagcgagtcagaagagaaggcctgtaaaaccagtggttcctgccgcggcgacatgcagttttgcaaggtcgctgggtgtgaacacggagaggaggcaagcgaagccaaatgcagatgttctttagttcataagccaggcgaggtggtagtgtcatacggtgggatgagggtccggcccaaatgctacggcttcagtcgcatgatggctacaatggaagtgaaccctccagagcagcgaattggacaatgtaccggctgccacctggaatgtatcaatgggggagttagacttatcactttgacaagcgagctgaagtccgccaccgtgtgcgcgtctcatttttgttcgagcgcaacgtccggtaagaaatcaactgagattcacttccacagtggctctctagtcgggaagaccgccatacatgtgaaaggagctctcgtagacggcacagaatttacttttgagggtagctgcatgttccccgatgggtgtaacgccgttgactgcaccttttgcagggagttcctgaagaatccgcagtgttatcctgctaaaaagtggctttttatcattatcgtgatactgttgggctacgcaggactcatgctgttaacaaacgtcctgaaggccattggcgtgtgggggtcctgggtcatcgcgcccgtgaaactcatgttcgccatcatgaagaaacttatgcggaccgtttcatgcctggtgggaaagttgatggatcgtggtcgccaggtaattcacgaagaaatcggcgagaatggggagggaaaccatgacgatgtcagaattgaaatggcaaggccacggcgagtgcgccactggatgtatagccctgttatactaacgatcctggctattggcctcgccgagggttgtgacgaaatggtgcatgctgattctaaactggtctcctgcagacaagggagtggcaatatgaaggagtgtgtgactacaggaagggcccttctgcccagcgtaaacccaggccaggaggcatgcttgcactttaccgcccccgggtctcctgactccaagtgtctcaaaatcaaggtgaaacggatcaatctgaagtgcaaaaagtcaagtagctacttcgttccagatgctcgcaacagatgtacttcggtcaggcgttgccggtgggcgggagactgtcagtccggctgcccgccccactttacatctaatagcttctcagatgactgggcaggtaagatggaccgagccgggttaggatttagtggctgctccgatggttgtggcggggctgcctgcggatgtttcaacgcagccccttcttgcattttctggagaaaatgggtggaaaacagccatggcataatctggaaggtgtccccatgtgctgcctgggtcccctcagcagttattgagctgaccatgcctagcggggaagtgaggacgttccacccaatgagtggaatccccacccaggtgttcaaaggcgtatctgtcacatatctaggttccgacatggaggtgagcgggctcactgatctgtgcgaaattgaggagcttaagtcgaaaaagttggcgctggctccgtgtaatcaagccggaatgggcgttgtgggtaaagtcggcgaaatccagtgctcatctgaggaaagtgcacgcaccataaagaaggacgggtgtatctggaacgccgatctcgtgggaattgagctgcgggttgacgatgctgtgtgctactccaaaatcacaagcgtagaagccgtcgcaaattattctgctattcctactaccatcggcgggcttagatttgagaggagccatgactcccagggaaagatatcaggcagtccactggatattacagccatccgcggtagcttctctgtgaactaccgagggttgcggctctccctgtcagagattaccgcgacttgtacgggagaagtgacaaatgtcagtggctgctacagctgcatgaccggtgccaaagtttccatcaagttacactcttcgaaaaacagcactgctcacgtgcgttgtaagggcgacgagaccgcattttcagtactggaaggggtgcattcctatacagtcagtctatctttcgatcacgccgtggttgacgagcagtgccaactcaattgtggaggccatgaaagccaggtgaccctgaaggggaaccttatatttttggatgtccccaaattcgtggacggatcctacatgcagacttatcactcaacagttcctacgggcgctaatatcccctctccaaccgactggctgaacgccctctttggtaatgggctgagcagatggattttaggagtgatcggcgtcctgcttggcgggttggcactcttctttctgattatgttcctatttaagctgggaactaaacaggtattcaggagtcgcacaaagctcgcgtga

SEQ ID NO: 11599 - RNA, 3222 nt, synthetic construct
  misc_feature 1..3222: note = derived and/or modified CDS sequence (opt3) from SFTSV/FTLSV(2012YGS10)__KF711937.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaaccagcctgagcaacgaatcggacagtgcactggctgtcacctggaatgcatcaatgggggagtgagacttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggatggcactgaatttaccttcgagggtagctgtatgtttccagacgggtgcgatgccgtagactgcacattctgtagggaatttctgaagaacccccaatgctatccggctaaaaagtggcttttcattatcatagttattctgttgggctacgccggactcatgctgttaaccaatgtgctgaaggcaatcggcatctgggggtcctgggtcattgctcctgtgaaactcatctttgccattataaagaaacttatgcggacggtctcatgtctgatgggaaagttgatggatcgtggtcgccaggtgatccatgaggaaattggcgagaacagagaggggaatcaggacgatgttaggatcgaaatggcgcggccccgacgcgtgagacactggatgtatagcccagtaatcctaactgtcctggccattggactcgcagagtcttgcgacgaaatggtgcatgctgattccaaactggttagttgtaggcagggcagcggtaacatgaaggagtgcgtgacaaccgggcgggcccttctgcctgctgtcaatcccggccaagaggcctgtttgcacttcactgcaccaggatctcccgactccaagtgcctcaaaataaaggtgaaacgcatcaacctgaagtgtaaaaagtcaagtagctactttgtacctgatgccagatcgaggtgcacatccgtgcgtcggtgtcgatgggctggcgactgccagtctgggtgcccaccgcatttcaccagcaattcatttagtgacgattgggcgggaaagatggacagagcaggcttaggtttctccgggtgttctgatggatgcggcggtgccgcttgtggctgctttaacgccgcacccagctgtattttctggaggaaatgggttgaaaatcctcacgggatcatttggaaggtctccccatgcgccgcttgggtgccctcagccgtgatcgagctgacgatgcctagcggagaagtccgcaccttccacccaatgagtggcatacccacacaggtttttaaaggggtgtctgtgacttatctaggatccgacatggaggtaagcggcctcaccgatctgtgtgaaatcgaggagcttaagtcgaaaaagttggcactggcgccgtgcaaccaggctggtatgggggtcgtgggaaaagttggcgaaattcaatgttcatctgaggaaagtgcccggacaatcaagaaggacggttgcatttggaacgcagatctcgtgggcatcgagctgagagtcgacgatgccgtgtgttactccaaaataactagcgttgaagctgtggccaattattctgcaattcctaccacaatcgggggacttaggttcgagcgcagccatgactcccagggcaagatttcagggagtccactggatatcaccgctatacgaggcagcttttctgtaaactaccggggattgcgtctctccctgtcagagatcactgccacgtgcacaggtgaagtcaccaatgtgagtgggtgctacagctgtatgactggagcgaaagtgtccattaagttacactcttcgaaaaacagcaccgcccatgtcagatgcaagggcgacgagacagctttctcagttctggaaggtgtgcactcctataccgtaagtctatcttttgatcacgcagtggtcgacgagcagtgtcagctcaattgcggcgggcatgaaagccaagtgactctgaagggaaaccttatcttcttggacgttcccaaatttgtggatggctcctacatgcagacatatcactcaacggtccctaccggggccaatattccctctccaactgactggctgaacgctctcttcggaaatggcctgagtaggtggatcttaggtgtgataggggttctgcttggaggcttggccctctttttcatgattatgagcctgtttaagctaggcacaaaacaggtgttccgctcccggaccaagctggcatga

SEQ ID NO: 11600 - RNA, 3222 nt, synthetic construct
  misc_feature 1..3222: note = derived and/or modified CDS sequence (opt3) from SFTSV/FTLSV(2012YGS4)__KF711933.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaaccagcctgagcaacgaatcggacagtgcactggctgtcacctggaatgcatcaatgggggagtgagacttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggatggcactgaatttaccttcgagggtagctgtatgtttccagacgggtgcgatgccgtagactgcacattctgtagggaatttctgaagaacccccaatgctatccggctaaaaagtggcttttcattatcatagttattctgttgggctacgccggactcatgctgttaaccaatgtgctgaaggcaatcggcatctgggggtcctgggtcattgctcctgtgaaactcatctttgccattataaagaaacttatgcggacggtctcatgtctgatgggaaagttgatggatcgtggtcgccaggtgatccatgaggaaattggcgagaacagagaggggaatcaggacgatgttaggatcgaaatggcgcggccccgacgcgtgagacactggatgtatagcccagtaatcctaactattctggccataggactcgcagagtcttgcgacgaaatggtccatgctgattccaaactggtgagttgtaggcagggcagcggtaacatgaaggagtgcgttacaaccgggcgggcccttctgcctgctgtgaatcccggccaagaggcctgtttgcacttcactgcaccaggatctcccgactccaagtgcctcaaaatcaaggtcaaacgcattaacctgaagtgtaaaaagtcaagtagctactttgtgcctgatgccagatcgaggtgcacatccgtacgtcggtgtcgatgggctggcgactgccagtctgggtgcccaccgcatttcaccagcaattcatttagtgacgattgggcgggaaagatggacagagcaggcttaggtttctccgggtgttctgatggatgcggcggtgccgcttgtggctgctttaacgccgcacccagctgtatcttctggaggaaatgggtggaaaatcctcacgggattatctggaaggtttccccatgcgccgcttgggtcccctcagccgtgatagagctgacgatgcctagcggagaagtgcgcaccttccacccaatgagtggcatccccacacaggtctttaaaggggtttctgtgacttatctaggatccgacatggaggtgagcggcctcaccgatctgtgtgaaattgaggagcttaagtcgaaaaagttggcactggcgccgtgcaaccaggctggtatgggggtagtcggaaaagtgggcgaaatccaatgttcatctgaggaaagtgcccggacaattaagaaggacggttgcatctggaacgcagatctcgttggcatagagctgagagtggacgatgccgtctgttactccaaaattactagcgtggaagctgttgccaattattctgcaatccctaccacaattgggggacttaggttcgagcgcagccatgactcccagggcaagatctcagggataccactggatatcaccgctattcgaggaagttttagcgtgaactaccggggcttgcgtctctctctgtccgagatcactgccacgtgcacaggtgaagtaaccaatgtctcagggtgctacagttgtatgactggagcgaaagtgagcattaagttacactcctctaaaaactcgaccgcccatgtgagatgcaagggcgacgagacagctttcagcgtcctggaaggtgttcactcatataccgtgtccctaagttttgatcacgcagtagtggacgagcagtgtcagctcaattgcggcgggcatgaatctcaagtcactctgaagggaaaccttatcttcttggacgtgcccaaatttgttgatggcagctacatgcagacatatcactccacggtgcctaccggggccaatataccctcaccaactgactggctgaacgctctcttcggaaatggcctgtctaggtggattttaggtgtcatcggggtgctgcttggaggcttggccctctttttcatgatcatgagcctgtttaagctaggcacaaaacaggttttccgcagtcggaccaagctggcatga

SEQ ID NO: 11601 - RNA, 3222 nt, synthetic construct
  misc_feature 1..3222: note = derived and/or modified CDS sequence (opt3) from SFTSV/FTLSV(2012YSC6)__KF711931.1__GP
  source 1..3222: mol_type = other RNA
atgatgaaggtgatctggttcagctccctgatttgctttgtcatacagtgttctggcgggtcaggacccatcatttgcgccggtcctatccacagtaacaaaagcgctgacattccacatctccttggctactccgagaagatctgtcaaatagatagactgatccacgtttcttcgtggttgaggaatcattcacagttccaggggtatgtgggacagcggggcggtcgcagccaagtaagttactatccggcagaaaactcctactctcgatggagcgggttactgtccccctgcgacgccgattggctaggaatgctcgtggtcaaaaaggcgaaaggctcagacatgattgtgcctggcccaagttataaggggaaggttttcttcgagcgtcccacctttgatggatacgtgggttggggctgtgggagcggaaaatctagaacagaatccggcgagctgtgctcaagcgacagtggtacttcttccgggcttctgcctagcgatagggtcttgtggatcggagacgtggcttgtcagccaatgacgcccattcctgaagagaccttcctcgagctgaagtcgttttctcagtccgaatttccagatatctgcaaaatagacggcattgtatttaatcagtgtgagggcgaatcactgccgcaacccatcgatgttgcctggatggacgtggggcacagtcataagattatcatgcgggagcacaaaacaaagtgggtccaggagagctcctctaaggatttcgtgtgctataaagaaggaactggtccttgtagcgagtcagaagagaagacctgcaaaacaagtggctcctgccgcggggacatgcagttttgtaaggtggcaggatgcgaacacggcgaggaggccagcgaagctaaatgtagatgctctctcgtccataagccaggtgaggttgtggtatcatacgggggcatgagggtgcggcccaaatgttacggattcagtcgcatgatggcaaccttagaagtcaaccagcctgagcaacgaatcggccagtgcactgggtgtcacctggaatgcattaatggaggtgtgagacttataacattgaccagcgagctgaagtccgccacggtttgtgcttctcatttttgctcgagcgccacttccggcaagaaatcaaccgagatccagttccacagtgggtctctagtgggaaagacagcgattcacgtcaaaggcgcactcgtggacggtactgaatttacctttgaggggagctgtatgttcccagatggctgcgacgccgtagattgcacattttgtagggagttcctgaagaacccccaatgctatccggctaaaaagtggctttttatcataattgttatcctgttgggatacgccggcctcatgctgttaaccaatgtgctgaaggcaatcgggatttggggatcctgggtcatcgctcctgtgaaactcattttcgccataatcaagaaacttatgcggacggtctcatgtctgatgggtaagttgatggaccgtggccgccaggtgattcatgaagaaatcggggagaacagagagggaaatcaggatgacgttaggatcgaaatggcgcggccccgacgcgtgagacactggatgtatagcccagtaattctaactatactggccatcggcctcgcagagtcttgcgatgaaatggtccatgctgactccaaactggtgagttgtaggcagggtagcgggaacatgaaggagtgcgttacaaccggccgggcccttctgcctgctgtgaatcccggacaagaggcctgtttgcactttactgcaccaggctctcccgattccaagtgcctcaaaattaaggtcaaacgcatcaacctgaagtgtaaaaagtcaagtagctacttcgtgcctgacgccagatcgaggtgcacatccgtacgtcggtgtcgatgggctggggattgccagtctggatgcccaccgcattttaccagcaattcattcagtgacgactgggcgggcaagatggatagagcaggtttagggttttccggatgttctgacggctgcggtggcgccgcttgtgggtgcttcaacgccgcacccagctgtattttctggaggaaatgggtggaaaatcctcacggaatcatatggaaggtttccccatgcgccgcttgggtcccctcagccgtgatcgagctgacgatgcctagcggcgaagtgcgcaccttccacccaatgagtgggattcccacacaggtcttcaaaggagtttctgtgacttatctaggctccgatatggaggtgagcggtctcaccgacctgtgtgaaatcgaggagcttaagtcgaaaaagttggcactggcgccgtgcaaccaggctgggatgggagtagtcggcaaagtgggtgaaattcaatgttcatctgaggaaagtgcccggacaatcaagaaggatggctgcatatggaacgcagacctcgttgggattgagctgagagtggatgacgccgtctgttactccaaaatcactagcgtggaagctgttgccaattattctgcaattcctaccacaatcggaggccttaggtttgagcgcagccatgattcccaggggaagatatcaggaagtccactggacatcaccgctattcgaggcagcttctctgtgaactaccggggtttgcgtctctccctgtcagagatcactgccacgtgcacaggggaagtaaccaatgtcagtggatgctacagctgtatgactggcgcgaaagtgtccattaagttacactcttcgaaaaacagcaccgcccatgtgagatgcaagggtgatgagacagctttttcagtcctggaaggcgttcactcctataccgtgagtctatctttcgaccacgcagtagtggatgagcagtgtcagctcaattgcgggggacatgaaagccaagtcactctgaagggcaaccttatctttttggacgtgcccaaattcgttgacgggtcctacatgcagacatatcactcaacggtgcctaccggagccaatataccctctccaactgattggctgaacgctctctttggcaatggtctgagtaggtggattttaggggtcatcggagtgctgcttggcggcttggccctcttctttatgatcatgagcctgttcaagctagggacaaaacaggtttttcgctcccggaccaagctggcatga

SEQ ID NO: 11602 - RNA, 3222 nt, synthetic construct
  misc_feature 1..3222: note = derived and/or modified CDS sequence (opt3) from SFTSV/FTLSV(2012YSH10)__KF711940.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcaatagggtcttgtggatcggggacgtggcttgtcagccaatgacgcccattcctgaagagaccttcctcgagctgaagtcgttttctcagtccgaatttccagatatctgcaaaatagacggaattgtatttaaccagtgtgagggcgaatcactgccgcaacccttcgatgttgcctggatggacgtgggccacagtcataagatcattatgcgggagcacaaaacaaagtgggtccaggagagctcctctaaggattttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaatcagcctgagcaacgaatcggacagtgcactggctgtcacctggaatgcatcaacgggggagtgagacttattacattgaccagcgagctgaagtccgccacggtttgtgcttctcatttctgctcgagcgccatgtccggtaagaaatcaactgagatacagttccacagtggctctctagtggggaagaccgcgatccacgtcaaaggagcactcgtggacggcacagaatttactttcgagggtagctgtatgtttccagatgggtgcgacgccgtagattgcaccttctgtagggaatttctgaagaatccccaatgctatccggctaaaaagtggcttttcattatcatagttattctgttgggctacgccggactcatgctgttaacaaacgtgctgaaggcaatcggcatctgggggtcctgggtcattgctcctgtgaaactcatctttgccattataaagaaacttatgcggaccgtctcatgtctgatgggaaagttgatggaccgtggtcgccaggtgatccatgaggaaattggcgagaatagagaggggaaccaggatgacgttaggatcgaaatggcgcggccccgacgcgtgagacactggatgtatagcccagtaatcctaacgattctggccataggactcgcagagtcttgcgatgaaatggtccatgctgactccaaactggtgagttgtaggcagggcagcggtaatatgaaggagtgcgttactacagggcgggcccttctgcctgctgtgaaccccggccaagaggcctgtttgcacttcaccgcaccaggatctcccgattccaagtgcctccgcatcaaagtcaagagaattaatctgaaatgtaagaaatcaagtagctactttgtgcctgacgccaggtcgcgttgcacttccgtacggcgatgtagatgggctggcgattgccagtctgggtgcccaccgcatttcacaagcaactcatttagtgacgactgggcgggaaagatggatagggcaggcttaggtttctccgggtgttctgacggatgcggcggtgccgcttgtggctgctttaatgccgcacccagctgtatcttctggcgcaagtgggtggaaaaccctcacgggattatctggaaagtttccccatgcgccgcttgggtcccctcagccgtgatagagctgaccatgcctagcggagaagtgcggacgttccacccaatgagtggcatccccacccaggtctttaagggggtttctgtgacatatctaggatccgatatggaggtgagcggcctcactgacctgtgtgaaattgaggagcttaaatcgaagaaattggcactggcgccgtgcaaccaggctggtatgggggtagtcggaaaggtgggcgaaatccaatgttcatctgaggaaagtgccagaaccattaaaaaggatggttgcatctggaatgcagacctcgttggcatagagctgagggtggatgacgccgtctgttactccaagattacaagcgtggaagctgttgccaactattctgcaatccctactaccattgggggacttcgcttcgagcgaagccatgattcccagggcaaaatctcagggagtccactggacataacagctatccggggcagcttttctgtgaattaccgtggattgagactctccctgtcagagattaccgccacttgcacgggtgaagtaacaaacgtcagtgggtgctacagctgtatgaccggagcgaaggtgtccatcaaattacactcttcgaagaatagcactgcccatgtgaggtgcaaaggcgatgagaccgctttctcagtcctggaaggtgttcactcctatacagtgagtctatcttttgaccacgcagtagtggatgagcagtgtcagctcaactgcggcgggcatgaaagccaagtcaccctgaagggaaatcttattttcttggacgtgcccaagtttgttgacggctcctacatgcagacttatcactcaacagtgcctacgggggccaacatcccctctccaaccgattggctgaatgctctcttcggaaacggcctgagccgctgggtcttaggtgtgatgggggttctgcttggaggcttggccctctttttcatgataatgagtctgtttaaactaggcactaaacaggtgttccggtccagaacaaagctggcatga

SEQ ID NO: 11603 - RNA, 3222 nt, synthetic construct
  misc_feature 1..3222: note = derived and/or modified CDS sequence (opt3) from SFTSV/FTLSV(2012YSH104)__KF711943.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcaatagggtcttgtggatcggggacgtggcttgtcagccaatgacgcccattcctgaagagaccttcctcgagctgaagtcgttttctcagtccgaatttccagatatctgcaaaatagacggaattgtatttaaccagtgtgagggcgaatcactgccgcaacccttcgatgttgcctggatggacgtgggccacagtcataagatcattatgcgggagcacaaaacaaagtgggtccaggagagctcctctaaggattttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaatcagcctgagcaacgaatcggacagtgcactggctgtcacctggaatgcatcaacgggggagtgagacttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggacggcactgaatttaccttcgagggtagctgtatgtttccagatgggtgcgacgccgtagattgcacattctgtaggaagtttctgaaaaatccccaatgctatccggctaagaagtggcttttcattatcatagttattctgttgggctacgccggactcatgctgttaaccaacgtgctgaaagcaatcggcatctgggggtcctgggtcattgctcctgtgaagctcatctttgccattataaagaaacttacgcggactgtctcatgtctgatgggaaaattgatggaccgtggtcgccaggtgatccatgaagagattggcgaaaatagagaggggaaccaggatgacgttaggatcgagatggcgcggccccgacgcgtgagacactggatgtatagcccagtaatcctaacaattctggccataggactcgcagaatcttgcgatgagatggtccatgctgactccaagctggtgagttgtaggcagggcagcggtaatatgaaggaatgcgttaccactgggcgggcccttctgcctgctgtgaaccccggccaagaggcctgtttgcacttcacagcaccaggatctcccgattccaaatgcctccgcatcaaggtcaaaagaattaatctgaagtgtaaaaagtcaagtagctactttgtgcctgacgccaggtatcgttgcacctcggtacggcgatgtagatgggctggcgattgccagtccgggtgcccaccgcatttcacgtctaacagcttttcagacgactgggcgggaaagatggatagggcaggcttaggtttcagtgggtgttccgacggatgcggcggtgccgcttgtggctgctttaatgccgcaccctcttgtatcttctggcgcaaatgggtggagaaccctcacgggattatctggaaggttagcccatgcgccgcttgggtcccctccgccgtgatagaactgaccatgccttcaggagaggtgcggacattccacccaatgagcggcatccccactcaggtctttaaaggggttagtgtgacctacctaggatctgatatggaagtgtccggcctcacagacctgtgtgagattgaggaacttaagagcaaaaagttggcactggcgccgtgcaaccaggctggtatgggggtagtcggaaaagtgggcgagatccaatgttcgtcagaagagtctgccagaactattaagaaggatggttgcatctggaatgcagacctcgttggcatagaactgagggtggatgacgccgtctgttatagtaaaattacctccgtggaggctgttgccaactacagcgcaatccctacaaccattgggggacttcgcttcgaacgatctcatgatagccagggcaagatctccgggtcaccactggacataactgctatccggggaagttttagcgtgaattaccgtggcttgagactctctctgtccgagattacggccacatgcaccggtgaggtaactaacgtctcagggtgctatagttgtatgaccggagcgaaagtgagcatcaagttacactcctctaaaaattcgacagcccatgtgaggtgcaagggcgatgaaaccgctttcagcgtcctggagggtgttcactcatacactgtgtccctaagttttgaccacgcagtagtggatgaacagtgtcagctcaactgcggcgggcatgagtctcaagtcacactgaagggaaatcttattttcttggacgtgcccaaatttgttgacggcagctatatgcagacgtaccactccaccgtgcctactggggccaacatcccctcaccaacagattggctgaatgctctcttcggaaacggcctgtctcgctgggtcttaggtgtgatgggggttctgcttggaggcttggccctctttttcatgataatgagcctgtttaagctaggcaccaaacaggtgttccggagtagaacaaagctggcatga

SEQ ID NO: 11604 - RNA, 3222 nt, synthetic construct
  misc_feature 1..3222: note = derived and/or modified CDS sequence (opt3) from SFTSV/FTLSV(2012YSH105)__KF711944.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcaatagggtcttgtggatcggggacgtggcttgtcagccaatgacgcccattcctgaagagaccttcctcgagctgaagtcgttttctcagtccgaatttccagatatctgcaaaatagacggaattgtatttaaccagtgtgagggcgaatcactgccgcaacccttcgatgttgcctggatggacgtgggccacagtcataagatcattatgcgggagcacaaaacaaagtgggtccaggagagctcctctaaggattttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaatcagcctgagcaacgaatcggacagtgcactggctgtcacctggaatgcatcaacgggggagtgagacttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggacggcactgaatttaccttcgagggtagctgtatgtttccagatgggtgcgacgccgtagattgcacattctgtagggaatttctgaagaatccccaatgctatccggctaaaaagtggcttttcattatcatagttattctgttgggctacgccggactcatgctgttaaccaacgtgctgaaggcaatcggcatctgggggtcctgggtcattgctcctgtgaaactcatctttgccattataaagaaacttatgcggacggtctcatgtctgatgggaaagttgatggaccgtggtcgccaggtgatccatgaggaaattggcgagaatagagaggggaaccaggatgacgttaggatcgaaatggcgcggccccgacgcgtgagacactggatgtatagcccagtaatcctaactattctggccataggactcgcagagtcttgcgatgaaatggtccatgctgactccaaactggtgagttgtaggcagggcagcggtaatatgaaggagtgcgttacaaccgggcgggcccttctgcctgctgtgaaccccggccaagaggcctgtttgcacttcactgcaccaggatctcccgattccaagtgcctccgcatcaaagtcaagagaattaatctgaaatgtaagaaatcaagtagctactttgtgcctgacgccaggtcgcgttgcacatccgtacggcgatgtagatgggctggcgattgccagtctgggtgcccaccgcatttcaccagcaactcatttagtggagactgggcgggcaagatggacagggcaggtttagggttctccggatgttctgatggctgcggtggcgccgcttgtgggtgctttaatgccgcacccagctgtatcttctggcgcaagtgggtggaaaaccctcacggaattatctggaaagtttccccatgcgccgcttgggtcccctcagccgtgatagagctgacgatgcctagcggcgaagtgcggaccttccacccaatgagtgggatccccacacaggtctttaagggagtttctgtgacttatctaggctccgacatggaggtgagcggtctcaccgatctgtgtgaaattgaggagcttaaatcgaagaaattggcactggcgccgtgcaaccaggctgggatgggagtagtcggcaaggtgggtgaaatccaatgttcatctgaggaaagtgccagaacaattaaaaaggacggctgcatctggaatgcagatctcgttgggatagagctgagggtggacgatgccgtctgttactccaagattactagcgtggaagctgttgccaactattctgcaatccctaccacaattggaggccttcgcttcgagcgaagccatgactcccaggggaaaatctcaggaagtccactggatataaccgctatccggggcagcttttctgtgaattaccgtggtttgagactctccctgtcagagattactgccacgtgcacaggggaagtaaccaacgtcagtggatgctacagctgtatgactggcgcgaaggtgtccatcaaattacactcttcgaagaatagcaccgcccatgtgaggtgcaaaggtgacgagacagctttctcagtcctggaaggcgttcactcctataccgtgagtctatcttttgatcacgcagtagtggacgagcagtgtcagctcaactgcgggggacatgaaagccaagtcactctgaagggcaatcttattttcttggatgtgcccaagtttgttgacgggtcctacatgcagacatatcactcaacggtgcctaccggagccaacatcccctctccaactgactggctgaatgctctcttcggcaacggtctgagccgctggatattaggggtcatgggagtgctgcttggcggcttggccctctttttcatgattatgagtctgtttaaactagggacaaagcaggttttccggtccagaaccaaactggcatga

SEQ ID NO: 11605 - RNA, 3222 nt, synthetic construct
  misc_feature 1..3222: note = derived and/or modified CDS sequence (opt3) from SFTSV/FTLSV(2012YSH107)__KF711942.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcaatagggtcttgtggatcggggacgtggcttgtcagccaatgacgcccattcctgaagagaccttcctcgagctgaagtcgttttctcagtccgaatttccagatatctgcaaaatagacggaattgtatttaaccagtgtgagggcgaatcactgccgcaacccttcgatgttgcctggatggacgtgggccacagtcataagatcattatgcgggagcacaaaacaaagtgggtccaggagagctcctctaaggattttgtgtgctataaagaagggactggaccttgtagcgagtcagaagagaagaccggtaaaacaagtggctcctgccgcggggacatgcagttctgcaaggtggcaggatgtgaacacggcgaggaggccagcgaagctaaatgcagatgttctctcgtccataagccaggtgaggttgtggtatcatacgggggcatgagggtgcggcccaaatgctacggatttagtcgcatgatggcaaccttagaagtcaatcagcctgagcaacgaatcggccagtgtactgggtgccacctggaatgtatcaacggaggtgtgagacttattacattgaccagcgagctgaagtccgccacggtttgcgcttctcatttctgttcgagcgccacttccggcaagaaatcaaccgagatacagttccacagtgggtctctagtgggaaagacagcgatccacgtcaaaggcgcactcgtggacggtactgaatttaccttcgaggggagctgcatgtttccagatggctgtgacgccgtagattgcacattctgcagggaatttctgaagaatccccaatgttatccggctaaaaagtggcttttcattatcatagttattctgttgggatacgccggcctcatgctgttaaccaacgtgctgaaggcaatcgggatctggggatcctgggtcattgctcctgtgaaactcatctttgccattataaagaaacttatgcggacggtctcatgcctgatgggtaagttgatggaccgtggccgccaggtgatccatgaggaaattggggagaatagagagggaaaccaggatgacgttaggatcgaaatggcgcggccccgacgcgtgagacactggatgtatagcccagtaatcctaactattctggccataggcctcgcagagtcttgtgatgaaatggtccatgctgactccaaactggtgagttgcaggcagggtagcgggaatatgaaggagtgtgttacaaccggccgggcccttctgcctgctgtgaaccccggacaagaggcctgcttgcacttcactgcaccaggctctcccgattccaagtgtctccgcatcaaagtcaagagaattaatctgaaatgcaagaaatcaagtagctactttgtgcctgacgccaggtatcgttgtacatcggtacggcgatgcagatgggctggggattgtcagtccggatgcccaccgcatttcacctctaacagcttttcagacgactgggcgggcaagatggatagggcaggtttagggttcagtggatgctccgacggctgtggtggcgccgcttgcgggtgttttaatgccgcaccctcttgcatcttctggcgcaagtgggtggaaaaccctcacggaattatctggaaagttagcccatgtgccgcttgggtcccctccgccgtgatagagctgacgatgccttcaggcgaagtgcggaccttccacccaatgagcgggatccccacacaggtctttaagggagttagtgtgacttacctaggctctgatatggaggtgtccggtctcaccgacctgtgcgaaattgaggagcttaaaagcaagaaattggcactggcgccgtgtaaccaggctgggatgggagtagtcggcaaggtgggtgaaatccaatgctcgtcagaggaatctgccagaacaattaaaaaggatggctgtatctggaatgcagacctcgttgggatagagctgagggtggatgacgccgtctgctatagtaagattacttccgtggaagctgttgccaactacagcgcaatccctaccacaattggaggccttcgcttcgagcgatctcatgatagccaggggaaaatctccggatcaccactggacataaccgctatccggggcagttttagcgtgaattaccgtggtttgagactctctctgtccgagattactgccacgtgtacaggggaagtaaccaacgtctcaggatgctatagttgcatgactggcgcgaaggtgagcatcaaattacactcctctaaaaattcgaccgcccatgtgaggtgtaagggtgatgagacagctttcagcgtcctggaaggcgttcactcatacaccgtgtccctaagttttgaccacgcagtagtggatgagcagtgccagctcaactgtgggggacatgaatctcaagtcactctgaagggcaatcttattttcttggacgtgcccaagtttgttgacgggagctatatgcagacataccactccacggtgcctaccggagccaacatcccctcaccaactgattggctgaatgctctcttcggcaacggtctgtctcgctgggtcttaggggtgatgggagttctgcttggcggcttggccctctttttcatgataatgagcctgtttaaactagggacaaaacaggtgttccggagtagaaccaagctggcatga

SEQ ID NO: 11606 - RNA, 3222 nt, synthetic construct
  misc_feature 1..3222: note = derived and/or modified CDS sequence (opt3) from SFTSV/FTLSV(2012YSH14)__KF711938.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaaccagcctgagcaacgaatcggacagtgcactggctgtcacctggaatgcatcattgggggagtgagacttataacattgaccagcgagctgaagtccgccacggtttgtgcttctcatttctgctcgagcgccacttccggtaagaaatcaaccgagatccagttccacagtggctctctagtggggaagacagcgattcacgtcaaaggagcactcgtggatggcactgaatttaccttcgagggtagctgtatgtttccagacgggtgcgatgccgtagactgcacattctgtagggaatttctgaagaatccccaatgctatccggctaaaaagtggcttttcatcataattgttatcctgttgggctacgccggactcatgctgttaaccaacgtgctgaaggcaatcggcatttgggggtcctgggtcatcgctcctgtgaaactcatttttgccataatcaagaaacttatgcggacggtctcatgtctgatgggaaagttgatggatcgtggtcgccaggtgattcatgaggaaatcggcgagaatagagaggggaaccaggacgatgttaggatcgaaatggcgcggccccgacgcgtgagacactggatgtatagcccagtaattctaactatactggccatcggactcgcagagtcttgcgacgaaatggtccatgctgattccaaactggtgagttgtaggcagggcagcggtaatatgaaggagtgcgttacaaccgggcgggcccttctgcctgctgtgaaccccggccaagaggcctgtttgcacttcactgcaccaggatctcccgactccaagtgcctcaaaattaaggtcaaacgcatcaatctgaagtgtaaaaagtcaagtagctactttgtgcctgatgccagatcgaggtgcacatccgtacgtcggtgtcgatgggctggcgactgccagtctgggtgcccaccgcatttcaccagcaactcatttagtgacgattgggcgggaaagatggacagagcaggcttaggtttctccgggtgttctgatggatgcggcggtgccgcttgtggctgctttaatgccgcacccagctgtattttctggaggaaatgggtggaaaaccctcacgggatcatatggaaggtttccccatgcgccgcttgggtcccctcagccgtgatcgagctgacgatgcctagcggagaagtgcgcaccttccacccaatgagtggcattcccacacaggtctttaaaggggtttctgtgacttatctaggatccgacatggaggtgagcggcctcaccgatctgtgtgaaatcgaggagcttaagtcgaaaaagttggcactggcgccgtgcaatcaggctggtatgggggtagtcggaaaagtgggcgaaattcaatgttcatctgaggaaagtgcccggacaatcaagaaggacggttgcatatggaacgcagatctcgttggcattgagctgagagtggacgatgccgtctgttactccaaaatcactagcgtggaagctgttgccaactattctgcaattcctaccacaatcgggggacttaggttcgagcgcagccatgactcccagggcaagatatcagggagtccactggatatcaccgctattcgaggcagcttttctgtgaattaccggggattgcgtctctccctgtcagagatcactgccacgtgcacaggtgaagtaaccaacgtcagtgggtgctacagctgtatgactggagcgaaagtgtccattaagttacactcttcgaaaaatagcaccgcccatgtgagatgcaagggcgacgagacagctttctcagtcctggaaggtgttcactcctataccgtgagtctatcttttgatcacgcagtagtggacgagcagtgtcagctcaactgcggcgggcatgaaagccaagtcactctgaagggaaatcttatcttcttggacgtgcccaaatttgttgatggctcctacatgcagacatatcactcaacggtgcctaccggggccaacataccctctccaactgactggctgaatgctctcttcggaaacggcctgagtaggtggattttaggtgtcatcggggtgctgcttggaggcttggccctctttttcatgatcatgagcctgtttaagctaggcacaaaacaggttttccgctcccggaccaagctggcatga

SEQ ID NO: 11607 - RNA, 3222 nt, synthetic construct
  misc_feature 1..3222: note = derived and/or modified CDS sequence (opt3) from SFTSV/FTLSV(2012YSH16)__KF711934.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaaccagcctgagcaacgaatcggacagtgcactggctgtcacctggaatgcatcaatgggggagtgagacttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggatggcactgaatttaccttcgagggtagctgtatgtttccagacgggtgcgatgccgtagactgcacattctgtagggaatttctgaagaacccccaatgctatccggctaaaaagtggcttttcattatcatagttattctgttgggctacgccggactcatgctgttaaccaatgtgctgaaggcaatcggcatctgggggtcctgggtcattgctcctgtgaaactcatctttgccattataaagaaacttatgcggacggtctcatgtctgatgggaaagttgatggatcgtggtcgccaggtgatccatgaggaaattggcgagaacagagaggggaatcaggacgatgttaggatcgaaatggcgcggccccgacgcgtgagacactggatgtatagcccagtaatcctaactattctggccataggactcgcagagtcttgcgacgaaatggtccatgctgattccaaactggtgagttgtaggcagggcagcggtaacatgaaggagtgcgttacaaccgggcgggcccttctgcctgctgtgaatcccggccaagaggcctgtttgcacttcactgcaccaggatctcccgactccaagtgcctcaaaatcaaggtcaaacgcattaacctgaagtgtaaaaagtcaagtagctactttgtgcctgatgccagatataggtgcacatcggtacgtcggtgtcgatgggctggcgactgccagtccgggtgcccaccgcatttcacctctaatagcttttcagacgattgggcgggaaagatggacagagcaggcttaggtttcagtgggtgttccgatggatgcggcggtgccgcttgtggctgctttaacgccgcaccctcttgtatcttctggaggaaatgggtggaaaatcctcacgggattatctggaaggttagcccatgcgccgcttgggtcccctccgccgtgatagagctgacgatgccttcaggagaagtgcgcaccttccacccaatgagcggcatccccacacaggtctttaaaggggttagtgtgacttacctaggatctgacatggaggtgtccggcctcaccgatctgtgtgaaattgaggagcttaagagcaaaaagttggcactggcgccgtgcaaccaggctggtatgggggtagtcggaaaagtgggcgaaatccaatgttcgtcagaggaatctgcccggacaattaagaaggacggttgcatctggaacgcagatctcgttggcatagagctgagagtggacgatgccgtctgttatagtaaaattacttccgtggaagctgttgccaattacagcgcaatccctaccacaattgggggacttaggttcgagcgctctcatgacagccagggcaagatctccgggtcaccactggatataaccgctatccgaggaagttttagcgtgaactaccggggcttgcgtctctctctgtccgagattactgccacgtgcacaggtgaagtaaccaatgtctcagggtgctatagttgtatgactggagcgaaagtgagcatcaagttacactcctctaaaaactcgaccgcccatgtgagatgcaagggcgacgagacagctttcagcgtcctggaaggtgttcactcatacaccgtgtccctaagttttgatcacgcagtagtggacgagcagtgtcagctcaattgcggcgggcatgaatctcaagtcactctgaagggaaaccttattttcttggacgtgcccaaatttgttgatggcagctatatgcagacataccactccacggtgcctaccggggccaatatcccctcaccaactgactggctgaacgctctcttcggaaatggcctgtctaggtggatattaggtgtcattggggtgctgcttggaggcttggccctctttttcatgatcatgagcctgtttaagctaggcacaaaacaggttttccgcagtcggaccaagctggcatga

SEQ ID NO: 11608 - RNA, 3222 nt, synthetic construct
  misc_feature 1..3222: note = derived and/or modified CDS sequence (opt3) from SFTSV/FTLSV(2012YSH6)__KF711921.1__GP
  source 1..3222: mol_type = other RNA
atgatgaaggtgatctggttcagctccctgatttgcctcgtcatacagtgttctggcgactcagggcccatcatttgcgccggacctatccacagtaacaaaagcgctggtattccacatcttctgggctactccgagaagatctgtcaaatagatagattgatccacgtttcttcgtggttaaggaatcattcacagtttcaggggtatgtgggacagcggggcggtcgcagccaagtaagttactatccggcagaaaactcctactctcgatggaatgggctgctaagcccctgcgacgccgattggctcggaatgctggtggtcaaaaaggcgaaagagtccgacatgattgtgcctggcccatcatataagggcaaggttttctttgaacgtcccaccttcgatgggtacgtgggatggggttgtggcagtgggaaaagcagaacagagtctggagaactttgctcctcagacagcggcacttcctctggtctgttgccttccgatagggtcctctggatcggggacgtggcttgtcagccaatgacgcccattcctgaggagacctttctggaacttaagagcttctcgcagtctgagtttccagatatctgcaaaatagacggaattgtattcaaccagtgtgaaggcgagtccctcccgcaaccctttgatgttgcctggatggacgtgggccactcacataagatcattatgcgggagcacaaaacaaagtgggtccaggaaagtagctccaaggatttcgtgtgctataaagaggggactggaccttgttctgaaagcgaggaaaaggcatgcaaaacctcaggtagttgccgcggcgacatgcagttttgtaaggtggccgggtgcgagcacggagaggaggcttccgaagcaaaatgtagatgcagcttagtccataagccaggcgaagttgtggtatcttacggtgggatgagggtgcggcccaaatgttacggcttctcacgcatgatggccacactggaggtcaatcctccagaacagcgaatcggacaatgcaccggctgtcaccttgagtgcatcaacgggggagtgagattgattactctgacaagtgagctaaggagcgctaccgtttgtgcctcccatttttgttcttcggcgacgagcggtaagaagtccactgaaatacacttccactcaggcagtctcgtggggaaaaccgcaatccatgtcaagggagccctggtggacggcacagagttcacttttgaaggttcttgcatgttccccgatgggtgcgacgctgtagattgcaccttttgtcgggagttccttaaaaatccgcagtgctatcctgccaagaaatggctgtttattatcatagttattttgctcggctacgcaggactgatgttagtgacaaacgtcctgaaggctatcggcgtgtgggggagctgggtcatcgcccccgtgaagctcatgttcgcgattatcaaaaagctgatgcgtaccgtttcctgtctggtgggaaaattgatggaccgcggtagacaggtaattcacgaagagataggcgagaatggggaaggaaaccaagatgacgtcaggatcgagatggcccggccacgacgcgtgagacattggatgtattcacctgttattctaacgatcctggcaatcggcctcgctgaaggttgcgatgagatggtgcacgccgacagcaagctggtctcttgtaggcaggggtccggcaatatgaaagagtgcattactacaggacgggcccttctgcccgctgtgaacccaggccaggaagcatgtttgcattttaccgcccccgggagtcctgatagcaagtgcctcaagataaaagtaaagcgcatcaatctgaaatgtaagaaatcttcctcatacttcgtgccagacgctagaagtaggtgcactagcgttcgtcggtgtcgatgggcgggagattgccagtcgggctgcccgccccactttacatccaactctttcagcgacgactgggcaggtaagatggatagagccgggttaggattttcaggctgtagtgacggttgcggcggggctgcctgtggatgcttcaatgcagccccttcctgtatcttttggaggaagtgggtcgagaacccacacggcattatttggaaagtgtctccctgcgctgcctgggtgcctagcgcagtcatcgaactgaccatgccatccggggaggttcgcacgttccatcccatgtcaggaataccgacccaagtgttcaagggcgtgagcgtaacatatctaggtagtgatatggaagtctctgggctcactgacctgtgtgagatcgaggaacttaaatccaagaaattggcgctggctccttgcaaccaggccggaatgggcgtggttggtaaggtgggcgagattcagtgtagctcggaagagtcagcacggaccatcaaaaaggatgggtgcatttggaatgccgacctcgtcggaatcgaactgagagtggatgacgctgtttgttactctaagataacaagtgtggaggccgtagcaaactattccgctattccaactaccatcggcgggcttaggtttgagcgcagccacgattctcagggaaaaattagcggcagtcccctggacatcacagccatacgaggttcattcagtgtcaattaccgggggttgcgtctcagcctgtctgaaatcaccgcgacttgcacgggagaggtgacaaacgtgtccggctgctactcatgtatgaccggtgccaaggtcagtattaaattacatagctccaaaaattctactgctcacgttagatgcaagggcgatgaaaccgcattttcggtgctggagggggtacacagctatatcgtgtcactatccttcgaccatgccgtcgtggatgaacaatgtcagctcaactgcggaggccacgagagtcaggttacactgaaggggaatcttatctttttggacgtgcctaagttcgtcgacggatcttacatgcagacctatcatagcactgtgcccacaggcgctaacattccatcccctacggattggctgaatgccctctttggtaacgggctgtcaaggtggatattaggagttattggcgtgctgcttggcgggttggcactcttctttctgatcatgttcctactgaaactcggaaccaagcaagtctttcgctctcggactaaactggcgtga

SEQ ID NO: 11609 - RNA, 3222 nt, synthetic construct
  misc_feature 1..3222: note = derived and/or modified CDS sequence (opt3) from SFTSV/FTLSV(2012YSH86)__KF711939.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgtcacggctttagtcgcatgatggcaaccttagaagtcaaccagcctgagcaacgaatcggacagtgcactggctgtcatctggaatgcatcaatgggggagtgagacttattacattgaccagcgagctgaagtccgccacggtttgtgcttctcacttctgctcgagcgccacttccggtaagaaatcaaccgagatacagttccacagtggctctctagtggggaagacagcgatccatgtcaaaggagcactcgtggatggcactgaatttaccttcgagggtagctgtatgtttccagacgggtgcgatgccgtagactgcacattctgtagggaatttctgaagaacccccaatgctacccggctaaaaagtggcttttcattatcatagttattctgttgggctatgccggactcatgctgttaaccaatgtgctgaaggcaatcggcatctgggggtcctgggtcattgctcctgtgaaactcatgtttgccatcattaagaaacttatgcggacggtctcatgtctgatgggaaagttgatggatcgtggtcgccaggtgatacacgaggaaatcggcgagaacagagaggggaatcaggacgatgttaggattgaaatggcgcggccccgacgcgtgagacattggatgtacagcccagtaatcctaactatcctggccattggactcgcagagtcttgcgacgaaatggtccacgctgattccaaactggtgagttgtaggcagggcagcggtaacatgaaggagtgcgttacaaccgggcgggcccttctgcctgctgtgaatcccggccaagaggcctgtttgcatttcactgcaccaggatctcccgactccaagtgcctcaaaataaaggtcaaacgcatcaacctgaagtgtaaaaagtcaagtagctattttgtgcctgatgccagatcgaggtgcacatccgtacgtcggtgtcgatgggctggcgactgccagtctgggtgcccaccgcacttcaccagcaattcatttagtgacgattgggcgggaaagatggacagagcaggcttaggtttctccgggtgttctgatggatgcggcggtgccgcttgtggctgctttaacgccgcacccagctgtattttctggaggaaatgggtggaaaatcctcacgggatcatttggaaggtttccccatgcgccgcttgggtcccctcagccgtgatcgagctgacgatgcctagcggagaagtgcgcaccttccatccaatgagtggcatacccacacaggtctttaaaggggtttctgtgacttacctaggatccgacatggaggtgagcggcctcaccgatctgtgtgaaatcgaggagcttaagtcgaaaaagttggcactggcgccgtgcaaccaggctggtatgggggtagtcggaaaagtgggcgaaattcaatgttcatctgaggaaagtgcccggacaatcaagaaggacggttgcatttggaacgcagatctcgttggcatcgagctgagagtggacgatgccgtctgttattccaaaataactagcgtggaagctgttgccaattactctgcaattcctaccacaatcgggggacttaggttcgagcgcagccacgactcccagggcaagatttcagggagtccactggatatcaccgctatacgaggcagcttttctgtgaactatcggggattgcgtctctccctgtcagagatcactgccacgtgcacaggtgaagtaaccaatgtcagtgggtgctacagctgtatgactggagcgaaagtgtccattaagttacattcttcgaaaaacagcaccgcccacgtgagatgcaagggcgacgagacagctttctcagtcctggaaggtgttcactcctacaccgtgagtctatcttttgatcatgcagtagtggacgagcagtgtcagctcaattgcggcgggcacgaaagccaagtcactctgaagggaaaccttatcttcttggacgtgcccaaatttgttgatggctcctatatgcagacataccattcaacggtgcctaccggggccaatattccctctccaactgactggctgaacgctctcttcggaaatggcctgagtaggtggatcttaggtgtcataggggtgctgcttggaggcttggccctctttttcatgattatgagcctgtttaagctaggcacaaaacaggttctgcgctcccggaccaagctcgcatga

SEQ ID NO: 11610 - RNA, 3222 nt, synthetic construct
  misc_feature 1..3222: note = derived and/or modified CDS sequence (opt3) from SFTSV/FTLSV(2012YSH89)__KF711935.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaaccagcctgagcaacgaatcggacagtgcactggctgtcacctggaatgcatcaatgggggagtgagacttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggatggcactgaatttaccttcgagggtagctgtatgtttccagacgggtgcgatgccgtagactgcacattctgtagggaatttctgaagaacccccaatgctatccggctaaaaagtggcttttcattatcatagttattctgttgggctacgccggactcatgctgttaaccaatgtgctgaaggcaatcggcatctgggggtcctgggtcattgctcctgtgaaactcatctttgccattataaagaaacttatgcggacggtctcatgtctgatgggaaagttgatggatcgtggtcgccaggtgatccatgaggaaattggcgagaacagagaggggaatcaggacgatgttaggatcgaaatggcgcggccccgacgcgtgagacactggatgtatagcccagtaatcctaactattctggccataggactcgcagagtcttgcgacgaaatggtccatgctgattccaaactggtgagttgtaggcagggcagcggtaacatgaaggagtgcgttacaaccgggcgggcccttctgcctgctgtgaatcccggccaagaggcctgtttgcacttcactgcaccaggatctcccgactccaagtgcctcaaaatcaaggtcaaacgcattaacctgaagtgtaaaaagtcaagtagctactttgtgcctgatgccagatcgaggtgcacatccgtacgtcggtgtcgatgggctggcgactgccagtctgggtgcccaccgcatttcaccagcaattcatttagtgacgattgggcgggaaagatggacagagcaggcttaggtttctccgggtgttctgatggatgcggcggtgccgcttgtggctgctttaacgccgcacccagctgtatcttctggaggaaatgggtggaaaatcctcacgggattatctggaaggtttccccatgcgccgcttgggtcccctcagccgtgatagagctgacgatgcctagcggagaagtgcgcaccttccacccaatgagtggcatccccacacaggtctttaaaggggtttctgtgacttatctaggatccgacatggaggtgagcggcctcaccgatctgtgtgaaattgaggagcttaagtcgaaaaagttggcactggcgccgtgcaaccaggctggtatgggggtagtcggaaaagtgggcgaaatccaatgttcatctgaggaaagtgcccggacaattaagaaggacggttgcatctggaacgcagatctcgttggcatagagctgagagtggacgatgccgtctgttactccaaaattactagcgtggaagctgttgccaattattctgcaatccctaccacaattgggggacttaggttcgagcgcagccatgactcccagggcaagatctcagggagtccactggatataaccgctatccgaggcagcttttctgtgaactaccggggattgcgtctctccctgtcagagattactgccacgtgcacaggtgaagtaaccaatgtcagtgggtgctacagctgtatgactggagcgaaagtgtccatcaagttacactcttcgaaaaacagcaccgcccatgtgagatgcaagggcgacgaggctgcattctcagtcctggaaggtgttcactcctatacagtgagtctatcttttgatcacgccgtagtggacgagcagtgtcagctcaattgcggcgggcatgaaagccaagtcaccctgaagggaaaccttattttcttggacgtgcccaaatttgttgatggctcctacatgcagacttatcactcaacagtgcctacgggggctaatatcccctctccaaccgactggctgaacgccctcttcggaaatggcctgagtaggtggatattaggtgtcattggggtgctgcttggaggcttggcactctttttcatgatcatgagcctgtttaagctaggcactaaacaggttttccgctcccggacaaagctggcgtga

SEQ ID NO: 11611 - RNA, 3222 nt, synthetic construct
  misc_feature 1..3222: note = derived and/or modified CDS sequence (opt3) from SFTSV/FTLSV(2012YSH9)__KF711919.1__GP
  source 1..3222: mol_type = other RNA
atgatgaaggtgatctggttcagctccctgatttgcctcgtcatacagtgttctggcgactcagggcccatcatttgcgccggacctatccacagtaacaaaagcgctggtattccacatcttctgggctactccgagaagatctgtcagatagatagattgatccacgtttcttcgtggttaaggaatcattcacagtttcaggggtatgtgggacagcggggcggtcgcagccgagtaagttactatccggcagaaaactcctactctcgttggagcgggctgctatccccctgcgacgccgattggctcggaatgctggtggtcaaaaaggcgaaagagtcagacatgattgtgcctggcccaagttataagggcaaggttttctttgaaagacccaccttcgatgggtacgtgggatggggttgtggcagcgggaaatctaggacagagtccggagaactttgctcaagcgacagtggcacttcttccggtctgttgcctagcgatcgggtcctctggatcggggacgtggcttgtcaaccaatgacgcccattcctgaggagacctttctggaactgaagtcgttctctcagtccgagtttccagatatctgcaaaatagacggaattgtattcaatcagtgtgaaggcgagtcactcccgcagccctttgatgttgcctggatggacgtgggccacagtcataagatcattatgcgcgagcacaaaacaaagtgggtccaagaaagctcctctaaggatttcgtgtgctataaagaggggactggaccttgtagcgaatcagaggaaaaggcatgcaaaaccagtggttcctgcagaggcgacatgcagttttgtaaggtggccgggtgcgagcacggagaggaagctagcgaggcaaaatgtaggtgctctttagtccataagccaggcgaagttgtggtatcatacggtgggatgcgggtgcgccccaaatgttacggcttcagtcgaatgatggccacactggaggtcaacagacctgaacagaggatcggacagtgcaccggctgtcaccttgagtgcatcaatgggggagtgcggttgattactctgacaagcgagctacgttccgctaccgtttgtgcctctcatttttgctcgagcgcgacgtccggtaagaagaacactgaaatacacttccactcaggcagtctcgtggggaaaaccgcaatccatgtcaagggagccctggtggacggcacagagttcacttttgaaggttcttgtatgttcccagatgggtgcgacgctgtagattgcaccttttgtcgcgagttccttaaaaatccccaatgctatccggccaagaaatggctgtttattatcatagttattttgctcggctacgcaggactgatgttactgacaaacgtgctcaaggctatcggcgtctgggggagctgggtgatcgcccctgtcaaacttatgttcgcgattatcaagaagctgatgagaaccgtgtcctgtttggttggaaaactaatggacaggggtagacaggtgattcacgaagagataggcgagaatggggaaggaaaccaggatgacgtacgaatcgagatggcccgccccagaagggtccggcattggatgtattcaccagtgattctgacgatcctcgcaatcggcctggctgaaggttgcgatgagatggttcacgccgacagcaaacttgtgtcttgtcgccaagggtccggcaatatgaaggagtgcattactacaggacgggctctgttgcctgccgtcaaccccggccaggaagcatgtctccattttaccgccccagggagtcccgatagcaagtgcctgaagataaaagtgaagaggatcaatttaaaatgtaagaaatcttcctcatacttcgtacctgacgctcgtagtcggtgcactagcgtgcgaagatgtaggtgggcgggagattgccagtcgggctgcccaccgcactttacatccaactctttcagcgacgactgggcaggtaagatggatcgcgccgggctgggattttcaggctgtagtgacggttgcggcggggctgcctgtggatgcttcaatgcagccccctcctgtatcttttggcggaagtgggttgagaaccctcacggcattatttggaaagtctctccatgcgctgcctgggtgcccagcgcagtgatcgaactaaccatgccttccggggaggtcagaacgttccatccaatgtcaggaatacccacccaggttttcaagggcgtgagcgtgacatatctcggtagtgatatggaagtatctgggctgactgacctttgtgagatcgaggaattgaaatccaagaaactggcgctcgctccgtgcaaccaagccggaatgggcgtcgtgggtaaggttggcgagattcagtgtagctcggaagagtcagcaaggaccatcaaaaaggatgggtgcatttggaatgccgacctggtgggaatcgaacttcgcgtcgatgacgctgtgtgttactctaagataacaagtgttgaggccgtggcaaactattccgctattcctactaccatcggcgggctgcgatttgagcggagccacgattctcagggaaaaattagcggctccccattggacatcacagccatacgtggttcattcagtgtaaattacagagggctcaggctgagcttatctgaaatcaccgcgacttgcacgggagaggtcacaaacgtgtccggctgctactcatgtatgaccggtgccaaggtgagtattaaactgcatagctccaaaaattctactgctcacgtccgctgcaagggcgatgaaaccgcattttcggttctagagggggtgcacagctatatcgtatcactctccttcgaccatgccgtggtcgatgaacagtgtcaactgaactgcggaggccacgagagtcaggtgacacttaaggggaatttgatttttctggacgttcccaagttcgtggacggatcttacatgcagacctatcatagcactgtccctacaggcgctaacatcccctccccaacggattggctcaatgccctgtttggtaacgggttatcacggtggatactgggagtgattggcgttcttttgggcgggctcgcactgttctttctaatcatgttcctgctcaaactgggaaccaagcaagtgtttagatctaggactaaacttgcgtga

SEQ ID NO: 11612 - RNA, 3222 nt, synthetic construct
  misc_feature 1..3222: note = derived and/or modified CDS sequence (opt3) from SFTSV/FTLSV(2012YSH91)__KF711920.1__GP
  source 1..3222: mol_type = other RNA
atgatgaaggtgatctggttcagctccctgatttgcctcgtcatacagtgttctggcgactcagggcccatcatttgcgccggacctatccacagtaacaaaagcgctggtattccacatcttctgggctactccgagaagatctgtcaaatagatagattgatccacgtttcttcgtggttaaggaatcattcacagtttcaggggtatgtgggacagcggggcggtcgcagccaagtaagttactatccggcagaaaactcctactctcgatggagcgggctgctatccccctgcgacgccgattggctcggaatgctggtggtcaaaaaggcgaaagagtcagacatgattgtgcctggcccaagttataagggcaaggttttctttgaacgtcccaccttcgatgggtacgtgggatggggttgtggcagcgggaaatctagaacagagtccggagaactttgctcaagcgacagtggcacttcttccggtctgttgcctagcgatagggtcctctggatcggggacgtggcttgtcagccaatgacgcccattcacgaggagacctttctggaactgaagtcgttctctcagtccgagtttcctgatatctgcaaaatagacggaattgtattcaatcagtgtgaaggcgagtcactcccacaaccgtttgatgttgcctggatggacgtgggccatagtcacaagatcattatgcgggagcacaaaacaaagtgggtccaggaaagctcctctaaggatttcgtgtgctataaagaggggactggaccctgtagcgaatcagaggaaaaggcatgcaaaaccagtggttcctgccgcggcgacatgcagttttgtaaggtggccgggtgcgagcatggagagaaagctagcgaaacaaagtgtagatgctctttagtccacaaacctggcgaggttgtggtatcatacggtgggatgagggtgcggccaaagtgttacggcatcagtcgcatgatggcaaccctggaagtcaatccccctgagcagcgaatcggacaatgcactggctgtcatcttgaatgcattaacgggggagtgagattgataacactgaccagcgagctaaggtccgccacggtttgtgcttctcacttctgctcgagcgcctcctcaggtaagaaaagtactgagatccactttcattctggcagcctcgtggggaagaccgcgattcacgtcaaaggagcactggtggacggcacagagttcactttcgaaggttcctgtatgtttccagatgggtgcgacgccgtagattgcaccttctgtcgggaatttcttaagaacccccagtgctatccggctaaaaagtggctgttcatcataattgttatcttgctcggctacgccggactgatgttactgacaaatgtgctcaaggcaatcggcgtctgggggtcatgggtgattgctcctgtcaaacttatgtttgccatcattaagaaactgatgcgtaccgtgagctgtttggttggaaagctaatggaccgcggtagacaggtgatacatgaggaaatcggcgagaacggggagggaaatcaagatgacgtaaggattgaaatggcgcggccccgacgcgtcagacactggatgtattctccagtgatcctgacgatcctcgccattggcctggcagagggttgcgatgaaatggttcatgctgactccaaacttgtgagttgtaggcaggggagcggcaacatgaaggagtgcataactacaggacgggccctgttgcctgctgtcaatcccggccaggaggcctgtctccacttcaccgcaccagggtctcccgattccaagtgcctgaaaatcaaggtgaaacgcattaacatcaagtgtaaaaagtcaagtagctactttgtaagagacgccaggtcgcgttgcacttccgtgcggcgatgtagatgggctggagattgccagtctggctgccctccacacttcacaagcaattcatttagtgacgactgggcgggtaagatggatagggcagggttaggattctccggctgttctgacggttgcggcggggccgcttgtggatgctttaacgccgcaccgagctgtattttctggcgcaaatgggttgaaaatccccatggcatcatatggaaggtctccccttgcgccgcttgggtgccatcagccgtgatcgagctgaccatgcccagcggggaagtccggacgtttcaccctatgagtggcattccaacccaagttttcaaaggagtgtctgtgacatatctaggttccgatatggaggtaagcgggctcactgacctgtgtgaaatcgaggagcttaagtcgaaaaagttggcactggcgccctgcaaccaggctggaatgggcgtcgtgggtaaagttggcgaaaagcagtgttcatctgaggaaagtgccagaaccattaagaaagatgggtgcatctggaacgcagacctcgtgggaatagagctgagggtcgatgacgccgtgtgttactccaagattacaagcgttgaagctgtggccaattattctgcaatcccgactaccattggcgggcttcgcttcgagcgaagccatgattcccagggaaaaatctcaggcagtcctctggacataacagctatccggggtagcttttctgtaaactaccgtgggttgagactctccctgtcagagattaccgccacttgcacgggagaagtcacaaatgtgagtggctgctacagctgtatgaccggtgcgaaggtgtccatcaaattacactcttcgaagaacagcactgcccacgtcaggtgcaagggcgatgagaccgctttctcagttctggaaggggtgcattcctatattgtaagtctatcttttgaccacgcagtggtcgatgagcaatgtcagctcaattgcggaggccatgaaagccaggtgacactgaaagggaaccttatcttcttggacgttccaaagtttgtggacggatcctacatgcagacctatcactcaactgtccccacaggcgccaatataccttctcccacggattggctgaacgctctcttcggtaatgggctgagccgctggattttaggagtgatcggcgttctgcttggcgggttggccctctttttcctgatcatgtttctactgaaactcggaaccaagcaagtgttccggagtagaactaaactggcatga

SEQ ID NO: 11613 - RNA, 3222 nt, synthetic construct
  misc_feature 1..3222: note = derived and/or modified CDS sequence (opt3) from SFTSV/FTLSV(2012YSH92)__KF711941.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcccactctcgatggagcggtttactgtccccctgcgatgccgactggctagggatgctcgtggtcaaaaaggcgaaaggatcagatatgattgtgcctggcccaagttacaagggcaaggttttcttcgagcgtcccacctttgacgggtatgtgggatggggttgtggcagcgggaaatctagaacagaatccggagagctgtgctcaagcgatagtggcacttcttccggtcttctgcctagcaatagggtcttgtggatcggggacgtggcttgtcagccaatgacgcccattcctgaagagaccttcctcgagctgaagtcgttttctcagtccgaatttccagatatctgcaaaatagacggaattgtatttaaccagtgtgagggcgaatcactgccgcaacccttcgatgttgcctggatggacgtgggccatagtcacaagatcattatgcgggagcacaaaacaaagtgggtccaggagagctcctctaaggattttgtgtgctacaaagaagggactggaccttgtagcgagtcagaagagaagacctgcaaaacaagtggttcctgccgcggcgacatgcagttctgtaaggtggcagggtgcgaacatggagaggaggccagcgaagctaaatgtagatgctctctcgtccacaagccaggcgaggttgtggtatcatatggtgggatgagggtgcggcccaaatgttacggctttagtcgcatgatggcaaccttagaagtcaatcagcctgagcaacgaatcggacagtgcactggctgtcatctggaatgcatcaacgggggagtgagacttattacattgaccagcgagctgaagtccgccacggtttgtgcttctcacttctgctcgagcgccacttccggtaagaaatcaaccgagatacagttccacagtggctctctagtggggaagacagcgatccatgtcaaaggagcactcgtggacggcactgaatttaccttcgagggtagctgtatgtttccagatgggtgcgacgccgtagattgcacattctgtagggaatttctgaagaatccccaatgctacccggctaaaaagtggcttttcattatcatagttattctgttgggctatgccggactcatgctgttaaccaacgtgctgaaggcaatcggcatctgggggtcctgggtcattgctcctgtgaaactcatctttgccattataaagaaacttatgcggacggtctcatgtctgatgggaaagttgatggaccgtggtcgccaggtgatccacgaggaaattggcgagaatagagaggggaaccaggatgacgttaggatcgaaatggcgcggccccgacgcgtgagacattggatgtacagcccagtaatcctaactattctggccataggactcgcagagtcttgcgatgaaatggtccacgctgactccaaactggtgagttgtaggcagggcagcggtaatatgaaggagtgcgttacaaccgggcgggcccttctgcctgctgtgaaccccggccaagaggcctgtttgcatttcactgcaccaggatctcccgattccaagtgcctccgcatcaaagtcaagagaattaatctgaaatgtaagaaatcaagtagctattttgtgcctgacgccaggtcgcgttgcacatccgtacggcgatgtagatgggctggcgattgccagtctgggtgcccaccgcacttcaccagcaactcatttagtgacgactgggcgggaaagatggatagggcaggcttaggtttctccgggtgttctgacggatgcggcggtgccgcttgtggctgctttaatgccgcacccagctgtatcttctggcgcaagtgggtggaaaaccctcacgggattatctggaaagtttccccatgcgccgcttgggtcccctcagccgtgatagagctgacgatgcctagcggagaagtgcggaccttccatccaatgagtggcatccccacacaggtctttaagggggtttctgtgacttacctaggatccgatatggaggtgagcggcctcaccgacctgtgtgaaattgaggagcttaaatcgaagaaattggcactggcgccgtgcaaccaggctggtatgggggtagtcggaaaggtgggcgaaatccaatgttcatctgaggaaagtgccagaacaattaaaaaggatggttgcatctggaatgcagacctcgttggcatagagctgagggtggatgacgccgtctgttattccaagattactagcgtggaagctgttgccaactactctgcaatccctaccacaattgggggacttcgcttcgagcgaagccacgattcccagggcaaaatctcagggagtccactggacataaccgctatccggggcagcttttctgtgaattatcgtggattgagactctccctgtcagagattactgccacgtgcacaggtgaagtaaccaacgtcagtgggtgctacagctgtatgactggagcgaaggtgtccatcaaattacattcttcgaagaatagcaccgcccacgtgaggtgcaaaggcgatgagacagctttctcagtcctggaaggtgttcactcctacaccgtgagtctatcttttgaccatgcagtagtggatgagcagtgtcagctcaactgcggcgggcacgaaagccaagtcactctgaagggaaatcttattttcttggacgtgcccaagtttgttgacggctcctatatgcagacataccattcaacggtgcctaccggggccaacatcccctctccaactgattggctgaatgctctcttcggaaacggcctgagccgctgggtcttaggtgtgatgggggttctgcttggaggcttggccctctttttcatgataatgagtctgtttaaactaggcacaaaacaggtgttccggtccagaaccaagctggcatga

SEQ ID NO: 11614 - RNA, 3222 nt, synthetic construct
  misc_feature 1..3222: note = derived and/or modified CDS sequence (opt3) from SFTSV/FTLSV(2012YSH93)__KF711946.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcaatagggtcttgtggatcggggacgtggcttgtcagccaatgacgcccattcctgaagagaccttcctcgagctgaagtcgttttctcagtccgaatttccagatatctgcaaaatagacggaattgtatttaaccagtgtgagggcgaatcactgccgcaacccttcgatgttgcctggatggacgtgggccacagtcataagatcattatgcgggagcacaaaacaaagtgggtccaggagagctcctctaaggattttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaatcagcctgagcaacgaatcggacagtgcactggctgtcacctggaatgcatcaacgggggagtgagacttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggacggcactgaatttaccttcgagggtagctgtatgtttccagatgggtgcgacgccgtagattgcacattctgtagggaatttctgaagaatccccaatgctatccggctaaaaagtggcttttcattatcatagttattctgttgggctacgccggactcatgctgttaaccaacgtgctgaaggcaatcggcatctgggggtcctgggtcattgctcctgtgaaactcatctttgccattataaagaaacttacgcggactgtctcatgtctgatgggaaagttgatggaccgtggtcgccaggtgatccatgaggaaattggcgagaatagagaggggaaccaggatgacgttaggatcgaaatggcgcggccccgacgcgtgagacactggatgtatagcccagtaatcctaacaattctggccataggactcgcagagtcttgcgatgaaatggtccatgctgactccaaactggtgagttgtaggcagggcagcggtaatatgaaggagtgcgttaccactgggcgggcccttctgcctgctgtgaaccccggccaagaggcctgtttgcacttcacagcaccaggatctcccgattccaagtgcctcaaaatcaaggtcaaacgcattaatctgaagtgtaaaaagtcaagtagctactttgtgcctgacgccagatataggtgcacctcggtacgtcggtgtcgatgggctggcgattgccagtccgggtgcccaccgcatttcacgtctaacagcttttcagacgactgggcgggaaagatggatagagcaggcttaggtttcagtgggtgttccgacggatgcggcggtgccgcttgtggctgctttaatgccgcaccctcttgtatcttctggaggaaatgggtggaaaaccctcacgggattatctggaaggttagcccatgcgccgcttgggtcccctccgccgtgatagagctgaccatgccttcaggagaagtgcgcacattccacccaatgagcggcatccccactcaggtctttaaaggggttagtgtgacctacctaggatctgatatggaggtgtccggcctcacagacctgtgtgaaattgaggagcttaagagcaaaaagttggcactggcgccgtgcaaccaggctggtatgggggtagtcggaaaagtgggcgaaatccaatgttcgtcagaggaatctgcccggactattaagaaggatggttgcatctggaatgcagacctcgttggcatagagctgagagtggatgacgccgtctgttatagtaaaattacctccgtggaagctgttgccaactacagcgcaatccctacaaccattgggggacttaggttcgagcgctctcatgatagccagggcaagatctccgggtcaccactggacataactgctatccgaggaagttttagcgtgaattaccggggcttgcgtctctctctgtccgagattacggccacatgcaccggtgaagtaactaacgtctcagggtgctatagttgtatgaccggagcgaaagtgagcatcaagttacactcctctaaaaattcgacagcccatgtgagatgcaagggcgatgagaccgctttcagcgtcctggaaggtgttcactcatacactgtgtccctaagttttgaccacgcagtagtggatgagcagtgtcagctcaactgcggcgggcatgaatctcaagtcacactgaagggaaatcttattttcttggacgtgcccaaatttgttgacggcagctatatgcagacgtaccactccaccgtgcctactggggccaacatcccctcaccaacagattggctgaatgctctcttcggaaacggcctgtctaggtgggtcttaggtgtgatgggggttctgcttggaggcttggccctctttttcatgataatgagcctgtttaagctaggcaccaaacaggtgttccgcagtcggacaaagctggcatga

SEQ ID NO: 11615 - RNA, 3222 nt, synthetic construct
  misc_feature 1..3222: note = derived and/or modified CDS sequence (opt3) from SFTSV/FTLSV(YGS1)__KF356537.1__GP
  source 1..3222: mol_type = other RNA
atgatgaaggtgatctggttcagctccctggtctgcctcgttattcagtgttctggcgactcagggcccataatctgcgccggacctattcacagtaacaaaagcgctgcaatcccacatcttctgggttactccgagaagatttgtcaaatcgatagattgatacacgtgtcttcgtggttaaggaatcattcacagtttcagggctatgtagggcagcggggaggccgcagccaagtgagttactatccggccgaaaactcctactctcgatggagcggtctgctatccccctgcgacgcggattggctcgggatgctggtcgtgaaaaaggctaaaggatcagacatgatcgttcctggcccaagttataagggcaaggtgttctttgagcgtcccaccttcgatgggtacgtcggatggggttgtggcagcgggaaatctagaacagaatccggagagctttgctcaagcgacagtggcacttcttccggtctgttgcctagcgatagggtgctctggattggggacgtagcctgtcagccaatgacgcccatccctgaagagacctttctggagctgaagtcgttctctcagtccgaatttccagatatttgcaaaatcgacggaatagttttcaatcagtgtgagggcgaatcactcccgcaaccctttgatgtggcatggatggacgtcggccacagtcataagattatcatgcgggagcacaaaacaaagtgggtgcaggagagctcctctaaggatttcgtgtgctataaagaagggactggaccttgtagcgagtcagaagagaaggcctgcaaaaccagtggttcctgccgcggcgacatgcagttttgtaaggtcgctgggtgcgaacacggagaggaggcaagcgaagccaaatgtagatgctctttagttcataagccaggcgaggtggtagtgtcatacggtgggatgagggtccggcccaaatgttacggcttcagtcgcatgatggctacaatggaagtgaaccctccagagcagcgaattggacaatgcaccggctgtcacctggaatgcatcaatgggggagttagacttatcactttgacaagcgagctgaagtccgccaccgtgtgtgcgtctcatttttgctcgagcgcaacgtccggtaagaaatcaactgagattcacttccacagtggctctctagtcgggaagaccgccatacatgtgaaaggagctctcgtagacggcacagaatttacttttgagggtagctgtatgttccccgatgggtgcaacgccgttgactgcaccttttgtagggagttcctgaagaatccgcagtgctatcctgctaaaaagtggctttttatcattatcgtgatactgttgggctacgcaggactcatgctgttaacaaacgtcctgaaggccattggcgtgtgggggtcctgggtcatcgcgcccgtgaaactcatgttcgccatcatgaagaaacttatgcggaccgtttcatgtctggtgggaaagttgatggatcgtggtcgccaggtaattcacgaagaaatcggcgagaatggggagggaaaccatgacgatgtcagaattgaaatggcaaggccacggcgagtgcgccactggatgtatagccctgttatactaacgatcctggctattggcctcgccgagggttgcgacgaaatggtgcatgctgattctaaactggtctcctgtagacaagggagtggcaatatgaaggagtgcgtgactacaggaagggcccttctgcccagcgtaaacccaggccaggaggcatgtttgcactttaccgcccccgggtctcctgactccaagtgcctcaaaatcaaggtgaaacggatcaatctgaagtgtaaaaagtcaagtagctacttcgttccagatgctcgctcgagatgcacttccgtcaggcgttgtcggtgggcgggagactgccagtctggctgcccgccccactttacaagcaactcattcagtgatgactgggcaggtaagatggaccgagccgggttaggattttccggctgttctgatggttgcggcggggctgcctgtggatgcttcaatgcagcccctagctgtattttctggagaaaatgggtggaaaactcccatggcataatctggaaggtgtcaccatgcgctgcctgggtccccagcgcagttattgagctgaccatgcctagtggggaagtgaggacgttccacccaatgtctggaatccccacccaggtgttcaaaggcgtatccgtcacatatctaggtagcgacatggaggtgtcggggctcactgatctgtgtgaaattgaggagcttaagagcaaaaagttggcgctggctccgtgcaaccaagccggaatgggcgttgtgggtaaagtcggcgaaatccagtgttctagtgaggaatccgcacgcaccataaagaaggacgggtgcatctggaatgccgatctcgtgggaattgagctgcgggttgacgatgctgtgtgttacagcaaaatcacatctgtagaagccgtcgcaaactatagcgctattcctactaccatcggcgggcttagatttgagaggtcccatgactcacagggaaagataagtggcagcccactggatattacagccatccgcggttctttctccgtgaattaccgagggttgcggctctcactgagtgagattaccgcgacttgcacgggagaagtgacaaacgtcagcggctgctactcctgtatgaccggtgccaaagtttctatcaagttacactcgagcaaaaattcaactgctcacgtgcgttgcaagggcgacgagaccgcattttccgtactggaaggggtgcatagttatacagtctctctatcattcgatcacgccgtggttgacgagcagtgtcaactcaactgcggaggccatgaatcccaggtgaccctgaaggggaatcttatatttttggatgtccccaaattcgtggacggatcatacatgcagacttatcactctacagttcctacgggcgctaacatccccagcccaaccgactggctgaatgccctctttggtaacgggctgagtagatggattttaggagtgatcggcgtcctgcttggcgggttggcactcttctttctgattatgttcctatttaagctgggaactaaacaggtattcaggtcccgcacaaagctcgcgtga

SEQ ID NO: 11616 - RNA, 3222 nt, synthetic construct
  misc_feature 1..3222: note = derived and/or modified CDS sequence (opt3) from SFTSV/FTLSV(YNY1)__KF356538.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaaccagcctgagcaacgaatcggacagtgcactggctgtcacctggaatgcatcaatgggggagtgagacttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggatggcactgaatttaccttcgagggtagctgtatgtttccagacgggtgcgatgccgtagactgcacattctgtagggaatttctgaagaacccccaatgctatccggctaaaaagtggcttttcattatcatagttattctgtttggctacgccggattgatgctcctgaccaatgtgttaaaggcaatcggcatctgggggtcctgggtcattgctcctgtgaaactgatcttcgccattataaagaaactcatgcggacggtctcatgtcttatgggaaagctgatggatcgtggtcgccaggtgatccatgaggaaattggcgagaacagagaggggaatcaggacgatgttaggatcgaaatggcgcggccccgacgcgtgagacactggatgtatagcccagtaatcttgactattctagccataggactggcagagtcttgcgacgaaatggtccatgctgattccaaactcgtgagttgtaggcagggcagcggtaacatgaaggagtgcgttacaaccgggcgggccctgcttcctgctgtgaatcccggccaagaggcctgtctgcactttactgcaccaggatctcccgactccaagtgcttgaaaatcaaggtcaaacgcattaacctcaagtgtaaaaagtcaagtagctacttcgtgcctgatgccagatcgaggtgcacatccgtacgtcggtgtcgatgggctggcgactgccagtctgggtgcccaccgcattttaccagcaattcattcagtgacgattgggcgggaaagatggacagagcaggcctgggtttttccgggtgttctgatggatgcggcggtgccgcttgtggctgcttcaacgccgcacccagctgtatcttctggaggaaatgggtggaaaatcctcacgggattatctggaaggtttccccatgcgccgcttgggtcccctcagccgtgatagagttaacgatgcctagcggagaagtgcgcacctttcacccaatgagtggcatccccacacaggtcttcaaaggggtttctgtgacttatctgggatccgacatggaggtgagcggcctaaccgatctctgtgaaattgaggagctgaagtcgaaaaagttggcacttgcgccgtgcaaccaggctggtatgggggtagtcggaaaagtgggcgaaatccaatgttcatctgaggaaagtgcccggacaattaagaaggacggttgcatctggaacgcagatctggttggcatagagctcagagtggacgatgccgtctgttactccaaaattactagcgtggaagctgttgccaattattctgcaatccctaccacaattgggggactgaggtttgagcgcagccatgactcccagggcaagatctcagggagtccacttgatataaccgctatccgaggcagcttctctgtgaactaccggggactgcgtttgtccctctcagagattactgccacgtgcacaggtgaagtaaccaatgtcagtgggtgctacagctgtatgactggagcgaaagtgtccatcaagctgcactcttcgaaaaacagcaccgcccatgtgagatgcaagggcgacgagacagctttttcagtcttagaaggtgttcactcctataccgtgagtctgtctttcgatcacgcagtagtggacgagcagtgtcagctaaattgcggcgggcatgaaagccaagtcactctcaagggaaacctgatttttcttgacgtgcccaaattcgttgatggctcctacatgcagacatatcactcaacggtgcctaccggggccaatatcccctctccaactgactggttgaacgctctgtttggaaatggcctcagtaggtggatactgggtgtcatgggggtgttactgggaggccttgccttgttctttatgattatgagcctcttcaagctgggcacaaaacaggtttttcgctcccggaccaagctagcatga

SEQ ID NO: 11617 - RNA, 3222 nt, synthetic construct
  misc_feature 1..3222: note = derived and/or modified CDS sequence (opt3) from SFTSV/FTLSV(YPQ133)__KF356530.1__GP
  source 1..3222: mol_type = other RNA
atgatgaaggtgatctggttcagctccctgatttgctttgtcatacagtgttctggcgactcaagtcccatcatttgcgccgggcctatccacagcaacaaatccgctgatattccacatctccttggatactctgagaagatctgtcaaatagacagactgatccacgtttcgtcatggttgaggaatcatagccagttccagggttatgtgggccagcgcgggggacggagtcaagtatcctactatccggcagaaaactcttacagccgatggtccggcttactgtcaccctgcgatgccgactggctaggtatgctcgtggtcaaaaaggcgaaagggagtgatatgattgtgcctggaccaagctataagggcaaggttttcttcgagcgtcccacctttgacggctacgtggggtggggatgtggttctggcaaatccagaacagaatcaggggagctgtgcagcagtgattctggaacttccagcggccttctgccttcggacagggtcttgtggatcggtgatgtggcttgtcagccaatgacgcccattcctgaagagaccttcctcgagctgaagtctttttcccagtcagaatttccagacatctgcaaaatagatgggattgtatttaatcagtgtgagggagaaagtctgccgcaacccttcgacgttgcctggatggatgtgggccacagccagaagatcattatgcgggagcataaaacaaagtgggtccaggagtcctctagcaaggactttgtgtgctataaagaaggcactgggccttgttcagagagtgaagagaagacctgcaaaacatccggaagctgccgcggtgacatgcagttctgtaaggtggcaggctgcgaacacggggaggaggcctctgaagctaaatgtagatgctcactcgtccacaagccaggagaggttgtggtaagttacggcggtatgagggtgcggcccaaatgttacgggtttagccgcatgatggcaaccttagaagtcaaccaacctgagcagcgaatcggccagtgcactggatgtcatctggaatgcatcaatggcggggtgagacttattacattgacctccgagctgaagtctgccacggtttgtgcttcgcacttctgcagctccgccacttcaggaaagaaaagtaccgagatacaattccattctggtagcctagtgggcaagacagcgatccacgtcaaaggggcactcgtggatggaactgaatttaccttcgagggctcctgtatgtttccagacggttgcgatgccgtagactgcacattctgtagggaatttctgaagaacccccagtgctatccggctaaaaagtggcttttcattatcatagttattctgttggggtacgccggcctcatgctgttaaccaatgtgctgaaggcaatcggaatctggggctcatgggtcattgctcctgtgaaactcatctttgccattataaagaaacttatgcggacggtcagctgtctgatggggaagttgatggatcgtggacgccaggtgatccacgaggaaattggtgagaacagagagggcaatcaggacgatgttaggatcgaaatggcgcggccccgacgcgtgagacattggatgtattctccagtaatcctaactattctggccatagggctcgcagagtcctgcgacgaaatggtccacgctgatagtaaactggtgagctgtaggcaaggatctggcaacatgaaggagtgcgttacaaccggtcgggcccttctgcctgctgtgaatcccgggcaggaggcctgtttgcatttcactgcaccaggctcccccgactcaaagtgcctcaaaatcaaggtcaaacgcattaacctgaagtgtaaaaagagtagctcgtactttgtgcctgatgccagatccaggtgcacatctgtacgtcggtgtcgatgggctggagactgccagagcggctgcccaccgcacttcacctcaaatagtttttccgacgattgggcggggaagatggacagagcaggattaggcttctctggttgtagcgatgggtgcggaggcgccgcttgtggttgctttaacgccgcaccctcctgtatcttctggaggaaatgggtggaaaatcctcatggcgttatttggaaggtctcaccatgcgccgcttgggtgcccagcgccgtgatcgagctgacgatgcctagtggggaagtccgcaccttccacccaatgtctggaatacccacacaggtttttaaaggcgtgtccgtgacttatctagggagcgacatggaggtatcgggactcaccgatctgtgtgaaatcgaggagcttaagagcaaaaagttggcactggcgccgtgcaaccaagctggcatgggtgtcgtggggaaagttggagaaattcagtgttctagtgaggaatccgcccggacaatcaagaaggacggctgcatttggaacgcagatctcgtgggtatcgagctgagagtcgacgatgccgtgtgttacagcaaaataacttctgttgaagctgtggccaattatagcgcaattcctaccacaatcggcgggcttaggttcgagcgctcccacgactcacagggaaagattagtggcagcccactggatatcaccgctatacgagggtctttttccgtaaactaccggggattgcgtctctcactgagtgagatcactgccacgtgcacaggcgaagtcaccaatgtgagcggttgctactcctgtatgactggggcgaaagtgtctattaagttacattcgagcaaaaactcaaccgcccacgtcagatgcaagggagacgagacagctttctccgttctggaaggcgtgcatagttataccgtatctctatcatttgatcacgcagtggtcgacgagcagtgtcaactcaattgcggtggccacgaatcccaggtgactctgaaggggaaccttatcttcttggacgttcccaaatttgtggatggatcatacatgcagacatatcattctacggtccctaccggcgccaatattcccagcccaactgactggctgaacgctctcttcgggaatggactgagtaggtggatcttaggcgtgatgggtgttctgcttgggggattggccctctttttcatgataatgtccctgtttaagctaggcacaaaacaggtgttccgcagccggaccaagctggcatga

SEQ ID NO: 11618 - RNA, 3222 nt, synthetic construct
  misc_feature 1..3222: note = derived and/or modified CDS sequence (opt3) from SFTSV/FTLSV(YPQ2)__KF356531.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaaccagcctgagcaacgaatcggacagtgcactggctgtcacctggaatgcatcaatgggggagtgagacttattacattgaccagcgagctgaagtccgccacggtttgtgcttctcatttctgctcgagcgccacttccggtaagaaatcaaccgagatacagttccacagtggctctctagtggggaagatcgcgattcacgtcaaaggagcactcgtggatggcacagaatttactttcgagggtagctgtatgtttccagacgggtgcgatgccgtagactgcaccttctgtagggaatttctgaagaacccccaatgctatccggctaaaaagtggcttttcatcataattgttatcctgttgggctacgccggactcatgctgttaacaaatgtgctgaaggcaatcggcatttgggggtcctgggtcatcgctcctgtgaaactcatttttgccataatcaagaaacttatgcggaccgtctcatgtctgatgggaaagttgatggatcgtggtcgccaggtgattcatgaggaaatcggcgagaacagagaggggaatcaggacgatgttaggatcgaaatggcgcggccccgacgcgtgagacactggatgtatagcccagtaattctaacgatactggccatcggactcgcagagtcttgcgacgaaatggtccatgctgattccaaactggtgagttgtaggcagggcagcggtaacatgaaggagtgcgttactacagggcgggcccttctgcctgctgtgaatcccggccaagaggcctgtttgcacttcaccgcaccaggatctcccgactccaagtgcctcaaaattaaggtcaaacgcatcaacctgaagtgtaaaaagtcaagtagctactttgtgcctatggccagattcaggtgcacttcggtacgtcggtgtcgatgggctggcgattgccagtccgggtgcccaccgcattttacatctaatagcttctcagacgactgggcgggaaagatggatagagcaggcttaggttttagtgggtgttccgacggatgcggcggtgccgcttgtggctgcttcaacgccgcaccctcttgtattttctggaggaaatgggtggaaaatcctcacgggatcatatggaaggttagcccatgcgccgcttgggtcccctccgccgtgatcgagctgaccatgccttcaggagaagtgcgcacgtttcacccaatgagcggcattcccacccaggtcttcaaaggggttagtgtgacatatctaggatctgatatggaggtgtccggcctcactgacctgtgtgaaatcgaggagcttaagagcaaaaagttggcactggcgccgtgcaaccaggctggtatgggggtagtcggaaaagtgggcgaaattcaatgttcgtcagaggaatctgcccggaccatcaagaaggatggttgcatatggaacgcagacctcgttggcattgagctgagagtggatgacgccgtctgttacagtaaaatcacatccgtggaagctgttgccaattatagcgcaattcctactaccatcgggggacttaggtttgagcgctctcatgatagccaggtgaagatatccggctcaccactggacatcacagctatgcgagggagtttcagcgtaaactaccggggattgcgtctctctctgtccgagattaccgccacttgcacgggcgaagtcacaaatgtgtcaggttgctacagttgtatgaccggggcgaaagtgagcatcaagttacactcctctaaaaactcgactgcccatgtcagatgcaagggagatgagaccgcttttagcgttctggaaggcgtgcactcatatacagtatccctaagtttcgaccacgcagtggtcgatgagcagtgtcagctcaattgcggtggccatgaatctcaagtgaccctgaaggggaaccttatctttttggacgttcccaaattcgtggacggaagctacatgcagacttatcactccacagtccctacgggcgccaatattccctcaccaaccgattggctgaacgctctctttgggaatggactgtctaggtggatattaggcgtgatgggtgttctgcttgggggattggccctcttctttatgattatgagcctgttcaagctaggcactaaacaggtgtttcgcagtcggacaaagctggcatga

SEQ ID NO: 11619 - RNA, 3222 nt, synthetic construct
  misc_feature 1..3222: note = derived and/or modified CDS sequence (opt3) from SFTSV/FTLSV(YPQ5)__KF356532.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccgagtaagttactatccggcagaaaactcctactctcgttggagcggtttactgtccccctgcgatgccgactggctagggatgctcgtggtcaaaaaggcgaaaggatcagatatgattgtgcctggcccaagttataagggcaaggttttcttcgagagacccacctttgacgggtacgtgggatggggttgtggcagcgggaaatctaggacagaatccggagagctgtgctcaagcgatagtggcacttcttccggtcttctgcctagcgaccgggtcttgtggatcggggatgtggcttgtcaaccaatgacgcccattcctgaagagaccttcctcgagctgaagtcgttttctcagtccgaatttccagacatctgcaaaatagatggaattgtatttaatcagtgtgagggcgaatcactgccgcagcccttcgacgttgcctggatggatgtgggccacagtcataagatcattatgcgcgagcacaaaacaaagtgggtccaagagagctcctctaaggactttgtgtgctataaagaagggactggaccttgtagcgagtcagaagagaagacctgcaaaacaagtggttcctgcagaggcgacatgcagttctgtaaggtggcagggtgcgaacacggagaggaggccagcgaagctaaatgtaggtgctctctcgtccataagccaggcgaggttgtggtatcatacggtgggatgcgggtgcgccccaaatgttacggctttagtcgaatgatggcaaccttagaagtcaaccagcctgagcagagaatcggacaatgcactggctgtcacctggaatgcatcaatgggggagtgaggcttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggatggcactgaatttaccttcgagggtagctgtatgtttccagacgggtgcgatgccgtagactgcacattctgtcgggaatttctgaagaacccccagtgctatccggctaaaaagtggcttttcattatcatagttattctgttgggctacgccggactcatgctgttaaccaatgtgctgaaggcaatcggcatctgggggtcctgggtcattgctcctgtgaaactcatctttgccattataaagaaacttatgcgtacggtctcatgtctgatgggaaagttgatggatcgcggtagacaagtgatccatgaggaaattggcgagaacagggaggggaatcaggacgatgttcggatcgaaatggcgcgaccccgcagagtgaggcactggatgtatagcccagtaatcctaactattctggccataggactcgcagagtcttgcgacgaaatggtccatgctgattccaaactggtgagttgtcggcagggcagcggtaacatgaaggagtgcgttacaaccgggcgcgcccttctgcctgctgtgaatcccggccaggaggcctgtttgcacttcactgcaccaggatctcccgactccaagtgcctcaaaatcaaggtcaaaagaattaacctgaagtgtaaaaagtcaagtagctactttgtgcctgtagccaggtatcgttgcacatcggtgcggcgatgtagatgggctggcgattgccaatccgggtgcccaccgcatttcacctctaatagcttttcaaacgactgggcgggaaagatggacagggcaggcttaggtttcagtgggtgttccgatggatgcggcggtgccgcttgtggctgctttaatgccgcaccctcttgtatcttctggcgcaaatgggttgaaaaccctcacgggattatctggaaggtcagcccatgcgccgcttgggtgccctccgccgtgatagagctgacgatgccttcaggagaagtccggaccttccacccaatgagcggcatccccacacaggtttttaaaggggtgagtgtgacttacctaggatcttatatggaggtatccggcctcaccgacctgtgtgaaattgaggagcttagaagcaagaaattggcactggcgccgtgcaaccaggctggtatgggggtcgtgggaaaggttggcgaaatccagtgttcgtcagaggaatctgccaggacaattaaaaaggatggttgcatctggaatgcagacctcgtgggcatagagctgcgcgtcgatgacgccgtgtgttacagtaagattacttccgttgaagctgtggccaactacagcgcaatccctaccacaattgggggacttcgattcgagcggtctcatgatagccaaggcaaaatctccgggtcaccactggacataaccgctatccgtggaagttttagcgtaaattatagaggcttgaggctctctctgtccgagattactgccacgtgcacaggtgaagtcaccaacgtgtcagggtgctacagttgtatgactggagcgaaggtgagcatcaaattacactcctctaaaaattcgaccgcccatgtccgctgcaagggcgatgagacagctttcagcgttctggaaggtgtgcactcatataccgtatccctaagttttgaccacgcagtggtcgatgagcagtgtcagctcaactgcggcgggcatgaatctcaggtgactctgaagggaaatcttattttcttggacgttcccaagtttgtggatggcagctacatgcaaacatatcactccacggtccctaccggggccaacatcccctcaccaactgactggctgaatgctctcttcggaaacggcctgtctcggtggatattaggtgtgatgggggttctgcttggaggcttggccctctttttcatgattatgagcctgtttaaactaggcacaaaacaggtgttcagaagtaggaccaagctggcatga

SEQ ID NO: 11620 - RNA, 3222 nt, synthetic construct
  misc_feature 1..3222: note = derived and/or modified CDS sequence (opt3) from SFTSV/FTLSV(YSC19)__KF356536.1__GP
  source 1..3222: mol_type = other RNA
atgatgaaggtgatctggttcagctccctggtctgcctcgttattcagtgttctggcgactcagggcccataatctgcgccggacctattcacagtaacaaaagcgctgcaatcccacatcttctgggttactccgagaagatttgtcaaatcgatagattgatacacgtgtcttcgtggttaaggaatcattcacagtttcagggctatgtagggcagcggggaggccgcagccaagtgagttactatccggccgaaaactcctactctcgatggagcggtctgctatccccctgcgacgcggattggctcgggatgctggtcgtgaaaaaggctaaaggatcagacatgatcgttcctggcccaagttataagggcaaggtgttctttgagcgtcccaccttcgatgggtacgtcggatggggttgtggcagcgggaaatctagaacagaatccggagagctttgctcaagcgacagtggcacttcttccggtctgttgcctagcgatagggtgctctggattggggacgtagcctgtcagccaatgacgcccatccctgaagagacctttctggagctgaagtcgttctctcagtccgaatttccagatatttgcaaaatcgacggaatagttttcaatcagtgtgagggcgaatcactcccgcaaccctttgatgtggcatggatggacgtcggccacagtcataagattatcatgcgggagcacaaaacaaagtgggtgcaggagagctcctctaaggatttcgtgtgctataaagaagggactggaccttgtagcgagtcagaagagaaggcctgcaaaaccagtggttcctgccgcggcgacatgcagttttgtaaggtcgctgggtgcgaacacggagaggaggcaagcgaagccaaatgtagatgctctttagttcataagccaggcgaggtggtagtgtcatacggtgggatgagggtccggcccaaatgttacggcttcagtcgcatgatggctacaatggaagtgaaccctccagagcagcgaattggacaatgcaccggctgtcacctggaatgcatcaatgggggagttagacttatcactttgacaagcgagctgaagtccgccaccgtgtgtgcgtctcatttttgctcgagcgcaacgtccggtaagaaatcaactgagattcacttccacagtggctctctagtcgggaagaccgccatacatgtgaaaggagctctcgtagacggcacagagttcacttttgaaggtagctgtatgttccccgatgggtgcaacgccgttgactgcaccttttgtagggagttcctgaagaatccgcagtgctatcctgctaaaaagtggctttttatcattatcgtgatactgttgggctacgcaggactcatgctgttaacaaacgtcctgaaggccattggcgtgtgggggtcctgggtcatcgcgcccgtgaaactcatgttcgccatcatgaagaaacttatgcggaccgtttcatgtctggtgggaaagttgatggatcgtggtcgccaggtaattcacgaagaaatcggcgagaatggggagggaaaccatgacgatgtcagaattgaaatggcaaggccacggcgagtgcgccactggatgtatagccctgttatactaacgatcctggctattggcctcgccgagggttgcgacgaaatggtgcatgctgattctaaactggtctcctgtagacaagggagtggcaatatgaaggagtgcgtgactacaggaagggcccttctgcccagcgtaaacccaggccaggaggcatgtttgcactttaccgcccccgggtctcctgactccaagtgcctcaaaatcaaggtgaaacggatcaatctgaagtgtaaaaagtcaagtagctacttcgttccaattgctcgcaacagatgcacttcggtcaggcgttgtcggtgggcgggagattgccagtccggctgcccgccccactttacatctaatagcttctcagacgattgggcaggtaagatggaccgagccgggttaggatttagtggctgttccgacggttgcggcggggctgcctgtggatgcttcaacgcagccccttcttgtatattttggagaaaatgggtggaaaacagccatggcatcatttggaaggtgtccccatgcgctgcctgggtcccctcagcagttatcgagctgaccatgcctagcggggaagtgaggacgttccacccaatgagtggcattcccacccaggtgttcaaaggagtatctgtcacatatctaggttccgatatggaggtgagcgggctcactgacctgtgtgaaatcgaggagcttaagtcgaaaaagttggcgctggctccgtgcaatcaagccggaatgggcgttgtgggtaaagtcggcgaaatacagtgttcatctgaggaaagtgcacgcaccatcaagaaggatgggtgcatttggaacgccgacctcgtgggaatcgagctgcgggttgatgacgctgtgtgttactccaaaattacaagcgtagaagccgtcgcaaattattctgctatccctactaccataggcgggcttagatttgagaggagccatgattcccagggaaagatttcaggcagtccactggacatcacagccattcgcggtagcttctctgtgaactaccgagggttgcggctctccctgtcagagatcaccgcgacttgcacgggagaagtgacaaatgtcagtggctgctacagctgtatgaccggtgccaaagtttccataaagttacactcttcgaaaaacagcactgctcacgtgcgttgcaagggcgatgagaccgcattttcagtactggaaggggtgcattcctatacagtcagtctatctttcgaccacgccgtggttgatgagcagtgtcaactcaattgcggaggccatgaaagccaggtgaccctgaaggggaaccttatctttttggacgtccccaaattcgtggatggatcctacatgcagacttatcactcaacagttcctacgggcgctaatattccctctccaaccgactggctgaacgccctctttggtaatgggctgagcagatggatcttaggagtgattggcgtcctgcttggcgggttggcactcttctttctgatcatgttcctatttaagctgggaactaaacaggtattcaggagtcgcacaaagctcgcgtga

SEQ ID NO: 11621 - RNA, 3222 nt, synthetic construct
  misc_feature 1..3222: note = derived and/or modified CDS sequence (opt3) from SFTSV/FTLSV(YSC3)__KF356535.1__GP
  source 1..3222: mol_type = other RNA
atgatgaaggtgatctggttcagctccctggtctgcctcgttattcagtgttctggcgactcagggcccataatctgcgccggacctattcacagtaacaaaagcgctgcaatcccacatcttctgggttactccgagaagatttgtcaaatcgatagattgatacacgtgtcttcgtggttaaggaatcattcacagtttcagggctatgtagggcagcggggaggccgcagccaagtgagttactatccggccgaaaactcctactctcgatggagcggtctgctatccccctgcgacgcggattggctcgggatgctggtcgtgaaaaaggctaaaggatcagacatgatcgttcctggcccaagttataagggcaaggtgttctttgagcgtcccaccttcgatgggtacgtcggatggggttgtggcagcgggaaatctagaacagaatccggagagctttgctcaagcgacagtggcacttcttccggtctgttgcctagcgatagggtgctctggattggggacgtagcctgtcagccaatgacgcccatccctgaagagacctttctggagctgaagtcgttctctcagtccgaatttccagatatttgcaaaatcgacggaatagttttcaatcagtgtgagggcgaatcactcccgcaaccctttgatgtggcatggatggacgtcggccacagtcataagattatcatgcgggagcacaaaacaaagtgggtgcaggagagctcctctaaggatttcgtgtgctataaagaagggactggaccttgtagcgagtcagaagagaagacctgcaaaacaagtggttcctgccgcggcgacatgcagttttgtaaggtcgccgggtgcgaacacggagaggaggctagcgaagcaaaatgtagatgctctttagttcataagccaggcgaggtggtagtgtcatacggtgggatgagggtccggcccaaatgttacggcttcagtcgcatgatggccaccctggaagtgaaccagcctgagcaacgaattggacagtgcactggctgtcaccttgaatgcatcaatgggggagttagattgatcacactgaccagcgagctaaagtccgctacggtgtgtgcctctcatttttgctcgagcgcgacttccggtaagaaatcaaccgagattcagttccacagtggctctctcgtcgggaagacagcaatacacgtgaaaggagccctggtagacggcactgagttcacctttgaaggtagctgtatgttcccagatgggtgcgacgctgttgattgcacattttgtagggagttccttaagaacccccaatgctatccggccaaaaagtggctgtttatcattatcgtgatattgctcggctacgcaggactgatgttactgaccaatgtcctcaaggctattggcatctgggggtcctgggtgatcgcccctgtcaaacttattttcgcgatcattaagaaactgatgcggacggtgtcatgtttgatgggaaagctaatggaccgtggtcgccaggttatacatgaagaaatcggcgagaacagagaggggaatcaggatgacgtgaggattgaaatggcccggccccgacgcatcagacactggatgtatagcccagtaatcctgactattctcgcaataggactggctgagtcttgcgatgaaatggtccatgccgactccaaacttgtgagttgtaggcagggcagcggtaacatgaaggagtgcgttacaaccgggcgggctctgttgcctgccgtgaatcccggccaagaggcatgtctccactttactgccccaggatctcccgattccaagtgcctgaaaatcaaggtcaaacgcattaacttaaagtgtaaaaagtcaagtagctacttcgtgcctgacgctagatcgaggtgcacatccgtacgtcggtgtcgatgggcgggcgattgccagtctgggtgcccaccgcattttaccagcaattcattcagtgacgactgggcaggaaagatggatagagccggcctgggtttttccgggtgttctgacggatgcggcggtgctgcctgtggctgcttcaacgcagcccccagctgtatcttttggaggaaatgggtggaaaatcctcacgggattatctggaaggtttccccatgcgctgcctgggtcccctcagcagtgatagagctaacgatgcctagcggagaagtgcgcaccttccacccaatgagtggcatccccacacaggtcttcaaaggggtttctgtgacttatctcggatccgatatggaggtgagcggcctgaccgacctttgtgaaattgaggagttgaagtcgaaaaagctggcgctcgctccgtgcaaccaggccggtatgggggtagtcggaaaagtgggcgaaatccaatgttcatctgaggaaagtgcacggacaattaagaaggatggttgcatctggaacgccgacctggttggcatagagcttagagtggatgacgctgtctgttactccaaaattactagcgtggaagccgttgcaaattattctgctatccctaccacaattgggggactgaggtttgagcgcagctacgattcccagggcaagatctcagggagtccattggacataaccgccatccgaggcagcttctctgtgaactaccggggactccgtctgtccttatcagagattactgcgacgtgcacaggtgaagtaaccaatgtcagtgggtgctatagctgtatgactggagccaaagtgtccatcaagctgcattcttcgaaaaacagcaccgctcacgtgagatgcaagggcgatgagacagcattttcagtcctagaaggtgttcattcctacaccgtgagtctctctttcgaccacgccgtagtggatgagcagtgtcagctgaattgcggcgggcacgaaagccaagtcactcttaagggaaacttgatttttctggacgtgcccaaattcgttgacggctcctatatgcagacataccattcaacggtgcctaccggggctaatatcccctctccaactgattggctcaacgccctgtttggaaatggcttaagtaggtggatactgggtgtcattggggtgcttttgggaggcctcgcactgttctttatgatcatgagcctattcaagctgggcacaaaacaggtttttcgctcccggaccaagctcgcgtga

SEQ ID NO: 11622 - RNA, 3222 nt, synthetic construct
  misc_feature 1..3222: note = derived and/or modified CDS sequence (opt3) from SFTSV/FTLSV(YSH39)__KF356529.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcatggagctcaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctggtccataagccaggcgaggttgtggtatcatacggtgggatgaggatccggcccaaatgttacggctttagtcgcatgatggcaaccctcgaagtgaaccagcctgagcaacgaatcggacagtgcactggctgtcacttagaatgcattaatgggggagtcagactgataacacttaccagcgagttgaagtccgccacggtgtgtgcttctcatttctgctcgagcgccacttccggtaagaaatcaaccgagatccagttccacagtggctctctggttgggaagacagcgattcacgtgaaaggagcacttgtcgatggcactgaatttaccttcgagggtagctgtatgtttccagacgggtgcgatgccgtggactgcacattctgtagggaatttctcaagaacccccaatgctatccggctaaaaagtggctgttcatcataattgtaatccttctgggccatgccggattgatgctcctgaccaatgttttaaaggcaatcggcatttgggggtcctgggtgatcgctcctgtcaaactgatttttgccataatcaagaaactcatgcggacggtgtcatgtcttatgggaaagctgatggatcgtggtcgccaggtcattcacgaggaaatcggcgagaacagagaggggaatcaggacgatgtgaggatcgaaatggcgcggccccgacgcgttagacattggatgtacagcccagtgattttgactatactagccatcggactggcagagtcttgcgacgaaatggtacacgctgattccaaactcgtcagttgtaggcagggcagcggtaacatgaaggagtgcgtgacaaccgggcgggccctgcttcctgctgttaatcccggccaagaggcctgtctgcatttcactgcaccaggatctcccgactccaagtgcttgaaaattaaggtgaaacgcatcaacctcaagtgtaaaaagtcaagtagctattttgtccctgatgccagatcgaggtgcacatccgtgcgtcggtgtcgatgggctggcgactgccagtctgggtgcccaccgcacttcaccagcaattcatttagtgacgattgggcgggaaagatggacagagcaggcctgggtttctccgggtgttctgatggatgcggcggtgccgcttgtggctgctttaacgccgcacccagctgtattttctggaggaaatgggtagaaaatcctcacgggatcatatggaaggtgtccccatgcgccgcttgggttccctcagccgtcatcgagttaacgatgcctagcggagaagtgcgcaccttccatccaatgagtggcattcccacacaggtgtttaaaggggtctctgttacttacctgggatccgacatggaggtgagcggcctaaccgatctctgtgaaatcgaggagctgaagtcgaaaaagctagcattggcgccgtgcaaccaggctggtatgggggtggtaggaaaagtcggcgaaattcaatgttcatctgaggaaagtgcccggacaatcaagaaggacggttgcatatggaacgcagatctggtgggcattgagctcagagttgacgatgccgtgtgttattccaaaatcactagcgtcgaagctgtggccaattactctgcaattcctaccacaatcgggggactgaggttcgagcgcagccacgactcccagggcaagatatcagggagtccacttgatatcaccgctattcgaggcagcttttctgttaactatcggggactgcgtttgtccctctcagagatcactgccacgtgcacaggtgaagtgaccaatgtaagtgggtgctacagctgtatgactggagcgaaagtctccattaagctgcattcttcgaaaaacagcaccgcccacgtgagatgcaagggcgacgagacagctttctcagtgttagaaggtgtccactcctacaccgttagtctgtcttttgatcatgcagtggtagacgagcagtgtcagctaaattgcggcgggcacgaaagccaagtgactctcaagggaaacctgatcttccttgacgtccccaaatttgtggatggctcctatatgcagacataccattcaacggttcctaccggggccaatataccctctccaactgactggttgaacgctctgttcggaaatggcctcagtaggtggattctgggtgtgatcggggtcttactgggaggccttgccttgtttttcatgatcatgagcctctttaagctgggcacaaaacaggtgttccgctcccggaccaagctagcatga

SEQ ID NO: 11623 - RNA, 3222 nt, synthetic construct
  misc_feature 1..3222: note = derived and/or modified CDS sequence (opt3) from SFTSV/FTLSV(YSHX002)__KF356540.1__GP
  source 1..3222: mol_type = other RNA
atgatgaaggtgatctggttcagctccctgatttgcctcgtcatacagtgttctggcgactcagggcccatcatttgcgccggacctatccacagtaacaaaagcgctggtattccacatcttctgggctactccgagaagatctgtcaaatagatagattgatccacgtttcttcgtggttaaggaatcattcacagtttcaggggtatgtgggacagcggggcggtcgcagccaagtaagttactatccggcagaaaactcctactctcgatggaatgggctgctaagcccctgcgacgccgattggctcggaatgctggtggtcaaaaaggcgaaagagtccgacatgattgtgcctggcccatcatataagggcaaggttttctttgaacgtcccaccttcgatgggtacgtgggatggggttgtggcagtgggaaaagcagaacagagtctggagaactttgctcctcagacagcggcacttcctctggtctgttgccttccgatagggtcctctggatcggggacgtggcttgtcagccaatgacgcccattcctgaggagacctttctggaacttaagagcttctcgcagtctgagtttccagatatctgcaaaatagacggaattgtattcaaccagtgtgaaggcgagtccctcccgcaaccctttgatgttgcctggatggacgtgggccactcacataagatcattatgcgggagcacaaaacaaagtgggtccaggaaagtagctccaaggatttcgtgtgctataaagaggggactggaccttgttctgaaagcgaggaaaaggcatgcaaaacctcaggtagttgccgcggcgacatgcagttttgtaaggtggccgggtgcgagcacggagaggaagctagtgaggcaaaatgtagatgcagcttagtccataagccaggcgaagttgtggtatcttacggtgggatgagggtgcggcccaaatgttacggcttctcacgcatgatggccacactggaggtcaatcctccagaacagcgaatcggacaatgcaccggctgtcaccttgagtgcatcaacgggggagtgagattgattactctgacaagtgagctaaggagcgctaccgtttgtgcctcccatttttgctcctcggcgacgagcggtaagaagtccactgaaatacacttccactcaggcagtctcgtggggaaaaccgcaatccatgtcaagggagccctggtggacggcacagagttcacttttgaaggttcttgtatgttccccgatgggtgcgacgctgtagattgcaccttttgtcgggagttccttaaaaatccgcagtgctatcctgccaagaaatggctgtttattatcatagttattttgctcggctacgcaggactgatgttagtgacaaacgtcctgaaggctatcggcgtgtgggggagctgggtcatcgcccccgtgaagctcatgttcgcgattatcaaaaagctgatgcgtaccgtttcctgtctggtgggaaaattgatggaccgcggtagacaggtaattcacgaagagataggcgagaatggggaaggaaaccaagatgacgtcaggatcgagatggcccggccacgacgcgtgagacattggatgtattcacctgttattctaacgatcctggcaatcggcctcgctgaaggttgcgatgagatggtgcacgccgacagcaagctggtctcttgtaggcaggggtccggcaatatgaaagagtgcattactacaggacgggcccttctgcccgctgtgaacccaggccaggaagcatgtttgcattttaccgcccccgggagtcctgatagcaagtgcctcaagataaaagtaaagcgcatcaatctgaaatgtaagaaatcttcctcatacttcgtgccagacgctagaagtaggtgcactagcgttcgtcggtgtcgatgggcgggagattgccagtcgggctgcccgccccactttacatccaactctttcagcgacgactgggcaggtaagatggatagagccgggttaggattttcaggctgtagtgacggttgcggcggggctgcctgtggatgcttcaatgcagccccttcctgtatcttttggaggaagtgggtcgagaacccacacggcattatttggaaagtgtctccctgcgctgcctgggtgcctagcgcagtcatcgaactgaccatgccatccggggaggttcgcacgttccatcccatgtcaggaataccgacccaagtgttcaagggcgtgagcgtaacatatctaggtagtgatatggaagtctctgggctcactgacctgtgtgagatcgaggaacttaaatccaagaaattggcgctggctccttgcaaccaggccggaatgggcgtggttggtaaggtgggcgagaaacagtgtagctcggaagagtcagcacggaccattaagaaggatgggtgcatctggaatgccgacctcgtcggaattgaactgagagtggatgacgctgtttgttactctaaaatcacaagtgtggaggccgtagcaaactattccgctataccaactaccattggcgggcttaggtttgagcgcagccacgattctcagggaaagatcagcggctctcccctggacattacagccatccgaggttcattcagtgtcaattaccgggggttgcgtctcagcctgtctgaaataaccgcgacttgcacgggagaggtgacaaacgtgtccggctgctactcatgtatgaccggtgccaaagtcagtatcaagttacatagctccaaaaattctactgctcacgttagatgcaagggcgatgaaaccgcattttcggtgctggagggggtacacagctatattgtgtcactatccttcgaccatgccgtcgtggatgaacaatgtcagctcaactgcggaggccacgagagtcaggttacactgaaggggaatcttatctttttggacgtgcctaaattcgtcgacggatcttacatgcagacctatcatagcactgtgcccacaggcgctaacattccatcccctacggattggctgaatgccctctttggtaacgggctgtcaaggtggatcttaggagttataggcgtgctgcttggcgggttggcactcttctttctgattatgttcctactgaagctcggaaccaaacaagtctttcgctctcggactaagctggcgtga

SEQ ID NO: 11624 - RNA, 3222 nt, synthetic construct
  misc_feature 1..3222: note = derived and/or modified CDS sequence (opt3) from SFTSV/FTLSV(YXX2)__KF356534.1__GP
  source 1..3222: mol_type = other RNA
atgatgaaggtgatctggttcagctccctgatttgcctcgtcatacagtgtggcggggacaccggacccatcatttgcgccggtcctatccactctaacaaatcagctgatattccacatcttctgggctacagtgagaagatctgtcaaatagacagattgatccacgttagctcctggttaaggaatcattctcagtttcaggggtatgtgggacagcggggcggtcgctcgcaagtatcatactatccggcagaaaacagctacagtcgatggtccgggctgctatctccctgcgatgccgactggctcggaatgctggtggtcaaaaaggcgaaaggcagcgatatgattgtgcctggcccatcctataaggggaaggttttctttgagcgtcccacattcgacggatacgtgggttggggctgtgggtcaggaaaaagtagaactgaaagcggcgagctttgcagttccgattcaggtacgagcagtgggctgttgccttctgacagggtcctctggatcggagatgtggcttgtcagccaatgacccccattcctgaagagacatttctggagctgaagtccttcagccagtcggaatttccagacatctgcaaaatagatggcattgtattcaatcagtgtgagggcgaatctctcccgcaaccctttgacgttgcctggatggatgtggggcactcccataagatcattatgcgggagcacaaaactaagtgggtccaggagtcaagtagcaaggacttcgtgtgctataaagaaggaaccggtccttgttccgagtctgaagagaagacatgcaaaaccagcggctcatgccgcggggacatgcagttttgtaaggtggcaggatgcgaacacggcgaggaggccagtgaagctaaatgtagatgctccttagtccataagccaggtgaggttgtggtaagctacgggggcatgagggtgcggcccaaatgttacggattctctcgcatgatggcaactctggaagtctcacagcctgagcaacgaatcggccagtgcacagggtgtcaccttgaatgcatcaacggaggtgtgagattgattaccctgacgagtgagctaaagagcgccactgtttgtgcttcccatttttgttcttcggccaccagcggcaagaaatccacagagatacagttccactcagggagtctcgtgggaaagactgcgatccacgtcaaaggcgcactggtggatggtaccgagttcacatttgaagggtcttgcatgttcccagacggctgcgatgccgtagactgcaccttttgtagggagttccttaagaatccccaatgctatccggctaaaaagtggctgtttattatcatagttattttgctcggatacgccggcctgatgttactgacgaacgtgctcaaggcaatcggggtctggggaagctgggtgatcgctcctgtcaaacttgtgttcgccattatcaagaaactgatgcgggcggtttcctgtttgatgggtaagctaatggatcgtggccgccaggtgattcatgaagaaataggggagaatagagagggaaaccaggacgatgtaaggatcgaaatggcccggccccgacgcgtcagacactggatgtattcaccagtgattctgactatcctcgcaatcggcctggctgagggttgcgacgaaatggttcatgccgatagcaaacttgtgtcttgtaggcaggggtccggcaatatgaaggagtgcgtcacaaccggacgggctctgttgcctgccgtgaaccccggccaagaggcatgtctccactttactgccccagggagtcccgacagcaagtgcctgaaaattaaggtaaaacgcataaatttaaagtgtaaaaagtcttcctcatacttcgtgcctgatgctagaagtaggtgcacaagcgttcgtcggtgtcgatgggcgggagactgccagtcgggctgcccaccgcattttacctccaactctttcagcgacgattgggcaggtaagatggacagagccgggctgggattttcaggctgtagtgatggttgcggcggggctgcctgtggatgcttcaatgcagccccctcctgtatcttttggaggaaatgggtcgaaaaccctcacggcattatctggaaggtgtctccatgcgctgcctgggtgcccagcgcagtcattgagctaacgatgccttccggggaagttcgcaccttccacccaatgtcaggaatccccacacaggtgttcaaaggcgtgagcgtaacttatctcggtagtgacatggaggtctctgggctgaccgatctttgtgaaatagaggagttgaagtccaaaaagctggcgctcgctccgtgcaatcaggccggaatgggcgtggttggtaaagtgggcgaaatccaatgtagctcggaggaatcagcacggacaattaagaaggacgggtgcatctggaacgccgatctggtcggaattgagcttagagtggacgatgctgtttgttactctaaaatcacttctgtggaagccgtagcaaactattccgctatacctaccacaattggcgggctgaggtttgagcgcagccatgactctcagggaaagatcagcggctccccattggatattaccgccatccgaggttcattcagtgtcaattaccgggggctccgtctgagcttatctgagataactgcgacgtgcacaggagaagtgaccaacgtgtccggctgctactcatgtatgactggtgccaaagtcagtatcaagctgcacagctccaaaaattctaccgctcatgttagatgcaagggcgacgagacagcattttcggtgctagaaggggtacacagctattcagtgtccctcagtttcgattacgccgtcgtggacgagcagtgtcagctgaactgcggaggccacgaatctcaagttacccttagggggaatttgatttttctggacgtgcccaagttcgtcgatggaagctatatgcagacttaccattccacagtgcctacgggcgctaacatcccctcaccaaccgactggctcaatgccctgtttggtaacgggttatctcgctggattctgggagttatcggcgtgcttttgggcgggctcgcactgttctttctaataatgagcctgttcaaactcggaactaagcagatttttcggagtagaacaaaactggcgtga

SEQ ID NO: 11625 - RNA, 3222 nt, synthetic construct
  misc_feature 1..3222: note = derived and/or modified CDS sequence (opt3) from SFTSV/Huaiyangshan virus(2010-FQM)__HQ419236.1__GP
  source 1..3222: mol_type = other RNA
atgatgaaggtgatctggttcagctccctgatttgcctcgtcatacagtgtggcggggacaccggacccatcatttgcgccggtcctatccactctaacaaatcagctgatattccacatcttctgggctacagtgagaagatctgtcaaatagacagattgatccacgttagctcctggttaaggaatcattctcagtttcaggggtatgtgggacagcggggcggtcgctcgcaagtatcatactatccggcagaaaacagctacagtcgatggtccgggctgctatctccctgcgatgccgactggctcggaatgctggtggtcaaaaaggcgaaaggcagcgatatgattgtgcctggcccatcctataaggggaaggttttctttgagcgtcccacattcgacggatacgtgggttggggctgtgggtcaggaaaaagtagaactgaaagcggcgagctttgttcttccgattcaggtacgagcagtgggctgttgccttctgacagggtcctctggatcggagatgtggcttgccagccaatgacccccattcctgaagagacatttctggagctgaagtccttcagccagtcggaatttccagacatctgcaaaatagatggcattgtattcaatcagtgtgagggcgaatctctcccgcaaccctttgacgttgcctggatggatgtggggcactcccataagatcattatgcgggagcacaaaactaagtgggtccaggagtcaagtagcaaggacttcgtgtgctataaagaaggaaccggtccttgttccgagtctgaagagaaggcatgcaaagccagcggctcatgccgcggggacatgcagttttgtaaggtggctggatgcgaacacggcgaggaggcaagtgaagccaaatgtagatgctccttagtccataagccaggtgaggttgtggtaagctacgggggcatgagggtgcggcccaaatgttacggattctctcgcatgatggctacactggaagtctcacagcctgagcaacgaatcggccagtgcaccgggtgtcaccttgaatgcatcaacggaggtgtgagattgattactctgacaagtgagctaaagagcgccaccgtttgtgcgtcccatttttgttcttcggcaacgagcggcaagaaatccactgagatacagttccactcagggagtctcgtgggaaagaccgccatccacgtcaaaggcgctctggtggatggtacagagttcacttttgaagggtcttgcatgttcccagacggctgcgatgccgtagactgcaccttttgtagggagttccttaagaatccccaatgctatccggctaaaaagtggctgtttattatcatagttattttgctcggatacgcaggcctgatgttactgacaaacgtgctcaaggccatcggggtctggggaagctgggtgatcgcgcctgtcaaacttgtgttcgccattatcaagaaactgatgcgggcagtttcctgtttgatgggtaagctaatggatcgtggccgccaggtgattcatgaagaaataggggagaatagagagggaaaccaggacgatgtaaggatcgaaatggctcggccccgacgcgtcagacactggatgtattcaccagtgattctgaccatcctcgccatcggcctggctgagggttgcgacgaaatggttcatgccgatagcaaacttgtgtcttgtaggcaggggtccggcaatatgaaggagtgcgtcacgactggacgggcactgttgcctgccgtgaaccccggccaagaggcttgtctccactttacagcgccagggagtcccgacagcaagtgcctgaaaattaaggtaaaacgcataaatttaaagtgtaaaaagtcttcctcatacttcgtgcctgatgcaagaagtaggtgcaccagcgttcgtcggtgtcgatgggccggagactgccagtcgggctgcccaccgcattttacttccaactctttcagcgacgattgggctggtaagatggacagagccgggctgggattttcaggctgtagtgatggttgcggcggggcagcctgtggatgcttcaatgctgccccctcctgtatcttttggaggaaatgggtcgaaaaccctcacggcattatctggaaggtgtctccatgcgcagcgtgggtgcccagcgctgtcattgagctaacaatgccttccggggaagttcgcaccttccacccaatgtcaggaatccccacccaggtgttcaaaggcgtgagcgtaacgtatctcggtagtgacatggaggtctctgggctgacagatctttgtgaaatagaggagttgaagtccaaaaagctggccctcgcaccgtgcaatcaggccggaatgggcgtggttggtaaagtgggcgaaatccaatgtagctcggaggaatcagctcggactattaagaaggacgggtgcatctggaacgccgatctggtcggaattgagcttagagtggacgatgcagtttgttactctaaaatcaccagtgtggaagctgtagccaactattccgcgatacctacaactattggcgggctgaggtttgagcgcagccatgactctcagggaaagatcagcggctccccattggatattaccgccatccgaggttcattcagtgtcaattaccgggggctccgtctgagcttatctgagataacagctacctgcactggagaagtgacgaacgtgtccggctgctactcatgtatgacaggtgcaaaagtcagtatcaagctgcacagctccaaaaattctaccgcccatgttagatgcaagggcgacgagactgctttttcggtgctagaaggggtacacagctattcagtgtccctcagtttcgatcacgccgtcgtggacgagcagtgtcagctgaactgcggaggccatgaatctcaagttacccttagggggaatttgatttttctggacgtgcccaagttcgtcgatggaagctacatgcagacatatcactccaccgtgcctactggcgcaaacatcccctcaccaacagactggctcaatgcgctgtttggtaacgggttatctcgctggattctgggagttatcggcgtgcttttgggcgggctcgccctgttctttctaataatgttcctgtttaaactcggaacgaagcagattttccggagcagaaccaaactggcttga

SEQ ID NO: 11626 - RNA, 3222 nt, synthetic construct
  misc_feature 1..3222: note = derived and/or modified CDS sequence (opt3) from SFTSV/Huaiyangshan virus(2010-LZR)__HQ419237.1__GP
  source 1..3222: mol_type = other RNA
atgatgaaggtgatctggttcagctccctgatttgcctcgtcatacagtgtggcggggacaccggacccatcatttgcgccggtcctatccactctaacaaatcagctgatattccacatcttctgggctacagtgagaagatctgtcaaatagacagattgatccacgttagctcctggttaaggaatcattctcagtttcaggggtatgtgggacagcggggcggtcgctcgcaagtatcatactatccggcagaaaacagctacagtcgatggtccgggctgctatctccctgcgatgccgactggctcggaatgctggtggtcaaaaaggcgaaaggcagcgatatgattgtgcctggcccatcctataaggggaaggttttctttgagcgtcccacattcgacggatacgtgggttggggctgtgggtcaggaaaaagtagaactgaaagcggcgagctttgcagttccgattcaggtacgagcagtgggctgttgccttctgacagggtcctctggatcggagatgtggcttgtcagccaatgacccccattcctgaagagacatttctggagctgaagtccttcagccagtcggaatttccagacatctgcaaaatagatggcattgtattcaatcagtgtgagggcgaatctctcccgcaaccctttgacgttgcctggatggatgtggggcactcccataagatcattatgcgggagcacaaaactaagtgggtccaggagtcaagtagcaaggacttcgtgtgctataaagaaggaaccggtccttgttccgagtctgaagagaagacatgcaaaaccagcggctcatgccgcggggacatgcagttttgtaaggtggcaggatgcgaacacggcgaggaggccagtgaagctaaatgtagatgctccttagtccataagccaggtgaggttgtggtaagctacgggggcatgagggtgcggcccaaatgttacggattctctcgcatgatggcaactctggaagtctcacagcctgagcaacgaatcggccagtgcacagggtgtcaccttgaatgcatcaacggaggtgtgagattgattaccctgacgagtgagctaaagagcgccactgtttgtgcttcccatttttgttcttcggccaccagcggcaagaaatccacagagatacagttccactcagggagtctcgtgggaaagactgcgatccacgtcaaaggcgcactggtggatggtaccgagttcacatttgaagggtcttgcatgttcccagacggctgcgatgccgtagactgcaccttttgtagggagttccttaagaatccccaatgctatccggctaaaaagtggctgtttattatcatagttattttgctcggatacgccggcctgatgttactgacgaacgtgctcaaggcaatcggggtctggggaagctgggtgatcgctcctgtcaaacttgtgttcgccattatcaagaaactgatgcgggcggtttcctgtttgatgggtaagctaatggatcgtggccgccaggtgattcatgaagaaataggggagaatagagagggaaaccaggacgatgtaaggatcgaaatggcccggccccgacgcgtcagacactggatgtattcaccagtgattctgactatcctcgcaatcggcctggctgagggttgcgacgaaatggttcatgccgatagcaaacttgtgtcttgtaggcaggggtccggcaatatgaaggagtgcgtcacaaccggacgggctctgttgcctgccgtgaaccccggccaagaggcatgtctccactttactgccccagggagtcccgacagcaagtgcctgaaaattaaggtaaaacgcataaatttaaagtgtaaaaagtcttcctcatacttcgtgcctgatgctagaagtaggtgcacaagcgttcgtcggtgtcgatgggcgggagactgccagtcgggctgcccaccgcattttacctccaactctttcagcgacgattgggcaggtaagatggacagagccgggctgggattttcaggctgtagtgatggttgcggcggggctgcctgtggatgcttcaatgcagccccctcctgtatcttttggaggaaatgggtcgaaaaccctcacggcattatctggaaggtgtctccatgcgctgcctggattcccagcgcagtgatcgagctaacgatgccttccggggaagtccgcaccttccacccaatgtcaggaatacccacacaggttttcaaaggcgtgagcgtgacttatctcggtagtgacatggaggtatctgggctgaccgatctttgtgaaatcgaggagttgaagtccaaaaagctggcgctcgctccgtgcaatcaggccggaatgggcgtcgtgggtaaagttggcgaaattcaatgtagctcggaggaatcagcacggacaatcaagaaggacgggtgcatttggaacgccgatctggtgggaatcgagcttagagtcgacgatgctgtgtgttactctaaaataacttctgttgaagccgtggcaaactattccgctattcctaccacaatcggcgggctgaggtttgagcgcagccatgactctcagggaaagattagcggctccccattggatatcaccgccatacgaggttcattcagtgtaaattaccgggggctccgtctgagcttatctgagatcactgcgacgtgcacaggagaagtcaccaacgtgtccggctgctactcatgtatgactggtgccaaagtgagtattaagctgcacagctccaaaaattctaccgctcatgtcagatgcaagggcgacgagacagcattttcggttctagaaggggtgcacagctattcagtatccctcagtttcgatcacgccgtggtcgacgagcagtgtcagctgaactgcggaggccatgaatctcaagtgacccttagggggaatttgatctttctggacgttcccaagttcgtggatggaagctacatgcagacttatcactccacagtccctacgggcgctaacattccctcaccaaccgactggctcaatgccctgtttggtaacgggttatctcgctggatcctgggagtgataggcgttcttttgggcgggctcgcactgttctttctaattatgagcctgttcaaactcggaactaagcagatctttcggagtagaacaaaactggcgtga

SEQ ID NO: 11627 - RNA, 3222 nt, synthetic construct
  misc_feature 1..3222: note = derived and/or modified CDS sequence (opt3) from SFTSV/Huaiyangshan virus(2010-T112)__HQ419238.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaaccagcctgtgcaacgaatcggacagtgcactggctgtcacctggagtgcatcaatgggggagttagacttattacattgaccagcgaactgaagtccgccacggtgtgtgcttctcatttctgctcgagcgccacttccggtaagaaatcaaccgagatacagttccacagtggctctctagtcgggaagacagcgatccacgtgaaaggagcactcgtagatggcactgagtttaccttcgaaggtagctgtatgtttccagacgggtgcgatgccgttgactgcacattctgtagggagtttctgaagaacccccaatgctatccggctaaaaagtggcttttcattatcatagtgattctgttgggctacgccggactcatgctgttaaccaatgtcctgaaggcaatcggcatctgggggtcctgggtgattgctcctgtcaaactcatctttgccattataaagaaacttatgcggacggtgtcatgtctgatgggaaagttgatggatcgtggtcgccaggttatccatgaagagattggcgaaaacagagaggggaatcaggacgatgtgaggatcgagatggcgcggccccgacgcgtaagacactggatgtatgccccagtcatcctaactattctggcaatgggactcgctgaaagctgcgacgagatggtgcatgccgattctaaactggtttcctgtaggcagggcagtggtaacatgaaggaatgcgtgacaaccgggcgggcccttctgcctgctgtcaatcccggccaagaggcatgtttgcacttcactgccccaggaagccccgactctaagtgcctcaaaataaaggtgaaacgcatcaacctgaagtgtaaaaagtcctcaagttactttgtacctgatgctagatcgaggtgcacaagcgtgcgtcggtgtcgatgggcgggcgactgccagtccgggtgcccaccgcatttcacctctaatagcttttcagacgattgggcaggaaagatggacagagccggcttaggtttcagtgggtgttccgatggatgcggcggtgctgcctgtggctgctttaacgcagccccctcttgtattttctggaggaaatgggttgagaatcctcacgggatcatttggaaggtcagcccatgcgtggcttgggtgccctccgccgtcatcgaactgacgatgccttcaggagaggttcgcaccttccacccaatgagcggcatacccacacaggtgtttaaaggggtgagtgtaacttatctaggatctgacatggaagtctccggcctcaccgatctgtgtgagatcgaggaacttaagagcaaaaagttggcactggcgccgtgcaaccaggctggtatgggggtggttggaaaagtgggcgagattcaatgttcgtcagaagagtctgcccggacaatcaagaaggacggttgcatttggaacgcagatctcgtcggcatcgaactgagagtggacgatgccgtttgttacagtaaaataacttccgtggaggctgtagccaattatagcgcaattcctaccacaatcgggggacttaggttcgaacgctctcatgacagccagggcaagatttccgggtcaccactggatatcaccgctatacgaggaagttttagcgtcaactaccggggcttgcgtctctctctgtccgagatcactgccacgtgcacaggtgaggtgaccaatgtgtcagggtgctacagttgtatgactggagcgaaagtcagcattaagttacactcctctaaaaactcgaccgcccatgttagatgcaagggcgacgaaacagctttcagcgtgctggagggtgtacactcatataccgtgtccctaagttttgatcacgcagtcgtggacgaacagtgtcagctcaattgcggcgggcatgagtctcaagttactctgaagggaaaccttatcttcttggacgtgcccaaatttgtcgatggcagctacatgcagacatatcactccacggtgcctaccggggccaatattccctcaccaactgactggctgaacgctctcttcggaaatggcctgtctaggtggatcttaggtgttataggggtgctgcttggaggcttggccctctttttcatgattatgagcctgtttaagctaggcacaaaacaggtcttccgcagtcggaccaagctggcatga

SEQ ID NO: 11628 - RNA, 3222 nt, synthetic construct
  misc_feature 1..3222: note = derived and/or modified CDS sequence (opt3) from SFTSV/Huaiyangshan virus(2010-WJ)__HQ419229.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggaaacggggaggccgcagccaggtaagttactatttagcagaaaactcctactctcgatggagcggtctgctatccccgtgcgatgccgactggctcgggatgctggtggtcaagaaagcgaagggatcagatatgattgtgcccggccctagttataagggcaaagttttcttcgagcgtccaacctttgacgggtacgtgggatggggttgtggcagcgggaagtctagaacagaatccggagagctttgctcaagcgatagtggcacttcttccggtctgttgcccagcgacagggtcctctggatcggggatgtggcttgtcaacctatgacgccaattcccgaagagaccttcctggagctgaaatcgttttctcagtccgaatttcctgacatctgcaagatagatggaattgtatttaatcagtgtgagggcgaatcactcccacagccgttcgacgttgcctggatggatgtgggccacagtcataaaatcattatgcgggagcacaagacaaagtgggtccaagagagctcctctaaagactttgtgtgctataaggaagggactggaccctgtagcgagtcagaagagaaaacctgcaagacaagtggttcctgccgcggcgacatgcagttctgtaaagtggcagggtgcgaacacggagaggaggccagcgaagctaagtgtagatgctctttagtccataaacctggcgaggttgtggtatcatacggtgggatgagggtgcggccaaagtgttacggctttagtcgcatgatggcaaccctggaagtcaaccagcccgagcagcgaatcggacaatgcactggctgtcaccttgaatgcatcaatgggggagtgagattgattacactgaccagcgagctaaagtccgccacggtttgtgcttctcatttctgctcgagcgccacttccggtaaaaagtcaaccgagatacagttccacagtggctctctcgtggggaaaacagcgatccacgtcaagggagcactggtggatggcactgaatttaccttcgagggtagctgtatgtttcctgacgggtgcgatgccgtagactgcacattctgtagggaatttcttaaaaacccacagtgctatcccgctaagaagtggctgttcattatcatagttattttgctcggctacgccggactgatgttactgaccaatgtgctcaaagcaatcggcatctgggggtcctgggtcattgctccggtgaaacttatctttgccattataaagaagctgatgcggacggtctcatgtttgatgggaaaactaatggatcgtggtcgccaagtgatccatgaggaaattggcgagaacagagaggggaatcaggacgatgttaggatcgaaatggcgcggcctcgacgcgtgagacactggatgtatagccccgtaatcctgactattctcgccataggactggcagagtcttgcgacgaaatggtccatgctgattccaaacttgtgagttgtaggcagggcagcggtaacatgaaggagtgcgttacaaccgggcgggccctgttgccagctgtgaatcctggccaggaggcctgtctccacttcactgcacccggatctccagactccaagtgcctgaagatcaaagtcaagcgcattaacttaaaatgtaagaagtcaagtagctactttgtgcccgatgccagatcgaggtgcacatccgtacgtcggtgtcgatgggctggcgactgccaatctgggtgccctccacatttcaccccgaatagcttttcagacgattgggcgggaaaaatggacagagcaggcctgggtttcagtgggtgttccgatggatgcggcggtgccgcttgtggctgctttaacgccgcaccctcttgtatcttctggaggaagtgggtggaaaatcctcacgggattatctggaaagttagcccatgcgccgcttgggtcccctccgccgtgatagagctaacgatgccttcaggagaagtgcgcaccttccacccaatgagcggcatccccacacaggtctttaagggggttagtgtgacttatctcggatctgacatggaggtgtccggcctgaccgatctttgtgaaattgaggagttgaaaagcaagaaactggcactcgcgccgtgcaaccaggctggtatgggggtagtcggaaaggtgggcgaaatccagtgttcgtcagaggaatctgcccggacaattaagaaagacggttgcatctggaacgcagatctggttggcatagagcttagagtggacgatgccgtctgttacagtaagattacttccgtggaagctgttgccaattatagcgcaatccctaccacaattgggggactgaggttcgagcgctctcatgacagccaaggcaaaatctccgggtcaccattggatataaccgctatccgaggaagttttagcgtgaactaccggggcctccgtctgtctttatccgagattactgccacgtgcacaggtgaagtaaccaatgtctcagggtgctacagttgtatgactggagcgaaggtgagcatcaaactgcactcctctaagaactcgaccgcccatgtgagatgcaagggcgacgagacagctttcagcgtcctagaaggtgttcactcatataccgtgtccctcagttttgatcacgcagtagtggacgagcagtgtcagctgaattgcggcgggcatgaatctcaggtcactcttaaaggaaacttgattttcctggacgtgcccaagtttgttgatggcagctacatgcaaacatatcactccacggtgcctaccggggccaatatcccctcaccaactgactggctcaacgctctgttcggaaatggcttatctaggtggatactgggtgtcattggggtgcttttgggaggcctcgccctgtttttcatgatcatgagcctatttaaactgggcacaaagcaggttttccgcagtcggaccaaactcgcatga

SEQ ID NO: 11629 - RNA, 3222 nt, synthetic construct
  misc_feature 1..3222: note = derived and/or modified CDS sequence (opt3) from SFTSV/Huaiyangshan virus(2010-WJQ)__HQ419230.1__GP
  source 1..3222: mol_type = other RNA
atgatgaaggtgatctggttcagctccctgatttgcctcgtcatacagtgtggcggggacaccggacccatcatttgcgccggtcctacacactctaacaaatcagctgatatcccacatcttctgggctacagtgagaagatttgtcaaatcgacagattgatacacgttagctcctggttaaggaatcattctcagtttcaggggtatgtgggacagcggggcggtcgctcgcaagtatcatactatccggcagaaaacagctacagtcgatggtccgggctgctatctccctgcgatgccgactggctcggaatgctggtggtcaaaaaggcgaaaggcagcgatatgatcgtgcctggcccatcctataaggggaaggttttctttgagcgtcccactttcgacggatacgtgggttggggctgtgggtcaggaaaaagtagaacggaaagcggcgagctttgcagttccgattcaggtaccagcagtgggctgttgccttctgacagggtcctctggattggagatgtggcttgtcagccaatgacacccatccctgaagagacttttctggagctgaagtccttcagccagtcggaatttccagacatttgcaaaatcgatggcatagtattcaatcagtgtgagggcgaatctctcccgcaaccctttgacgttgcctggatggatgtggggcactcccataagattatcatgcgggagcacaaaaccaagtgggtccaggagtcaagtagcaaggacttcgtgtgctataaagaaggaacaggtccttgttccgagtctgaagagaagacctgcaaaactagcggctcatgccgcggggacatgcagttttgtaaggtggcaggatgcgaacacggcgaggaggccagtgaagctaaatgtagatgctccttagtccataagccaggtgaggttgtggtaagctacgggggcatgagggtgcggcccaaatgttacggattctctcgcatgatggcaacactggaagtctcacagcctgagcaacgaattggccagtgcaccgggtgtcaccttgaatgcatcaacggaggtgtgagattgatcacgctgacttctgagctaaagagcgccaccgtttgtgcttcccatttttgttcttcggccacaagcggcaagaaatccactgagattcagttccactcagggagtctcgtgggaaagaccgcgatacacgtcaaaggcgcactggtggatggtacagagttcacctttgaagggtcttgcatgttcccagacggctgcgatgccgtagactgcacgttttgtagggagttccttaagaatccccaatgctatccggctaaaaagtggctgtttatcattatcgttatattgctcggatacgccggcctgatgttactgactaacgtgctcaaggcaattggggtctggggaagctgggtgatcgctcctgtcaaacttgtgttcgccatcattaagaaactgatgcgggcggtttcctgtttgatgggtaagctaatggatcgtggccgccaggtgatccatgaagaaattggggagaatagagagggaaaccaggacgatgtaaggatagaaatggcccggccccgacgcgtcagacactggatgtattcaccagtgatcctgacaattctcgcaatcggcctggctgagggttgcgacgaaatggttcatgccgatagcaaacttgtgtcttgtaggcaggggtccggcaatatgaaggagtgcgtcaccactggacgggctctgttgcctgccgtgaaccccggccaagaggcatgtctccactttacagccccagggagtcccgacagcaagtgcctgaaaatcaaggtaaaacgcattaatttaaagtgtaaaaagtcttcctcatacttcgtgcctgatgctagaagtggatgcaccagcgttaggcgttgtcggtgggcgggcgactgccagtcgggttgcccaccgcattttacgtccaactctttcagcgacgattgggcagggaagatggaccgagccggactgggcttttcaggttgtagtgatggctgcgggggagctgcctgtggctgcttcaatgcagccccctcctgtatattttggagaaaatgggtcgaaaaccctcacgggatcatttggaaggtgtctccatgcgctgcctgggtgcccagcgcagtcatcgagctaaccatgccttccggagaagttaggacattccacccaatgtcaggcattcccactcaggtgttcaaaggtgtgagcgtaacctatctcgggagtgacatggaggtctctggactgacagatctttgtgaaatcgaggagttgaagtccaaaaagctggcgctcgctccgtgcaatcaggccggcatgggtgtggttggcaaagtgggggaaatacaatgtagctcggaggaatcagcacgcactatcaagaaggacggatgcatttggaacgccgatctggtcggcatcgagcttcgggtggacgatgctgtttgttactctaaaattaccagtgtggaagccgtagcaaactattccgctatccctacaaccatagggggactgagatttgagaggagccatgactctcagggcaagattagcggttccccattggatatcactgccattcgcgggtcattcagtgtcaattaccgaggactccggctgagcttatctgagatcacggcgacatgcaccggcgaagtgactaacgtgtccggttgctactcatgtatgaccggcgccaaagtcagtataaagctgcacagctccaaaaattctacagctcatgttcgttgcaagggggacgagaccgcattttcggtgctagaaggagtacacagctattcagtgtccctcagtttcgatcacgccgtcgtggacgagcagtgtcagctgaactgcggcgggcatgaatctcaagttactcttagaggaaatttgatctttctggacgtgcccaagttcgtcgatggcagctacatgcagacatatcactccacggtgcctaccggtgctaacattccctcaccaactgactggctcaatgccctgtttgggaacggattatctaggtggatcctgggcgttattggcgtgcttctcgggggattggcactgttctttctaatcatgagcctgttcaaactcggtacaaagcagatatttcgcagtcggaccaaactggcgtga

SEQ ID NO: 11630 - RNA, 3222 nt, synthetic construct
  misc_feature 1..3222: note = derived and/or modified CDS sequence (opt3) from SFTSV/Huaiyangshan virus(2010-WSQ)__HQ419235.1__GP
  source 1..3222: mol_type = other RNA
atgatgaaggtgatctggttcagctccctgatttgcctcgtcatacagtgttctggcgactcagggcccatcatttgcgccggacctatccacagtaacaaaagcgctggtattccacatcttctgggctactccgagaagatctgtcaaatagatagattgatccacgtttcttcgtggttaaggaatcattcacagtttcaggggtatgtgggacagcggggcggtcgcagccaagtaagttactatccggcagaaaactcctactctcgatggagcgggctgctatccccctgcgacgccgattggctcggaatgctggtggtcaaaaaggcgaaagagtcagacatgattgtgcctggcccaagttataagggcaaggttttctttgaacgtcccaccttcgatgggtacgtgggatggggttgtggcagcgggaaatctagaacagagtccggagaactttgctcaagcgacagtggcacttcttccggtctgttgcctagcgatagggtcctctggatcggggacgtggcttgtcagccaatgacgcccattcctgaggagacctttctggaactgaagtcgttctctcagtccgagtttccagatatctgcaaaatagacggaattgtattcaatcagtgtgaaggcgagtcactcccgcaaccctttgatgttgcctggatggacgtgggccacagtcataagatcattatgcgggagcacaaaacaaagtgggtccaggaaagctcctctaaggatttcgtgtgctataaagaggggactggaccttgtagcgaatcagaggaacgcgcatgcaagaccagtggttcctgcagaggcgacatgcagttttgtaaagtggccgggtgcgagcacggagaggaagctagcgaggcaaagtgtaggtgctctttagtccataaaccaggcgaagttgtggtatcatacggtgggatgcgggtgcgccccaagtgttacggcttcagtcgaatgatggccacactggaggtcaaccctccagaacagagaatcggacaatgcaccggctgtcaccttgagtgcatcaatgggggagtgaggttgattactctgacaagcgagctacggtccgctaccgtttgtgcctctcatttttgctcgagcgcgacgtccggtaaaaagtcaactgaaatacacttccacagtggctctctcatcgggaagaccgcaattcatgtgaaaggagccctggtcgacggcacagagttcacttttgaaggtagctgtatgttccccgatgggtgcgacgctgtggattgcaccttttgtcgtgagttccttaagaacccgcagtgctatcctgccaaaaagtggctgtttatcataattgtaatcttgctcggctacgcaggactgatgttactgacaaatgttctcaaagctatcggcgtgtgggggtcctgggtcattgcccccgtgaagttgatgttcgcgatcattaagaaactgatgcgcaccgtctcatgtttggtgggaaagctaatggacagaggtaggcaggttatacacgaagagatcggcgagaacggggaaggaaatcaagatgacgtgcggattgagatggcccgaccacgcagagtaaggcattggatgtatagccctgtcatcctgacgatcctcgcaattggcctggctgaagattgcgacgagatggtgcacgccgattctaaacttgtttcctgtcggcagggtagtgggaacatgaaggagtgcataactacaggccgcgctctgttgcccgccgtgaatccaggacaggaagcatgtctccattttaccgcccccggcagccctgactctaaatgcctgaagatcaaggtcaaaagaattaacttaaagtgtaaaaagtcctcaagttacttcgtgccagatgctaggagccgttgcacttcggtacggcgatgtagatgggcgggggactgccagtccggatgcccgccccactttacatctaatagcttctcagacgattgggcaggcaaaatggacagggccggtctggggtttagtggatgttccgatggctgcggtggcgctgcctgtgggtgcttcaacgcagccccttcttgtatcttttggcgcaagtgggtggagaatccacacggaattatctggaaggttagcccctgcgctgcctgggtcccttccgcagtgatagaactaaccatgccatcaggcgaggtgcggacgttccatcccatgagcgggatcccgacccaagtcttcaaaggagttagtgtgacatatctcggctctgacatggaagtgtccggtctgactgatctttgtgagattgaggaacttaagagcaaaaagctggcgctcgctccttgcaaccaggccgggatgggagtagtcggcaaagtgggtgagatccagtgttcgtcagaagagtctgcaagaaccattaagaaagacggctgcatctggaacgccgatctggttgggatagaacttagggtggacgatgctgtctgttacagtaagattacatccgtggaggccgttgcaaattatagcgctatcccaactaccattggaggcctgcgctttgagaagtctcacgacagccaggggaaaatctccggatcacccttggatataacagccatccgaggcagtttcagcgtgaactaccggggtctccgtctgtctttatccgaaattaccgcgacttgcacgggggaggtaacaaatgtctcaggatgctacagttgtatgaccggcgccaaggtgagcatcaaactgcattcctctaagaactcgactgctcacgtgagatgcaaaggtgacgaaaccgcatttagcgtcctagagggcgttcactcatatattgtgtccctcagtttcgatcatgccgtagtggacgaacaatgtcagctgaattgcgggggacacgagtctcaggtcacacttaagggcaacttgatctttctggacgtgcctaagttcgttgatgggagctacatgcagacctatcattccactgtgcccacaggagctaatataccatcacctacggactggctcaacgccctgtttggcaatggtttatctaggtggattctgggggtcatcggagtgcttttgggcggcctcgcactgttctttctaatcatgttcctgctcaaactggggaccaagcaagtttttcgcagccggactaaacttgcgtga

SEQ ID NO: 11631 - RNA, 3222 nt, synthetic construct
  misc_feature 1..3222: note = derived and/or modified CDS sequence (opt3) from SFTSV/Huaiyangshan virus(2010-WWG)__HQ419231.1__GP
  source 1..3222: mol_type = other RNA
atgatgaaggtgatctggttcagcaccctgatttgctttgtcatacagtgttccggcgactctgggcccatcatttgcgccggacctatccactcaaacaaaagtgctgatattccacatctccttggttacagcgagaagatctgtcaaatagacagactgatccacgtttcctcttggttgaggaatcattcgcagttccagggctatgtggggcagcggggaggccgctcacaagtaagctactatccggcagaaaacagttactcccgatggtctggtttactgagcccctgcgatgccgactggctagggatgctcgtggtcaaaaaggcgaaaggatccgatatgattgtgcctggcccatcatataagggcaaggttttcttcgagcgtcccacatttgacgggtacgtgggatggggttgtggcagtgggaaaagcagaactgaatctggagagctgtgctcctcagatagcggcacgagttctggtcttctgccttccgacagggtcttgtggatcggggatgtggcttgtcagccaatgacccccattcctgaagagacattcctcgagcttaagagcttttcgcagtctgaatttccagacatctgcaaaatagatggaattgtatttaatcagtgtgagggcgaatccctgccgcaacccttcgacgttgcctggatggatgtgggccactcacataagatcattatgcgggagcacaaaactaagtgggtccaggagagtagctccaaggactttgtgtgctataaagaagggaccggaccttgttctgagagcgaagagaagacatgcaaaacctcaggtagttgccgcggcgacatgcagttctgtaaggtggcagggtgcgaacacggagaggaggcctccgaagctaaatgtagatgcagcctcgtccataagccaggcgaggttgtggtatcttacggtgggatgagggtgcggcccaaatgttacggctttcctcgcatgatggcaactttagaagtcaaccagccagagcaacgaatcggacagtgcacaggctgtcacctggaatgcatcaatgggggagtgagacttattaccttgacgtcagagctgaggagtgccactgtttgtgctagccatttctgctcctctgccacctcgggtaaaaagagcacagagatacagttccactccggcagtctagtggggaaaactgcgatccacgtcaagggagcactcgtggatggcaccgaatttacattcgagggtagttgtatgtttcccgacgggtgcgatgccgtagactgcaccttctgtcgggaatttctgaaaaacccgcaatgctatcctgctaagaaatggcttctgattatcatagttattttgctcggctacgccggactgatgttactgacgaatgtgctcaaggcaatcggcatctgggggtcttgggtcattgctcccgtgaagctgatcttcgccattataaagaagctgatgcgtgcggtcagctgtttgatgggaaaactaatggatcgcggtagacaggtgatccatgagggcattggggaaaacagggagggaaatcaggacgatgttcggatcgagatggcccgaccacgcagagtgaggcactggatgtattcccctgtaatcctgactattctcgcaataggcctggctgaatcatgcgacgagatggtccatgccgatagcaaacttgtgtcttgtcggcagggttccgggaacatgaaggaatgcgttacaaccggccgcgctctgttgcccgccgtgaatccaggacaagaggcatgtctccactttactgcccccggcagtcctgacagcaagtgcctgaagatcaaagtcaagagaattaacttaaaatgtaagaaatcttcctcatacttcgtgccagatgctaggagtcgttgcacaagcgtacggcgatgtagatgggcgggggactgccagtcgggatgcccgccccattttacctccaattctttcagcgacgattgggcaggcaagatggacagggccggtctggggttttcaggatgtagtgatggctgcggtggcgctgcctgtgggtgcttcaacgcagccccttcctgtatcttttggcgcaagtgggtggagaatccacacggaattatctggaaagtttctccctgcgctgcctgggtccctagcgcagtgatagaactaacgatgccatccggcgaggtgcggaccttccaccccatgtcagggatcccgacacaggtcttcaagggagttagcgtgacttatctcggcagtgacatggaagtgtctggtctgaccgatctttgtgagattgaagagttgaaatccaagaaactggcgctcgctccttgcaaccaggccgggatgggagtagtcggcaaggtgggtgagatccaatgtagctcggaagagtcagcaagaacaattaaaaaggacggctgcatctggaacgccgatctggttgggatagaacttagggtggacgatgctgtctgttactctaagattacttcagtggaggccgttgcaaattattccgctatcccaaccacaattggaggcctgcgctttgaacgaagccatgactctcaggggaaaatcagcggatcccccttggatataaccgccatccggggctcattcagtgtgaactaccgtggtctcagactgagcttatctgagattactgcgacgtgcacaggggaggtaaccaatgtctccggatgctactcatgtatgactggcgccaaggtgagtatcaaactgcacagctccaagaactctaccgctcatgtgaggtgcaaaggtgacgaaacagcattttcggtcctagagggcgttcacagctataccgtgtcactctccttcgatcacgccgtagtggacgaacagtgtcagctgaattgcgggggacatgagagtcaagtcactcttaagggcaacttgatttttctggacgtgcctaagttcgttgatgggtcttacatgcagacatatcacagcacggtgcccaccggagctaatatcccatcccctactgactggctcaacgccctgtttggcaatggtttatcacgctggatactgggggtcattggagtgcttttgggcggcctcgcactgttctttatgatcatgtctctattcaaactggggacaaagcaggtttttcggagcagaaccaaactcgcgtga

SEQ ID NO: 11632 - RNA, 3222 nt, synthetic construct
  misc_feature 1..3222: note = derived and/or modified CDS sequence (opt3) from SFTSV/Huaiyangshan virus(2010-WWX)__HQ419232.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaaccagcctgagcaacgaatcggacagtgcactggctgtctgcttgaatgcatcaatgggggagtgagattgattacactgaccagcgagctaaagtccgccacggtttgtgcttctcacttctgctcgagcgccacttccggtaagaaatcaaccgagatacagttccatagtggctctctcgtggggaagacagcgatccacgtcaaaggagcactgattgatggcactgaatttaccttcgagggtagctgtatgtttccagacgggtgcgatgccgtggactgcacattctgtagggaatttcttaagaacccccaatgctatccggctaaaaagtggctgttcatcataattgtaatcttgctcggctacgccggactgatgttactgaccaatgttctcaaggcaatcggcatttgggggtcctgggtgatcgctcctgtcaaacttatttttgccataatcaagaaactgatgcggacggtgtcatgtttgatgggaaagctaatggatcgtggtcgccaggtcattcacgaggaaatcggcgagaacagagaggggaatcaggacgatgtgaggatcgaaatggcgcggccccgacgcgttagacattggatgtatagcccagtgattctgactatactcgccatcggactggcagagtcttgcgacgaaatggtacacgctgattccaaacttgtcagttgtaggcagggcagcggtaacatgaaggagtgcgtgacaaccgggcgggccctgttgcctgctgttaatcccggccaagaggcctgtctccatttcactgcaccaggatctcccgactccaagtgcctgaaaattaaggtgaaacgcatcaacttaaagtgtaaaaagtcaagtagctactttgtccctgatgccagatcgaggtgcacatccgtgcgtcggtgtcgatgggctggcgactgccagtctgggtgcccaccgcacttcaccagcaattcatttagtgacgattgggcgggaaagatggacagagcaggcctgggtttctccgggtgttctgatggatgcggcggtgccgcttgtggctgctttaacgccgcacccagctgtattttctggaggaaatgggtagaaaatcctcatgggatcatatggaaggtgtccccatgcgccgcttgggttccctcagccgtcatcgagctaacgatgcctagcggagaagtgcgcaccttccacccaatgagtggcattcccacacaggtgtttaaaggggtctctgttacttatctcggatccgacatggaggtgagcggcctgaccgatctttgtgaaatcgaggagttgaagtcgaaaaagctggcactcgcgccgtgcaaccaggctggtatgggggtggtaggaaaagtcggcgaaattcaatgttcatctgaggaaagtgcccggacaatcaagaaggacggttgcatatggaacgcagatctggtgggcattgagcttagagttgacgatgccgtgtgttactccaaaatcactagcgtcgaagctgtggccaattattctgcaattcctaccacaatcgggggactgaggttcgagcgcagccacgactcccagggcaagatatcagggagtccattggatatcaccgctattcgaggcagcttttctgttaactaccggggactccgtctgtccttatcagagatcactgccacgtgcacaggtgaagtgaccaatgtaagtgggtgctacagctgtatgactggagcgaaagtctccattaagctgcattcttcgaaaaacagcaccgcccacgtgagatgcaagggcgacgagacagctttctcagtgctagaaggtgtccattcctataccgttagtctctcttttgatcacgcagtggtagacgagcagtgtcagctgaattgcggcgggcacgaaagccaagtgactcttaagggaaacttgatcttcctggacgtccccaaatttgtggatggctcctacatgcagacatatcattcaacggttcctaccggggccaatataccctctccaactgactggctcaacgctctgttcggaaatggcttaagtaggtggattctgggtgtgatcggggtccttttgggaggcctcgccctgtttttcatgatcatgagcctatttaagctgggcacaaaacaggtgttccgctcccggaccaagctcgcatga

SEQ ID NO: 11633 - RNA, 3222 nt, synthetic construct
  misc_feature 1..3222: note = derived and/or modified CDS sequence (opt3) from SFTSV/Huaiyangshan virus(2010-ZGQ)__HQ419233.1__GP
  source 1..3222: mol_type = other RNA
atgatgaaggtgatctggttcagctccctgatttgcctcgtcatacagtgtggcggggacaccggacccatcatttgcgccggtcctacacactctaacaaatcagctgatatcccacatcttctgggctacagtgagaagatttgtcaaatcgacagattgatacacgttagctcctggttaaggaatcattctcagtttcaggggtatgtgggacagcggggcggtcgctcgcaagtatcatactatccggcagaaaacagctacagtcgatggtccgggctgctatctccctgcgatgccgactggctcggaatgctggtggtcaaaaaggcgaaaggcagcgatatgatcgtgcctggcccatcctataaggggaaggttttctttgagcgtcccactttcgacggatacgtgggttggggctgtgggtcaggaaaaagtagaacggaaagcggcgagctttgcagttccgattcaggtaccagcagtgggctgttgccttctgacagggtcctctggattggagatgtggcttgtcagccaatgacacccatccctgaagagacttttctggagctgaagtccttcagccagtcggaatttccagacatttgcaaaatcgatggcatagtattcaatcagtgtgagggcgaatctctcccgcaaccctttgacgttgcctggatggatgtggggcactcccataagattatcatgcgggagcacaaaaccaagtgggtccaggagtcaagtagcaaggacttcgtgtgctataaagaaggaacaggtccttgttccgagtctgaagagaagacctgcaaaactagcggctcatgccgcggggacatgcagttttgtaaggtggcaggatgcgaacacggcgaggaggccagtgaagctaaatgtagatgctccttagtccataagccaggtgaggttgtggtaagctacgggggcatgagggtgcggcccaaatgttacggattctctcgcatgatggcaacactggaagtctcacagcctgagcaacgaattggccagtgcaccgggtgtcaccttgaatgcatcaacggaggtgtgagattgatcacgctgacttctgagctaaagagcgccaccgtttgtgcttcccatttttgttcttcggccacaagcggcaagaaatccactgagattcagttccactcagggagtctcgtgggaaagaccgcgatacacgtcaaaggcgcactggtggatggtacagaatttacctttgaggggtcttgcatgttcccagacggctgcgatgccgtagactgcacgttttgtagggagttccttaagaatccccaatgctatccggctaaaaagtggctgtttatcattgttgtgatcttgctcggatacgccggcctgatgttactgactaacgtcctcaaggcaataggggtgtggggaagctgggtcattgctcctgtgaaacttgttttcgccatcatcaagaaactgatgcgggcggtgtcctgtttgatgggtaagctaatggatcgtggccgccaggtaattcatgaagaaatcggggagaatagagagggaaaccaggacgatgtcaggattgaaatggcccggccccgacgcgtgagacactggatgtattcaccagttatactgacaatcctcgcaattggcctggctgagggttgcgacgaaatggtgcatgccgatagcaaacttgtctcttgtaggcaggggtccggcaatatgaaggagtgcgtgaccactggacgggctctgttgcctgccgtaaaccccggccaagaggcatgtctccactttacagccccagggagtcccgacagcaagtgcctgaaaatcaaggtgaaacgcatcaatttaaagtgtaaaaagtcttcctcatacttcgttcctgatgctagaagtaggtgcaccagcgtccgtcggtgtcgatgggcgggagactgccagtcgggctgcccaccgcattttacgtccaactctttcagcgacgattgggcaggtaagatggacagagccgggctgggattttcaggctgtagtgatggttgcggcggggctgcctgtggatgcttcaatgcagccccctcctgtattttctggaggaaatgggtggaaaaccctcacggcataatctggaaggtgtctccatgcgctgcctgggtccccagcgcagttattgagctaaccatgccttccggggaagtgcgcacattccacccaatgtcaggaatccccactcaggtgttcaaaggcgtaagcgtcacctatctcggtagtgacatggaggtgtctgggctgacagatctttgtgaaattgaggagttgaagtccaaaaagctggcgctcgctccgtgcaatcaggccggaatgggcgttgtgggtaaagtcggcgaaatccaatgtagctcggaggaatcagcacggactataaagaaggacgggtgcatctggaacgccgatctggtgggaattgagcttagagttgacgatgctgtgtgttactctaaaatcaccagtgtagaagccgtcgcaaactattccgctattcctacaaccatcggcgggctgaggtttgagcgcagccatgactctcagggaaagataagcggctccccattggatattactgccatccgaggttcattcagtgtgaattaccgggggctccgtctgagcttatctgagattacggcgacatgcaccggagaagtgactaacgtctccggctgctactcatgtatgaccggtgccaaagttagtatcaagctgcacagctccaaaaattctacagctcatgtgagatgcaagggcgacgagaccgcattttcggtactagaaggggtgcacagctattcagtctccctcagtttcgatcacgccgtggttgacgagcagtgtcagctgaactgcggaggccatgaatctcaagtgactcttagggggaatttgatatttctggacgtccccaagttcgtggatggaagctacatgcagacatatcactccacggttcctaccggcgctaacatcccctcaccaactgactggctcaatgccctgtttggtaacgggttatctcgctggattctgggagtgatcggcgtccttttgggcgggctcgcactgttctttctaattatgagcctgttcaaactcggaacaaagcagatctttcggagtagaaccaaactggcgtga

SEQ ID NO: 11634 - RNA, 3222 nt, synthetic construct
  misc_feature 1..3222: note = derived and/or modified CDS sequence (opt3) from SFTSV/Huaiyangshan virus(M-HZM)__JF951393.1__GP
  source 1..3222: mol_type = other RNA
atgatgaaggtgatctggttcagctccctgacctgcctcgtcattcagtgttctggcgactcagggcccataatctgcgccggacctattcacagtaacaaaagcgctggtatcccacatcttctgggctactccgagaagatttgtcaaatcgatagattgatacacgtttcttcgtggttaaggaatcattcacagtttcaggggtatgtgggacagcggggcggtcgcagccaagtaagttactatccggcagaaaactcctactctcgatggagcgggctgctatccccctgcgacgccgattggctcggaatgctggtggtcaaaaaggcgaaagagtcagacatgatcgtgcctggcccaagttataagggcaaggttttctttgaacgtcccacattcgatgggtacgtgggatggggttgtggcagcgggaaatctagaactgagtccggagaactttgctcaagcgacagtggcacgtcttccggtctgttgcctagcgatagggtcctctggattggggacgtggcttgtcagccaatgacccccatccctgaggagacatttctggaactgaagtcgttctctcagtccgagtttccagatatttgcaaaatcgacggaatagtattcaatcagtgtgaaggcgagtcactcccgcaaccctttgatgttgcctggatggacgtgggccacagtcataagattatcatgcgggagcacaaaactaagtgggtccaggaaagctcctctaaggatttcgtgtgctataaagaggggaccggaccttgtagcgaatcagaggaaaaggcatgcaaaacaagtggttcctgccgcggcgacatgcagttttgtaaggtggccgggtgcgagcacggagaggaagctagcgaggcaaaatgtagatgctctttagtccataagccaggcgaagttgtggtatcatacggtgggatgagggtgcggcccaaatgttacggcttcagtcgcatgatggccaccctggaggtcaaccctccagaacagcgaattggacaatgcactggctgtcaccttgagtgcatcaatgggggagtgagattgatcacactgaccagcgagctaaggtccgctacggtttgtgcctctcatttttgctcgagcgcgacttccggtaagaagaacaccgaaattcacttccactcaggcagtctcgtggggaaaacagcaatacatgtcaagggagccctggtggacggcactgagttcacctttgaaggttcttgtatgttccccgatgggtgcgacgctgtagattgcacattttgtcgggagttccttaaaaatccgcagtgctatcctgccaagaaatggctgtttatcattatcgttatattgctcggctacgcaggactgatgttactgaccaacgtgctcaaggctattggcgtctgggggagctgggtgatcgcccccgtcaaacttatgttcgcgatcattaagaagctgatgcgtacggtgtcctgtttggttggaaaactaatggaccgcggtagacaggtgatccacgaagagattggcgagaatggggaaggaaaccaagatgacgtaaggatagagatggcccggccacgacgcgtcagacattggatgtattcacctgtgatcctgactattctcgcaatcggcctggctgaaggttgcgatgagatggttcacgccgacagcaaacttgtgtcttgtaggcaggggtccggcaatatgaaggagtgcatcacaaccggacgggctctgttgcccgccgtcaacccaggccaggaagcatgtctccattttactgcccccgggagtcctgatagcaagtgcctgaagattaaagtgaagcgcataaatttaaaatgtaagaaatcttcctcatacttcgtaccagacgctagaagtaggtgcacaagcgtgcgtcggtgtcgatgggcgggagattgccagtcgggctgcccgccccactttacctccaactctttcagcgacgactgggcaggtaagatggatagagccgggctgggattttcaggctgtagtgacggttgcggcggggctgcctgtggatgcttcaatgcagccccttcctgtatcttttggaggaagtgggttgagaacccacacggcattatctggaaagtctctccctgcgctgcctgggtgcctagcgcagtgattgaactaacgatgccatccggggaggtccgcaccttccatcccatgtcaggaatcccgacacaagttttcaagggcgtgagcgtgacttatctcggtagtgatatggaagtatctgggctgaccgacctttgtgagatagaggaattgaaatccaagaaactggcgctcgctccttgcaaccaggccggaatgggcgtcgtgggtaaggttggcgagatccagtgtagctcggaagagtcagcacggacaattaaaaaggatgggtgcatctggaatgccgacctggtgggaattgaacttagagtcgatgacgctgtgtgttactctaagatcacttctgttgaggccgtggcaaactattccgctataccaaccacaattggcgggctgaggtttgagcgcagccacgattctcagggaaaaatcagcggctcccccttggacattaccgccatccgaggttcattcagtgtaaatctccgggggctgcgtttaagcctgtctgaaataactgcgacgtgcacaggagaggtcaccaacgtgtccggctgctactcatgtatgactggtgccaaggtgagtatcaaactacatagctccaagaatagtaccgctcacgtcagatgcaaaggcgatgaaacagcattttcggttctcgagggggtgcacagctacattgtatcactgtccttcgaccatgccgtggtcgatgaacaatgtcagcttaactgcggaggccacgagagtcaggtgaccttgaaggggaatctgatctttctcgacgttcctaagttcgtggacggatcttatatgcagacttaccatagcacagtccccacgggcgctaacattccatcccctaccgattggctgaatgccttatttggtaacgggctgtcaaggtggatccttggagtgataggcgttttgctcggcgggctggcactattctttctgattatgttcctcctgaaacttggaactaagcaagtgtttcgctctcggacaaaattggcgtga

SEQ ID NO: 11635 - RNA, 3222 nt, synthetic construct
  misc_feature 1..3222: note = derived and/or modified CDS sequence (opt3) from SFTSV/Phlebovirus(AH15/China/2010 strain AH15)__HQ141593.1__GP
  source 1..3222: mol_type = other RNA
atgatgaaggtgatctggttctttagcctgatttgcctcgtcatacagtgtggcggggacaccggacccatcatttgcgccggtcctatccactccaacaaatctgctgatattccacatcttctgggctactcagagaagatctgtcaaatagacagattgatccacgttagtagctggttaaggaatcattcccagttccaggggtatgtgggacagcggggcggtcgctctcaagtatcgtactatccggcagaaaactcatacagccgatggagtgggctgctatccccctgcgatgccgactggctcggaatgctggtggtcaaaaaggcgaaaggctctgatatgattgtgcctggcccaagctataaggggaaggttttcttcgagcgtcccacatttgacggatacgtgggttggggctgtgggtccggaaaatcaagaactgaaagtggcgagctttgcagctctgattccggtacgtcaagcgggctgttgcctagtgacagggtcctctggatcggagatgtggcttgtcagccaatgacccccattcctgaagagacattcctggagctgaagtctttttcccagagcgaatttccagacatctgcaaaatagatggcattgtatttaatcagtgtgagggcgaatcgctcccgcaacccttcgacgttgcctggatgggggtgggacactctcataagatcattatgcgggagcacaaaactaagtgggtccaggagtcctcaagtaaggattttgtgtgctataaagaaggtaccggcccttgtagcgagtccgaagagaagacatgcaaaacctctgggagctgccgcggagacatgcagttctgtaaggtggcaggctgcgaacacggtgaggaggcctcagaagctaaatgtagatgcagtttagtccataagccaggggaggttgtggtatcctacggcggaatgagggtgcggcccaaatgttacggctttagccgcatgatggcaactctggaagtcaacgagcctgaacagcgaatcgggcaatgcacaggatgtcaccttgagtgcatcaatggtggcgtgagattgattaccctgacgtctgagctaaagtcagccactgtttgtgctagtcatttctgcagctccgccacctctgggaagaaatcgacagaaatacagttccacagcggatccctcgtgggcaagactgcgatccacgtcaaaggtgcactggtggacgggaccgagtttacattcgaaggctcatgtatgtttccagatggatgcgacgccgtagattgcaccttctgtagggagtttcttaagaacccccagtgctatccggctaaaaagtggctgttcattatcatagttattttgctcggctacgccgggctgatgttactgacgaatgtgctcaaggcaatcggagtctggggtagttgggtgatcgctcctgtcaaacttgtgtttgccattatcaagaaactgatgcgggcggtttcttgtttgatgggcaagctaatggaccgtgggcgccaagtgattcatgaagagataggagagaacagagaaggcaatcaggatgacgtaaggatcgagatggcccggccccgacgcgtcagacactggatgtatagcccagtgattctgactatcctcgcaatgggtctggctgaagggtgcgatgagatggttcatgccgactccaaacttgtgtcatgtaggcagggcagcggaaacatgaaggagtgcgtcacaaccggccgggctctgttgcctgccgtgaatcccgggcaggaagcatgtctccacttcactgccccaggatctcccgattccaagtgcctgaaaatcaaggtaaaacgcattaacttaaagtgtaaaaagagtagctcttactttgtgcctgacgctagatccaggtgcacatcagttcgtcggtgtcgatgggcgggcgattgccaaagtggttgcccaccgcatttcaccagcaattcgttttccgacgactgggcagggaagatggatagagccggactgggcttctctggttgtagcgacggctgcgggggagctgcctgtggctgctttaacgcagccccctcatgtatattctggaggaaatgggtcgagaatcctcacgggatcatttggaaggtgagtccatgcgctgcctgggtgccctccgcagtcatcgaactaacgatgccttctggagaggttcgcaccttccacccaatgagcggcattcccacacaggtgtttaaaggtgtgtccgtaacttatctcgggtcagatatggaagtcagcggactgaccgacctttgtgagatcgaggaattgaagagtaaaaagctggcgctcgctccgtgcaaccaggccggcatgggtgtggttggcaaagtgggggagatacagtgttcttccgaagagagcgcacggacaatcaagaaggatggatgcatttggaacgccgacctggtcggcatcgaacttagagtggatgacgctgtttgttactcgaaaattacttcagtggaggccgtagcaaattattctgctatccctaccacaatagggggactgaggttcgagcgcagtcatgattcccaaggcaagattagcggttctccattggacatcaccgccattcgagggagcttttccatcaactaccggggactccgtctgtcattaactgaaataacggcgacatgcaccggcgaggtcactaatgtgagtggttgctacagctgtatgaccggcgccaaagtgtctatcaagctgcactcctcaaagaacagtacagctcatgtcagatgcaagggggatgaaaccgcattcagcgttctagagggagtgcactcctattctgtatcgctcagctttgaccacgccgtggtcgatgaacagtgtcagctgaattgcggcgggcatgagtcacaggtgactcttaggggaaacttgattttcctggacgttcccaagtttgtggacggctcctacatgcaaacatatcacagtacggtccctaccggtgctaatatcccctctccaactgattggctcaacgccctgttcgggaatggattaagccgctggattctgggcgtgatcggcgttcttctcgggggattggcactgtttttcctaataatgtccctgtttaaactcggtacaaaacaggtgttccggtcaagaaccaaactggcgtga

SEQ ID NO: 11636 - RNA, 3222 nt, synthetic construct
  misc_feature 1..3222: note = derived and/or modified CDS sequence (opt3) from SFTSV/Phlebovirus(HN6/China/2010 strain HN6)__HQ141596.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaaccagcctgagcaacgaatcggacagtgcactggctgtcacctggaatgcatcaatgggggagtgagacttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggatggcactgaatttaccttcgagggtagctgtatgtttccagacgggtgcgatgccgtagactgcacattctgtagggaatttctgaagaacccccaatgctatccggctaaaaagtggcttttcattatcatagttattctgttgggctacgccggactcatgctgttaaccaatgtgctgaaggcaatcggcatctgggggtcctgggtcattgctcctgtgaaactcatctttgccattataaagaaacttatgcggacggtctcatgtctggtgggaaagttgatggatcgtggtcgccaggttatccatgaggaaattggcgagaacagagaggggaatcaggacgatgtgaggatcgaaatggcgcggccccgacgcgtaagacactggatgtatagcccagtcatcctaactattctggccataggactcgcagagtcttgcgacgaaatggtgcatgctgattccaaactggttagttgtaggcagggcagcggtaacatgaaggagtgcgtgacaaccgggcgggcccttctgcctgctgtcaatcccggccaagaggcctgtttgcacttcactgcaccaggatctcccgactccaagtgcctcaaaatcaaggtgaaacgcattaacctgaagtgtaaaaagtcaagtagctactttgtacctgatgccagatcgaggtgcacatccgtgcgtcggtgtcgatgggctggcgactgccagtctgggtgcccaccgcatttcaccagcaattcatttagtgacgattgggcgggaaagatggacagagcaggcttaggtttctccgggtgttctgatggatgcggcggtgccgcttgtggctgctttaacgccgcacccagctgtatcttctggaggaaatgggttgaaaatcctcacgggattatctggaaggtctccccatgcgccgcttgggtgccctcagccgtgatagagctgacgatgcctagcggagaaatgcgcaccttccacccaatgagtggcatccccacacaggtctttaaaggggtttctgtgacttatctaggatccgacatggaggtgagcggcctcaccgatctgtgtgaaattgaggagcttaagtcgaaaaagttggcactggcgccgtgcaaccaggctggtatgggggtagtcggaaaagtgggcgaaatccaatgttcatctgaggaaagtgcccggacaattaagaaggacggttgcatctggaacgcagatctcgttggcatagagctgagagtggacgatgccgtctgttactccaaaattactagcgtggaagctgttgccaattattctgcaatccctaccacaattgggggacttaggttcgagcgcagccatgactcccagggcaagatctcagggagtccactggatataaccgctatccgaggcagcttttctgtgaactaccggggattgcgtctctccctgtcagagattactgccacgtgcacaggtgaagtaaccaatgtcagtgggtgctacagctgtatgactggagcgaccgtgtccatcaaattacactcttcgaagaacagcacagcccatgtgagatgcaaaggcgacgagaccgctttctcagtcctggaaggtgttcactcctatactgtgagtctatcttttgatcacgcagtagtggacgagcagtgtcagctcaattgcggcgggcatgaaagccaagtcacactgaagggaaaccttattttcttggacgtgcccaagtttgttgatggctcctacatgcagacgtatcactcaaccgtgcctactggggccaatatcccctctccaacagactggctgaacgctctcttcggaaatggcctgagtaggtggatattaggtgtcattggggtgctgcttggaggcttggccctctttttcatgatcatgagcctgtttaaactaggcaccaagcaggttttccgctcccggacaaaactggcatga

SEQ ID NO: 11637 - RNA, 3222 nt, synthetic construct
  misc_feature 1..3222: note = derived and/or modified CDS sequence (opt3) from SFTSV/Phlebovirus(JN1/China/2010)__JN258706.1__GP
  source 1..3222: mol_type = other RNA
atgatgaaggtgatctggttcagctccctgatttgcctcgtcatacagtgttctggcgactcagggcccatcatttgcgccggacctatccacagtaacaaaagcgctggtattccacatcttctgggctactccgagaagatctgtcaaatagatagattgatccacgtttcttcgtggttaaggaatcattcacagtttcaggggtatgtgggacagcggggcggtcgcagccaagtaagttactatccggcagaaaactcctactctcgatggagcgggctgctatccccctgcgacgccgattggctcggaatgctggtggtcaaaaaggcgaaagagtcagacatgattgtgcctggcccaagttataagggcaaggttttctttgaacgtcccaccttcgatgggtacgtgggatggggttgtggcagcgggaaatctagaacagagtccggagaactttgctcaagcgacagtggcacttcttccggtctgttgcctagcgatagggtcctctggatcggggacgtggcttgtcagccaatgacgcccattcctgaggagacctttctggaactgaagtcgttctctcagtccgagtttccaaatatctgcaaaatagatggaattgtattcaaccagtgtgaaggcgagtcactcccgcaaccctttgacgttgcctggatggatgtgggccacagtcataagatcattatgcgggagcacaaaacaaagtgggtccaggaaagctcctctaaggacttcgtgtgctataaagaggggactggaccttgtagcgaatcagaggaaaaggcatgcaaaaccagtggttcctgccgcggcgatatgcagttttgtaaggtggccgggtgcgagcacggagaggaagctagcgaggcaaaatgtagatgctctttagtccataagccaggcgaagttgtggtatcatacggtgggatgagggtgcggcccaaatgttacggcttcagtcgcatgatggccacactggaggtcaatcctccagaacagcgaatcggacaatgcaccggctgtcaccttgagtgcatcaacgggggagtgagattggttactctgacaagcgagctaaggtccgctaccgtgtgtgcctctcatttttgctcgagcgcgacgtccggtaagaagtcaactgaaattcacttccacagtggctctctcgtcgggaaaaccgcaatacatgtgaagggagccctggtagacggcacagagttcacttttgaaggtagctgtatgttccccgacgggtgcgatgctgttgactgcaccttttgtcgggagttccttaaaaatccgcagtgctatcctgccaagaaatggctgtttatcattatcgtgatattgctcggctacgcaggactgatgttactgacaaacgtcctcaaggctattggcgtgtgggggtcctgggtcatcgcccccgtgaaacttatgttcgcgatcattaagaagctgatgcgtaccgtttcatgtttggtgggaaaactaatggatcgcggtagacaggtaatccacgaagagattggcgagaatggggaaggaaaccaagacgatgtcaggatagagatggcccggccacgacgcgtgagacattggatgtatagccctgttatcctgacgattctcgcaatcggcctggctgaaggttgcgacgagatggtgcacgccgattctaaacttgtctcctgtaggcaggggagtggcaatatgaaggagtgcatcactacaggacgggctctgttgcccgccgtgaacccaggccaggaagcatgtctccattttaccgcccccgggagccctgactctaagtgcctgaagattaaagtaaagcgcataaatttaaaatgtaagaaatcctcaagttacttcgtgccagatgctagatcgaggtgcacttcggttcgtcggtgtcgatgggcgggagactgccagtccggctgcccgccccactttacatctaacagcttctcagatgactgggcaggtaagatggacagagccgggctgggatttagtggctgttccgatggttgcggcggggctgcctgtggatgcttcaatgcagccccttcttgtatcttttggaggaagtgggtcgagaacccacacggcattatctggaaagtgagcccctgcgctgcctgggtgccttccgcagtcattgaactaaccatgccatcaggggaggttcgcacgttccatcccatgagcggaatcccgacccaagtgttcaagggcgtgagtgtaacatatctcggttctgacatggaagtctccgggctgactgatctttgtgagatagaggaattgaaaagcaagaaactggcgctcgctccttgcaaccaggccggaatgggcgtggttggtaaggtgggcgagatccagtgttcgtcagaagagtctgcacggaccattaaaaaggacgggtgcatctggaatgccgatctggtcggaattgaacttagagtggacgatgctgtttgttacagtaagatcacatccgtggaggccgtagcaaactatagcgctataccaactaccattggcgggctgaggtttgagcgctctcacgacagccagggaaaaatctccggctcacccttggatattacagccatccgaggtagtttcagcgtcaattaccgggggctccgtctgtctttatccgaaataaccgcgacttgcacgggagaggtgacaaacgtgtcaggctgctacagttgtatgaccggtgccaaggtcagcatcaaactgcattcctctaagaatagcactgctcacgttagatgcaaaggcgacgaaaccgcatttagcgtgctaaagggggtacactcatatattgtgtccctcagtttcgatcatgccgtcgtggacgagcaatgtcagctgaactgcggaggccacgaatctcaggttacacttaaggggaatttgatctttctggatgtgcctattttcgtcgacggaagctacatgcagacctatcattccactgtgcccacaggcgctaacatcccatcacctacggactggctcaatgccctgtttggtaacgggttatctaggtggatactgggagttattggcgtgcttttgggcgggctcgcactgttctttctaatcatgttcctgctcaaactgggaaccaagcaagtctttcgcagccggactaaacttgcgtga

SEQ ID NO: 11638 - RNA, 3222 nt, synthetic construct
  misc_feature 1..3222: note = derived and/or modified CDS sequence (opt3) from SFTSV/Phlebovirus(JS2010-014)__JQ317170.1__GP
  source 1..3222: mol_type = other RNA
atgatgaaggtgatctggttcagctacctgatttgctttgtcatacagtgttccggcgactctgggcccatcatttgggccggacctatccactcaaacaaaagtgctgatattccacatctccttggttatagcgagaagatctgccaaatagacagactgatccacgtttcctcttggttgaggaatcattcgcagttccagggctacgtggggcagcggggaggccgctcacaagtaagctattacccggcagaaaacagttattcccgatggtctggtttactgagcccctgtgatgccgactggctagggatgctcgtggtcaaaaaggcgaaaggatccgatatgattgtgcctggcccatcatacaagggcaaggttttcttcgagcgtcccacctttgacgggtatgtgggatggggttgcggcagtgggaaaagcagaacagaatctggagagctgtgttcctcagatagcggcactagctctggtcttctgccttccgacagggtcttgtggatcggggatgtggcttgccagccaatgacgcccattcctgaagagaccttcctcgagctgaagagtttttcgcagtctgaatttccagacatctgtaaaatagatggaattgtatttaatcagtgcgagggcgaatccctgccgcaacccttcgacgttgcctggatggatgtgggccactcacataagatcattatgcgggagcacaaaacaaagtgggtccaggagagtagctccaaggactttgtgtgttacaaagaagggactggaccttgctctgagagcgaagagaagacctgtaaaacatcaggtagttgccgcggcgacatgcagttctgcaaggtggcagggtgtgaacacggagaggaggcctccgaagctaaatgcagatgtagcctcgtccataagccaggcgaggttgtggtatcttacggtgggatgaggatccggcccaaatgctatggcttttcacgcatgatggcaaccttagaagtgagtcagcctgagcaacgactgggacagtgtactggctgccaccttgaatgtatcaacgggggagtcagattgattacactgaccagcgagctaaagtccgccacggtgtgcgcttctcatttctgttcgagcgccacttccggtaagaaatcaaccgagatacagttccacagtggctctctcgttgggaagacagcgatccacgtgaaaggagcactggtcgatggcactgaatttaccttcgagggtagctgcatgtttccagacgggtgtgatgccgtggactgcacattctgcagggaatttcttaagaatccccaatgttacccggctaaaaagtggctgttcattatcatagtaattttgctcggctatgccggactgatgttactgaccaacgttctcaaggcaatcggcatctgggggtcctgggtgattgctcctgtcaaacttatgtttgccatcattaagaaactgatgcggacggtgtcatgcttgatgcgtaagctaatggatcgcggaagacaggtcatacatgaggaaatcggtgagaatagggtgggcaaccaggacgatgttcggattgagatggcgcgaccccgcagagtgaggcactggatgtacagcccagtaatcctgactatcctcgccattgggctggcagaatcttgtgacgagatggtccatgctgattccaaacttgtgagttgccggcagggaagcggcaatatgaaggaatgtgttacaaccggtcgcgccctgttgcctgctgtgaaccccgggcaagaggcctgcctccacttcactgcaccaggctctcccgactccaagtgtctgaaaataaaggtcaaaagaatcaatttaaagtgcaaaaagtcaagtagctattttgtgcctgatgccaggtcgcgttgtacatccgtacggcgatgcagatgggctggagactgtcagtctggctgcccaccgcatttcaccagcaactcatttagtgacgattgggcggggaagatggacagggcaggactgggcttctccggttgctctgatgggtgtggaggcgccgcttgcggttgttttaatgccgcacccagctgcattttctggcgcaaatgggtggagaaccctcacggcatcatttggaaggtttccccatgtgccgcttgggtcccctcagccgtgatcgaactaacgatgcctagcggggaggtgcggaccttccacccaatgagtggaatacccacacaggtctttaaaggcgtttctgtgacttacctcgggtccgacatggaagtgagcggactgaccgatctttgcgagatcgaagagttgaagtcgaaaaagctggcactcgcgccgtgtaatcaggctggcatgggtgtagtcgggaaagtgggagagattcaatgctcatctgaagagagtgccagaacaatcaagaaggacggctgtatttggaacgcagatctggttggtatcgaacttagggtggacgatgccgtctgctattccaaaataactagcgtggaggctgttgccaactactctgcaattcctaccacaatcggcgggctgcgcttcgaacgaagccatgactcccagggaaagatttcaggcagtccattggatatcaccgctatacgggggagcttttctgtgaattaccgtggactcagactgtccttatcagagatcactgccacgtgtacaggcgaggtaaccaacgtcagtggttgctatagctgcatgactggggcgaaagtgtccattaagctgcactcttcgaaaaatagcaccgcccatgtgaggtgtaagggagacgaaacagctttctcagtcctagagggcgttcactcctacaccgtgagtctctcttttgatcacgcagtagtggacgaacagtgccagctgaactgtggtggccatgagagccaagtcactcttaaggggaatttgatcttcctggacgtgcccaaatttgttgatggatcctatatgcagacataccactcaacggtgcctaccggcgccaacattccctctccaactgactggctcaatgctctgttcgggaacggattaagccgctggatcctgggcgtcataggtgtgcttctcgggggattggccctgtttttcatgattatgagtctatttaagctgggcacaaaacaggttttccggtccagaaccaagctcgcatga

SEQ ID NO: 11639 - RNA, 3222 nt, synthetic construct
  misc_feature 1..3222: note = derived and/or modified CDS sequence (opt3) from SFTSV/Phlebovirus(JS2010-015)__JQ317173.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaaccagcctgagcaacgaatcggacagtgcactggctgtcacctggaatgcatcaatgggggagtgagacttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggatggcactgaatttaccttcgagggtagctgtatgtttccagacgggtgcaacgccgtagattgcacattctgtagggaatttctgaagaatccccaatgctatccggctaaaaagtggcttttcattatcatagttattctgttgggctacgccggactcatgctgttaaccaacgtgctgaaggcaatcggcatctgggggtcctgggtcattgctcctgtgaaactcatgtttgccatcattaagaaacttatgcggacggtctcatgtctgatgggaaagttgatggaccgtggtcgccaggtgatacatgaggaaatcggcgagaatagagaggggaaccaggatgacgttaggattgaaatggcgcggccccgacgcgtgagacactggatgtatagcccagtaatcctaactttcctggccatcggactcgcagagtcttgcgatgaaatggtccatgctgactccaaactggtgagttgtaggcagggcagcggtaatatgaaggagtgcgttacaaccgggcgggcccttctgcctgctgtgaaccccggccaagaggcctgtttgcactttactgcaccaggatctcccgattccaagtgcctcaaaattaaggtcaaacgcataaatctgaagtgtaaaaagtcaagtagctacttcgtgcctgacgccagatcgaggtgcacatccgtacgtcggtgtcgatgggctggcgattgccagtctgggtgcccaccgcattttaccagcaactcattcagtgacgactgggcgggaaagatggatagagcaggcttaggtttttccgggtgttctgacggatgcggcggtgccgcttgtggctgcttcaatgccgcacccagctgtatcttctggaggaaatgggtggaaaaccctcacgggattatctggaaggtttccccatgcgccgcttgggtcccctcagccgtgattgagctgacgatgcctagcggagaagtgcgcacctttcacccaatgagtggcatccccacacaggtcttcaaaggggtttctgtgacttatctaggatccgatatggaggtgagcggcctcaccgacctgtgtgaaatagaggagcttaagtcgaaaaagttggcactggcgccgtgcaaccaggctggtatgggggtagtcggaaaagtgggcgaaatccaatgttcatctgaggaaagtgcccggacaattaagaaggatggttgcatctggaatgcagacctcgttggcattgagctgagagtggatgacgccgtctgttactccaaaatcactagcgtggaagctgttgccaactattctgcaatacctaccacaattgggggacttaggtttgagcgcagccatgattcccagggcaagatctcagggagtccactggacattaccgctatccgaggcagcttctctgtgaattaccggggattgcgtctctccctgtcagagataactgccacgtgcacaggtgaagtaaccaacgtcagtgggtgctacagctgtatgactggagcgaaagtgtccatcaagttacactcttcgaaaaatagcaccgcccatgtgagatgcaagggcgatgagacagctttttcagtcctggaaggtgttcactcctataccgtgagtctatctttcgaccacgcagtagtggatgagcagtgtcagctcaactgcggcgggcatgaaagccaagtcactctgaagggaaatcttatctttttggacgtgcccaaattcgttgacggctcctacatgcagacatatcactcaacggtgcctaccggggccaacattccctctccaactgattggctgaatgctctctttggaaacggcctgagtaggtggattttaggtgtcatcggggtgctgcttggaggcttggccctcttctttatgataatgagcctgttcaagctaggcacaaaacaggtttttcgctcccggaccaagctggcatga

SEQ ID NO: 11640 - RNA, 3222 nt, synthetic construct
  misc_feature 1..3222: note = derived and/or modified CDS sequence (opt3) from SFTSV/Phlebovirus(JS2010-019)__JQ317179.1__GP
  source 1..3222: mol_type = other RNA
atgatgaaggtgatctggttcagctccctgacctgctttgtcattcagtgttctggcgactcagggcccataatctgcgccggacctattcacagtaacaaaagcgctgatatcccacatctccttggttactccgagaagatttgtcaaatcgacagactgatacacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgatcgtgcctggcccaagttataagggcaaggttttcttcgagcgtcccacatttgacgggtacgtgggatggggttgtggcagcgggaaatctagaactgaatccggagagctgtgctcaagcgatagtggcacgtcttccggtcttctgcctagcgacagggtcttgtggattggggatgtggcttgtcagccaatgacccccatccctgaagagacattcctcgagctgaagtcgttttctcagtccgaatttccagacatttgcaaaatcgatggaatagtatttaatcagtgtgagggcgaatcactgccgcaacccttcgacgttgcctggatggatgtgggccacagtcataagattatcatgcgggagcacaaaactaagtgggtccaggagagctcctctaaggactttgtgtgctataaagaagggaccggaccttgtagcgagtcagaagagaagacatgcaaaaccagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaactttagaagtcaaccagcctgagcaacgactgggacagtgcacaggctgtcaccttgaatgcattaatgggggagtgagattgatcaccctgacgagcgagctaaagtccgccactgtttgtgcttctcatttctgctcgagcgccacctccggtaagaaatcaacagagatccagttccacagtggctctctcgtggggaagactgcgattcacgtcaaaggagcactggtggatggcaccgaatttacattcgagggtagctgtatgtttccagacgggtgcgatgccgtagactgcaccttctgtagggaatttcttaagaacccccaatgctatccggctaaaaagtggctgttcataatcattgttatcttgctcggctacgccggactgatgttactgacgaatgtgctcaaggcaataggcatttgggggtcctgggtcatcgctcctgtgaaacttatgtttgccatcattaagaaactgatgcggactgtctcatgtttgatgcgtaagctaatggatcgcggaagacaggtgatccatgaggaaattggtgagaacagggagggcaatcaggacgatgttcggatagaaatggcgcgaccccgcagagtgaggcactggatgtatagcccagtaatcctgacaattctcgccatcgggctggcagagtcttgcgacgaaatggtccatgctgattccaaacttgtgagttgtcggcagggaagcggcaacatgaaggagtgcgttaccactggtcgcgccctgttgtctgctgtgaatcctgggcaagaggcctgtctccacttcacagcacccggctccccagactcaaagtgcctgaaaatcaaggtcaaaagaattaacttaaagtgtaaaaagagtagctcgtactttgtgcccgatgccaggtcccgttgcacctctgtacggcgatgtagatgggctggagactgccagagcggctgccctccacatttcacgtcaaatagtttttccgacgattgggcggggaagatggacagggcaggactgggcttctctggttgtagcgatgggtgcggaggcgccgcttgtggttgctttaacgccgcaccgtcctgtatattctggcgcaaatgggtggaaaatccccacggcatcatttggaaggtttcaccttgcgccgcttgggtcccaagcgccgtgatcgagctaaccatgcccagtggggaagtgcggacattccaccctatgtctggcattccaactcaggtctttaaaggagtttccgtgacctatctcgggagcgacatggaggtgtcgggactgacagatctttgtgaaatcgaggagttgaagtctaaaaagctggcactcgcgccctgcaaccaggctggcatgggtgtagtcgggaaagtgggagaaatacaatgttcaagtgaggaatccgccagaactatcaagaaggacggctgcatttggaacgcagatctggttggtatcgagcttagggtggacgatgccgtctgttacagcaaaattacctctgtggaagctgttgccaattatagcgcaatcccgacaaccataggcgggctgcgcttcgagcgatcccatgactcacagggaaagattagtggcagccctttggatatcactgctattcgggggtctttttccgtgaactaccgtggactcagactgtcattaagtgagatcacggccacatgcaccggcgaagtaactaatgtcagcggttgctactcctgtatgaccggggcgaaagtgtctataaagctgcactcgagcaaaaactcaacagcccatgtgaggtgcaagggagacgagaccgctttctccgtcctagaaggcggtcacagttatactgtttctctcagctttgatcacgcagtggtagacgagcagtgtcagctgaattgcggcgggcatgaatcccaagtgacacttaagggaaacttgatcttcctggacgtcccaaaatttgtggatggctcatacatgcagacgtatcactctaccgttcccactggggccaatattcctagccccacagactggctcaacgctctgttcggaaatggcttaagtcgctggatcctgggtgtgattggggtccttttgggaggcctcgccctgtttttcatgatcatgtccctatttaagctgggcaccaaacaggtgttccggagcagaacaaagctcgcatga

SEQ ID NO: 11641 - RNA, 3222 nt, synthetic construct
  misc_feature 1..3222: note = derived and/or modified CDS sequence (opt3) from SFTSV/Phlebovirus(JS24)__HQ830164.1__GP
  source 1..3222: mol_type = other RNA
atgatgaaggtgatctggttcagctccctgatttgcctcgtcatacagtgtggcggggacaccggacccatcatttgcgccggtcctatccactctaacaaatcagctgatattccacatcttctgggctacagtgagaagatctgtcaaatagacagattgatccacgttagctcctggttaaggaatcattctcagtttcaggggtatgtgggacagcggggcggtcgctcgcaagtatcatactatccggcagaaaacagctacagtcgatggtccgggctgctatctccctgcgatgccgactggctcggaatgctggtggtcaaaaaggcgaaaggcagcgatatgattgtgcctggcccatcctataaggggaaggttttctttgagcgtcccacattcgacggatacgtgggttggggctgtgggtcaggaaaaagtagaactgaaagcggcgagctttgttcttccgattcaggtacgagcagtgggctgttgccttctgacagggtcctctggatcggagatgtggcttgccagccaatgacccccattcctgaagagacatttctggagctgaagtccttcagccagtcggaatttccagacatctgcaaaatagatggcattgtattcaatcagtgtggcggggagtctctcccgcaaccctttgacgttgcctggatggatgtgggacactcccataagatcattatgcgggaacacaaaactaagtgggtccaggagtcaagtagcaaggacttcgtgtgctataaagagggtaccggcccttgttccgaatctgaggaaaagacatgcaaaaccagcgggtcatgccgcggagacatgcagttttgtaaggtggcaggctgcgagcacggtgaagaggccagtgaggctaaatgtagatgctccttagtccataagccaggggaagttgtggtaagctacggcggaatgagggtgcggcccaaatgttacggcttctctcgcatgatggcaactctggaggtcaaccagcctgaacaacgaatcgggcagtgcacaggatgtcaccttgagtgcatcaatggtggcgtgagattgattaccctgacgtcagaactaaagagtgccactgtttgtgctagccatttttgctcctctgccacctcggggaagaaaagcacagagatacagttccactccggatcactcgtgggcaagactgcgatccacgtcaaaggtgcactggtggatgggaccgagttcacatttgaaggcagttgtatgttcccagacggatgcgatgccgtagactgcaccttttgtagggagttccttaagaacccccaatgctatccggctaaaaagtggctgtttattatcatagttattttgctcggctacgccgggctgatgttactgacgaatgtgctcaaggcaatcggagtctggggttcttgggtgatcgctcctgtcaaacttgtgttcgccattatcaagaaactgatgcgggcggttagctgtttgatgggcaagctaatggatcgtgggcgccaggtgattcatgaagagataggagaaaacagagagggcaatcaggacgatgtaaggatcgagatggcccggccccgacgcgtcagacactggatgtattccccagtgattctgactatcctcgcaatcggtctggctgaagggtgcgacgagatggttcatgccgattcaaaacttgtgagctgtaggcagggctctggaaacatgaaggaatgcgtcacaaccggccgggctctgttgcctgccgtgaatcccgggcaagaggcatgtctccactttactgccccaggatcccccgacagtaagtgcctgaaaattaaggtgaaaaagataaacttaaaatgtaagaagtcgtcttcctacttcgtacctgatgctcgctcaagatgcacaagtgttaggcgttgtcggtgggcgggcgactgccagagcggttgcccaccgcattttaccagcaattccttctctgacgattgggcagggaaaatggaccgagccggactgggctttagcggttgttcagatggctgcgggggagctgcctgtggctgcttcaacgcagcccccagttgtatcttttggagaaagtgggtcgagaatcctcacgggattatctggaaagtgtccccatgcgctgcctgggtgccctctgcagtcattgaactaacgatgcctagcggagaggttaggaccttccacccaatgtccggcatccccacacaggtgttcaagggtgtgtcagtaacttatctcgggagcgacatggaagtcagtggactgaccgatctttgtgagatagaagagttgaaatctaagaaactggcgctcgctccgtgcaaccaggccggcatgggtgtggttggcaaggtgggggagatccaatgttccagcgaagagtcggcacgcacaattaagaaagacggatgcatctggaacgccgatctggtcggcattgaacttcgggtggacgatgctgtttgttactcaaagatcacttctgtggaggccgtagcaaattatagtgctatacctaccacaattgggggactgagatttgaaaggtcccatgacagccagggcaaaatctctggtagcccattggatattaccgccatccgcgggtccttctcagtcaactaccgaggactccggctgagtttaagcgagataactgcgacgtgcacaggcgaggtgaccaatgtgtctggttgctactcctgtatgactggcgccaaggtctcaatcaaactgcacagtagcaagaactccaccgctcatgttcgttgcaagggggacgaaacagcattttctgtgctagagggagtacactcgtatagcgtgtcactctccttcgatcacgccgtcgtggacgaacagtgtcagctgaattgcggcgggcatgagagtcacgttacccttaaaggaaacttgatttttctggacgtgcccaagttcgtcgatggctcttacatgcaaacttatcatagcacagtgcctacgggtgctaatatcccctccccaaccgactggctcaacgccctgtttgggaatggattatcaagatggattctgggcgttatcggcgtgcttctcgggggattggcactgttctttctaataatgtctctgttcaaactcggtactaagcaggtctttaggagccgcacaaaactggcgtga

SEQ ID NO: 11642 - RNA, 3222 nt, synthetic construct
  misc_feature 1..3222: note = derived and/or modified CDS sequence (opt3) from SFTSV/Phlebovirus(JS4/China/2010 strain JS4)__HQ141605.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaaccctccagagcagcgaatcggacaatgcactggctgtcacctggaatgcatcaatgggggagtgagacttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggatggcactgaatttaccttcgagggtagctgtatgtttcccgacgggtgcgatgccgtagactgcacattctgtagggaatttctgaagaacccgcagtgctatcctgctaaaaagtggcttttcattatcatagttattctgttgggctacgccggactcatgctgttaaccaatgtgctgaaggcaatcggcgtctgggggtcctgggtgatcgctcccgtcaaactcctttttgccattatcaagaaactgatgcggacggtgtcatgtttgatgggaaagctaatggatcgtggtcgccaagttattcatgaggaaataggcgagaacagagaggggaatcaggacgatgtgaggatcgaaatggcgcggccacgacgcgtaagacactggatgtatagccctgtcattctgactatcctcgccatcggactggcagagggctgcgacgaaatggtgcatgctgattctaaacttgtttcctgtaggcagggtagtgagaacatgaaggagtgcgtgacaaccgggcgggccctgttgcccgctgtcaatccaggccaggaagcctgtctccacttcactgcacccggaagccctgactctaagtgcctgaaaattaaggtgaaacgcataaacttaaagtgtaaaaagtcctcaagttactttgtaccagatgccagatcgaggtgcacaagcgtgcgtcggtgtcgatgggctggcgactgccaatccgggtgcccgccccatttcacctctaatagcttttcagacgattgggcgggaaagatggacagagcaggcctgggtttcagtgggtgttccgatggatgcggcggtgccgcttgtggctgctttaacgccgcaccttcttgtatcttctggaggaaatgggttgagaatccacacgggattatctggaaggtcagcccctgcgccgcttgggtgccttccgccgtgattgaactaacgatgccatcaggagaggtccgcaccttccaccccatgagcggcatcccgacacaggtttttaaaggggtgagtgtgacttatctcggatctgacatggaagtatccggcctgaccgatctttgtgagatagaggaattgaaaagcaagaagctggcactcgcgccttgcaaccaggctggtatgggggtcgtgggaaaagttggcgagatccagtgttcgtcagaagagtctgcccggacaattaagaaggacggttgcatctggaacgcagatctggtgggcattgaacttagagtcgacgatgccgtgtgttacagtaaaatcacttccgttgaggctgtggccaattatagcgcaataccaaccacaattgggggactgaggttcgagcgctctcatgacagccaaggcaagatctccgggtcacccttggatattaccgctatccgaggaagttttagcgtaaactaccggggcctccgtctgtctttatccgaaataactgccacgtgcacaggtgaggtcaccaatgtgtcagggtgctacagttgtatgactggagcgaaagtgagcatcaagctgcactcctctaaaaactcgaccgcccatgtcagatgcaagggcgacgaaacagctttcagcgttctagagggtgtgcactcatataccgtatccctcagttttgatcacgcagtggtcgacgaacagtgtcagctgaattgcggcgggcatgagtctcaggtgactcttaagggaaacttgattttcctggacgttcctaaatttgtggatggcagctacatgcaaacatatcactccacggtccccaccggggccaatatcccatcacctactgactggctcaacgctctgttcggaaatggcttatctaggtggattctgggtgtgatcggggttcttttgggaggcctcgccctgtttttcctaataatgagcctgtttaagctcggcacaaaacaggtgttccgcagtcggaccaagctggcatga

SEQ ID NO: 11643 - RNA, 3222 nt, synthetic construct
  misc_feature 1..3222: note = derived and/or modified CDS sequence (opt3) from SFTSV/Phlebovirus(JS6)__HQ830170.1__GP
  source 1..3222: mol_type = other RNA
atgatgaaggtgatctggttcagctccctgatttgcctcgtcatacagtgtggcggggacaccggacccatcatttgcgccggtcctatccactctaacaaatcagctgatattccacatcttctgggctacagtgagaagatctgtcaaatagacagattgatccacgttagctcctggttaaggaatcattctcagtttcaggggtatgtgggacagcggggcggtcgctcgcaagtatcatactatccggcagaaaacagctacagtcgatggtccgggctgctatctccctgcgatgccgactggctcggaatgctggtggtcaaaaaggcgaaaggcagcgatatgattgtgcctggcccatcctataaggggaaggttttctttgagcgtcccacattcgacggatacgtgggttggggctgtgggtcaggaaaaagtagaactgaaagcggcgagctttgttcttccgattcaggtacgagcagtgggctgttgccttctgacagggtcctctggatcggagatgtggcttgccagccaatgacccccattcctgaagagacatttctggagctgaagtccttcagccagtcggaatttccagacatctgcaaaatagatggcattgtattcaatcagtgtgagggcgaatctctcccgcaaccctttgacgttgcctggatggatgtggggcactcccataagatcattatgcgggagcacaaaactaagtgggtccaggagtcaagtagcaaggacttcgtgtgctataaagaaggaaccggtccttgttccgagtctgaagagaagacatgcaaaaccagcggctcatgccgcggggacatgcagttttgtaaggtggcaggatgcgaacacggcgaggaggccagtgaagctaaatgtagatgctccttagtccataagccaggtgaggttgtggtaagctacgggggcatgagggtgcggcccaaatgttacggattctctcgcatgatggcaactctggaagtcaacgagcctgaacagcgaatcggccaatgcacagggtgtcagcttgagtgcatcaatggaggtgtgagattgattaccctgacgtcagagctaaagagtgccactgtttgtgctagccacttttgctcctctgccacctcgggcaagaaaagcacagaaatacagttccattccgggtcactcgtgggaaagactgcgatccacgtcaaaggcgcactggtggatggtaccgagttcacatttgaagggagttgtatgttcccagacggctgcgatgccgtagactgcaccttttgtagggagttccttaagaacccccaatgctatccggctaaaaagtggctgtttattatcatagttattttgctcggatacgccggcctgatgttactgacgaatgtgctcaaggcaatcggggtctggggatcttgggtgatcgctcctgtcaaacttgtgttcgccattatcaagaaactgatgcgggcggttagctgtttgatgggtaagctaatggatcgtggccgccaggtgattcacgaagagataggggagaacagagaaggaaatcaggacgatgtaaggatcgagatggcccggccccgacgcgtcagacattggatgtattccccagtgattctgactatcctcgcaatgggcctggctgaaggttgcgacgagatggttcacgccgattcaaaacttgtgagctgtaggcaggggtctggcaacatgaaggagtgcgtcacaaccggacgggctctgttgcctgccgtgaatcccggccaagaagcatgtctccattttactgccccagggtcccccgacagtaagtgcctgaaaatcaaggtaaaacgcattaacttaaagtgtaaaaagtcgtcttcctacttcgtgcctgatgctagatcaaggtgcacaagtgttcgtcggtgtcgatgggcgggagactgccagagcggctgcccaccgcactttaccagcaattccttctctgacgattgggcaggtaagatggacagagccgggctgggatttagcggctgttcagatggttgcggcggggctgcctgtggatgcttcaacgcagcccccagttgtatattttggaggaaatgggtcgagaatcctcatggcatcatttggaaggtgtccccatgcgctgcctgggtgccctctgcagtcatcgaactaacgatgcctagcggggaggttcgcaccttccacccaatgtccggcattcccacacaggtgttcaaaggagtgtcagtaacttatctcggtagcgacatggaagtcagtgggctgaccgatctttgtgagatcgaggaattgaagtctaaaaagctggcgctcgctccgtgcaaccaggccggaatgggcgtggttggtaaagtgggcgagatacaatgttccagcgaagagtcggcacggacaatcaagaaggacgggtgcatttggaacgccgatctggtcggaatcgaacttagagtggacgatgctgtttgttactcaaaaattacttctgtggaggccgtagcaaattatagtgctatccctaccacaataggcgggctgaggtttgagcgctcccacgacagccagggaaagatttctggcagcccattggatatcaccgccattcgaggttccttctcaatcaactaccgggggctccgtctgagtttaagcgaaataactgcgacgtgcacaggagaggtcaccaatgtgtctggctgctactcctgtatgactggtgccaaagtgtcaatcaagctgcatagtagcaaaaactccaccgctcacgtcagatgcaagggcgacgaaacagcattttctgttctagagggggtgcattcgtatagcgtatcactctccttcgatcacgccgtggtcgacgaacagtgtcagctgaattgcggaggccacgagagtcaagtgacccttagggggaacttgatttttctggacgttcccaagttcgtggatggatcttacatgcagacttatcatagcacagtccctacgggcgctaatatcccctccccaaccgactggctcaacgccctgtttggtaatgggttatcacgctggattctgggagtgatcggcgttcttttgggcgggctcgcactgttctttctaataatgtctctgttcaaactcggaactaaacaggtgtttcggagcagaacaaagctggcgtga

SEQ ID NO: 11644 - RNA, 3222 nt, synthetic construct
  misc_feature 1..3222: note = derived and/or modified CDS sequence (opt3) from SFTSV/Phlebovirus(JSD1)__JF267784.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcccactctcgatggagcggtttactgtccccctgcgatgccgactggctagggatgctcgtggtcaaaaaggcgaaaggatcagatatgattgtgcctggcccaagttacaagggcaaggttttcttcgagcgtcccacctttgacgggtatgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccatagtcacaagatcattatgcgggagcacaaaacaaagtgggtccaggagagctcctctaaggactttgtgtgctacaaagaagggactggaccttgtagcgagtcagaagagaagacctgcaaaacaagtggttcctgccgcggcgacatgcagttctgtaaggtggcagggtgcgaacatggagaggaggccagcgaagctaaatgtagatgctctctcgtccacaagccaggcgaggttgtggtatcatatggtgggatgagggtgcggcccaaatgttacggctttagtcgcatgatggcaaccttagaagtcaaccagcctgagcaacgaatcggacagtgcactggctgtcatctggaatgcatcaatgggggagtgagacttattacattgaccagcgagctgaagtccgccacggtttgtgcttctcacttctgctcgagcgccacttccggtaagaaatcaaccgagatacagttccacagtggctctctagtggggaagacagcgatccatgtcaaaggagcactcgtggatggcactgaatttaccttcgagggtagctgtatgtttccagacgggtgcaacgccgtagattgcacattctgtagggaatttctgaagaatccccaatgctacccggctaaaaagtggcttttcattatcatagttattctgttgggctatgccggactcatgctgttaaccaacgtgctgaaggcaatcggcatctgggggtcctgggtcattgctcctgtgaaactcatgtttgccatcattaagaaacttatgcggacggtctcatgtctgatgggaaagttgatggaccgtggtcgccaggtgatacacgaggaaatcggcgagaatagagaggggaaccaggatgacgttaggattgaaatggcgcggccccgacgcgtgagacattggatgtacagcccagtaatcctaactttcctggccatcggactcgcagagtcttgcgatgaaatggtccacgctgactccaaactggtgagttgtaggcagggcagcggtaatatgaaggagtgcgttacaaccgggcgggcccttctgcctgctgtgaaccccggccaagaggcctgtttgcattttactgcaccaggatctcccgattccaagtgcctcaaaattaaggtcaaacgcataaatctgaagtgtaaaaagtcaagtagctatttcgtgcctgacgccagatcgaggtgcacatccgtacgtcggtgtcgatgggctggcgattgccagtctgggtgcccaccgcactttaccagcaactcattcagtgacgactgggcgggaaagatggatagagcaggcttaggtttttccgggtgttctgacggatgcggcggtgccgcttgtggctgcttcaatgccgcacccagctgtatcttctggaggaaatgggtggaaaaccctcacgggattatctggaaggtttccccatgcgccgcttgggtcccctcagccgtgattgagctgacgatgcctagcggagaagtgcgcacctttcatccaatgagtggcatccccacacaggtcttcaaaggggtttctgtgacttacctaggatccgatatggaggtgagcggcctcaccgacctgtgtgaaatagaggagcttaagtcgaaaaagttggcactggcgccgtgcaaccaggctggtatgggggtagtcggaaaagtgggcgaaatccaatgttcatctgaggaaagtgcccggacaattaagaaggatggttgcatctggaatgcagacctcgttggcattgagctgagagtggatgacgccgtctgttattccaaaatcactagcgtggaagctgttgccaactactctgcaatacctaccacaattgggggacttaggtttgagcgcagccacgattcccagggcaagatctcagggagtccactggacattaccgctatccgaggcagcttctctgtgaattatcggggattgcgtctctccctgtcagagataactgccacgtgcacaggtgaagtaaccaacgtcagtgggtgctacagctgtatgactggagcgaaagtgtccatcaagttacattcttcgaaaaatagcaccgcccacgtgagatgcaagggcgatgagacagctttttcagtcctggaaggtgttcactcctacaccgtgagtctatctttcgaccatgcagtagtggatgagcagtgtcagctcaactgcggcgggcacgaaagccaagtcactctgaagggaaatcttatctttttggacgtgcccaaattcgttgacggctcctatatgcagacataccattcaacggtgcctaccggggccaacattccctctccaactgattggctgaatgctctctttggaaacggcctgagtaggtggattttaggtgtcatcggggtgctgcttggaggcttggccctcttctttatgataatgagcctgttcaagctaggcacaaaacaggtttttcgctcccggaccaagctggcatga

SEQ ID NO: 11645 - RNA, 3222 nt, synthetic construct
  misc_feature 1..3222: note = derived and/or modified CDS sequence (opt3) from SFTSV/Phlebovirus(LN2/China/2010 strain LN2)__HQ141608.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgccggatagatggaattgtatttaatcagtgtgagggcgaatcactgccgcaacccttcgacgttgcctggatggatgtgggccacagtcataaaatcattatgcgcgagcacaagacaaaatgggtccaggagagctcctctaaggactttgtgtgctataaggaagggactggaccttgtagcgagtcagaagagaaaacctgcaagacaagtggttcctgcagaggcgacatgcagttctgtaaagtggcagggtgcgaacacggagaggaggccagcgaagctaagtgtaggtgctctctcgtccataaaccaggcgaggttgtggtatcatacggtgggatgcgggtgcgccccaagtgttacggctttagtcgaatgatggcaaccttagaagtcaaccagcctgtgcaaagaatcggacagtgcactggctgtcacctggagtgcatcaatgggggagttaggcttattacattgaccagcgaactgaaatccgccacggtgtgtgcttctcatttctgctcgagcgccacttccggtaagaagtcaaccgagatacagttccacagtggctctctagtcgggaaaacagcgatccacgtgaagggagcactcgtagatggcactgagtttaccttcgaaggtagctgtatgtttccagacgggtgcgatgccgttgactgcacattctgtcgggagtttctgaaaaacccccaatgctatccggctaagaaatggcttttcattatcatagtgattctgttgggctacgccggactcatgctgttaaccaatgtcctgaaggcaatcggcatctgggggtcctgggtgattgctcctgtcaagctcatctttgccattataaagaaacttatgcgtacggtgtcatgtctgatgggaaaattgatggatcgcggtagacaggttatccatgaagagattggcgaaaacagggaggggaatcaggacgatgtgcggatcgagatggcgcgaccccgcagagtaaggcactggatgtatgccccagtcatcctaactattctggcaatgggactcgctgaaagctgcgacgagatggtgcatgccgattctaagctggtttcctgtcggcagggcagtggtaacatgaaagaatgcgtgacaaccgggcgcgcccttctgcctgctgtcaatcccggccaagaggcatgtttgcacttcactgccccaggaagccccgactctaagtgcctcaagataaaagtgaagagaatcaacctgaaatgtaagaaatcctcaagttactttgtacctgatgctaggagccgttgcacatcggtgcggcgatgtagatgggcgggcgactgccagtccgggtgcccaccgcatttcacctctaatagcttttcagacgattgggcaggaaagatggacagggccggcttaggtttcagtgggtgttccgatggatgcggcggtgctgcctgtggctgctttaacgcagccccctcttgtattttctggcgcaagtgggttgagaatcctcacgggatcatttggaaagtcagcccatgcgctgcctgggtgccctccgcagtgatcgaactgacgatgccttcaggagaggtccggaccttccacccaatgagcggcatacccacacaggtttttaagggggtgagtgtgacttatctaggatctgacatggaagtatccggcctcaccgatctgtgtgagatcgaggaacttaaaagcaagaaattggcgctggctccgtgcaaccaggccggtatgggggtcgtgggaaaggttggcgagattcaatgttcgtcagaagagtctgcaagaacaatcaaaaaggacggttgcatttggaacgccgatctcgtgggcatcgaactgagggtcgacgatgctgtgtgttacagtaagataacttccgttgaggccgtggcaaattatagcgctattcctaccacaatcgggggacttcgcttcgaacgatctcatgacagccagggcaaaatttccgggtcaccactggatatcaccgccatacggggaagttttagcgtaaactaccgtggcttgagactctctctgtccgagatcactgcgacgtgcacaggtgaggtcaccaatgtgtcagggtgctacagttgtatgactggagccaaggtgagcattaaattacactcctctaagaactcgaccgctcatgtcaggtgcaaaggcgacgaaacagcattcagcgttctggagggtgtgcactcatataccgtatccctaagttttgatcacgccgtggtcgacgaacagtgtcagctcaattgcggcgggcatgagtctcaagtgactctgaagggaaaccttatcttcttggacgttcccaagtttgtggatggcagctacatgcagacatatcactccacggtccctaccggggctaatattccctcaccaactgactggctgaacgccctcttcggaaatggcctgtctcgctggatcttaggtgtgataggggttctgcttggaggcttggcactctttttcatgattatgagcctgtttaaactaggcacaaaacaggtgttccggagtagaaccaagctggcgtga

SEQ ID NO: 11646 - RNA, 3222 nt, synthetic construct
  misc_feature 1..3222: note = derived and/or modified CDS sequence (opt3) from SFTSV/Phlebovirus(LN3/China/2010 strain LN3)__HQ141611.1__GP
  source 1..3222: mol_type = other RNA
atgatgaaggtgatctggttcagctccctgatttgcctcgtcatacagtgtggcggggacaccggacccatcatttgcgccggtcctatccactctaacaaatcagctgatattccacatcttctgggctacagtgagaagatctgtcaaatagacagattgatccacgttagctcctggttaaggaatcattctcagtttcaggggtatgtgggacagcggggcggtcgctcgcaagtatcatactatccggcagaaaacagctacagtcgatggtccgggctgctatctccctgcgatgccgactggctcggaatgctggtggtcaaaaaggcgaaaggcagcgatatgattgtgcctggcccatcctataaggggaaggttttctttgagcgtcccacattcgacggatacgtgggttggggctgtgggtcaggaaaaagtagaactgaaagcggcgagctttgttcttccgattcaggtacgagcagtgggctgttgccttctgacagggtcctctggatcggagatgtggcttgccagccaatgacccccattcctgaagagacatttctggagctgaagtccttcagccagtcggaatttccagacatctgcaaaatagatggcattgtattcaatcagtgtgagggcgaatctctcccgcaaccctttgacgttgcctggatggatgtggggcactcccataagatcattatgcgggagcacaaaactaagtgggtccaggagtcaagtagcaaggacttcgtgtgctataaagaaggaaccggtccttgttccgagtctgaagagaagacatgcaaaaccagcggctcatgccgcggggacatgcagttttgtaaggtggcaggatgcgaacacggcgaggaggccagtgaagctaaatgtagatgctccttagtccataagccaggtgaggttgtggtaagctacgggggcatgagggtgcggcccaaatgttacggattctctcgcatgatggcaactctggaagtcaaccagcctgagcaacgaatcggccagtgcacagggtgtcaccttgaatgcatcaatggaggtgtgagattgattaccctgacgtcagagctaaagagtgccactgtttgtgctagccatttttgctcctctgccacctcgggcaagaaaagcacagagatacagttccactccgggtcactcgtgggaaagactgcgatccacgtcaaaggcgcactggtggatggtaccgagttcacatttgaagggagttgtatgttcccagacggctgcgatgccgtagactgcaccttttgtagggagttccttaagaacccccaatgctatccggctaaaaagtggctgtttattatcatagttattttgctcggatacgccggcctgatgttactgacgaatgtgctcaaggcaatcggggtctggggatcttgggtgatcgctcctgtcaaacttgtgttcgccattatcaagaaactgatgcgggcggttagctgtttgatgggtaagctaatggatcgtggccgccaggtgattcatgaagaaataggggagaacagagagggaaatcaggacgatgtaaggatcgaaatggcccggccccgacgcgtcagacactggatgtattccccagtgattctgactatcctcgcaatcggcctggctgagggttgcgacgaaatggttcatgccgattcaaggcttgtgagctgtcggcaggggtctggcaacatgaaagagtgcgtcacaaccggacgcgctctgttgcctgccgtgaatcccggccaagaggcatgtctccactttactgccccagggtcccccgacagtaagtgcctgaagattaaagtaaagagaataaacttaaaatgtaagaaatcgtcttcctacttcgtgcctgatgctaggtcacgttgcacaagtgttcggcgatgtagatgggcgggagactgccagagcggctgcccaccgcattttaccagcaattccttctctgacgattgggcaggtaagatggacagggccgggctgggatttagcggctgttcagatggttgcggcggggctgcctgtggatgcttcaacgcagcccccagttgtatcttttggcgcaagtgggtcgaaaatcctcacggcattatctggaaagtgtccccatgcgctgcctgggtgccctctgcagtcattgagctaacgatgcctagcggggaagttcggaccttccacccaatgtccggaatccccacacaggtgttcaagggcgtgtcagtaacttatctcggtagcgacatggaggtcagtgggctgaccgatctttgtgaaatagaggagttgaaatctaagaaactggcgctcgctccgtgcaaccaggccggaatgggcgtggttggtaaggtgggcgaaatccaatgttccagcgaggaatcggcaagaacaattaaaaaggacgggtgcatctggaacgccgatctggtcggaattgagcttagggtggacgatgctgtttgttactcaaagatcacttctgtggaagccgtagcaaattatagtgctatacctaccacaattggcgggctgcgctttgagcgatcccatgacagccagggaaaaatctctggcagcccattggatattaccgccatccggggttccttctcagtcaactaccgtgggctcagactgagtttaagcgagataactgcgacgtgcacaggagaagtgaccaatgtgtctggctgctactcctgtatgactggtgccaaggtctcaatcaaactgcacagtagcaagaactccaccgctcatgttaggtgcaaaggcgacgagacagcattttctgtgctagaaggggtacactcgtatagcgtgtcactctccttcgatcacgccgtcgtggacgagcagtgtcagctgaattgcggaggccatgaaagtcacgttacccttcgcgggaacttgatttttctggacgtgcccaagttcgtcgatggatcttacatgcaaacttatcatagcacagtgcctacgggcgctaatatcccctccccaaccgactggctcaacgccctgtttggtaatgggttatcacggtggattctgggagttatcggcgtgcttttgggcgggctcgcactgttctttctaataatgtctctgttcaagctcggaactaaacaggtctttagaagcaggacaaagctggcgtga

SEQ ID NO: 11647 - RNA, 3222 nt, synthetic construct
  misc_feature 1..3222: note = derived and/or modified CDS sequence (opt3) from SFTSV/Phlebovirus(SD24/China/2010 strain SD24)__HM802201.1__GP
  source 1..3222: mol_type = other RNA
atgatgaaggtgatctggttcagctccctgatttgcctcgtcatacagtgttctggcgactcagggcccatcatttgcgccggacctatccacagtaacaaaagcgctggtattccacatcttctgggctactccgagaagatctgtcaaatagatagattgatccacgtttcttcgtggttaaggaatcattcacagtttcaggggtatgtgggacagcggggcggtcgcagccaagtaagttactatccggcagaaaactcctactctcgatggagcgggctgctatccccctgcgacgccgattggctcggaatgctggtggtcaaaaaggcgaaagagtcagacatgattgtgcctggcccaagttataagggcaaggttttctttgaacgtcccaccttcgatgggtacgtgggatggggttgtggcagcgggaaatctagaacagagtccggagaactttgctcaagcgacagtggcacttcttccggtctgttgcctagcgatagggtcctctggatcggggacgtggcttgtcagccaatgacgcccattcctgaggagacctttctggaactgaagtcgttctctcagtccgagtttccagatatctgcaaaatagacggaattgtattcaatcagtgtgaaggcgagtcactcccgcaaccctttgatatcgcctggatggacgttggccacagtcataagattatcatgcgggagcacaaaacaaagtgggtgcaggaaagctcctctaaggatttcgtctgctataaagaggggactggaccttgtagcgaatcagaggaaaaggcatgcaaaaccagtggttcctgccgcggcgacatgcagttttgtaaggtggccgggtgcgagcacggagaggaagctagcgaggcaaaatgtagatgctctttagtgcataagccaggcgaagtcgttgtgtcatacggtgggatgagggtacggcccaaatgttacggcttcagtcgcatgatggccacactggaggtgaaccctccagaacagcgaatcggacaatgcaccggctgtcaccttgagtgcattaatgggggagtcagattgataactctgacaagcgagctaaggtccgctaccgtgtgtgcctctcatttttgctcgagcgcgacgtccggtaagaagtcaactgaaatccacttccacagtggctctctcgttgggaaaaccgcaattcatgtgaagggagccctggtcgacggcacagagttcacttttgaaggtagctgtatgttccccgatgggtgcgacgctgtggattgcaccttttgtcgggagttccttaaaaacccgcagtgctatcctgccaagaaatggctgtttatcataattgtaatcttgctcggctacgcaggactgatgttactgacaaatgttctcaaggctatcggcgtgtgggggtcctgggtcattgcccccgtgaaacttatgttcgcgatcattaagaagctgatgcgtaccgtctcatgtttggtgggaaaactaatggaccgcggtagacaggttatacacgaagagatcggcgagaacggggaaggaaatcaagatgacgtgaggattgagatggcccggccacgacgcgtaagacattggatgtatagccctgtcatcctgacgatcctcgcaattggcctggctgaaggttgcgatgagatggtgcacgccgactctaaacttgtttcctgtaggcaggggagtggcaacatgaaggagtgcataactacaggacgggctctgttgcccgccgtgaatccaggccaggaagcatgtctccattttaccgcccccgggagccctgattctaagtgcctgaagatcaaagtcaagcgcattaacttaaaatgtaagaaatcctcaagttacttcgtgccagacgctagatcgaggtgcactagcgtacgtcggtgtcgatgggcgggagattgccagtccggctgcccgccccactttacatctaatagcttctcagacgactgggcaggtaagatggatagagccgggctgggatttagtggctgttccgacggttgcggcggggctgcctgtggatgcttcaacgcagccccttcttgtatcttttggaggaagtgggtggagaatccacacggcattatctggaaagttagcccctgcgctgcctgggtcccttccgcagtgatagaactaaccatgccatcaggggaggtgcgcacgttccatcccatgagcggaatcccgacccaagtcttcaagggcgttagtgtgacatatctcggttctgatatggaagtgtccgggctgactgacctttgtgagattgaggaattgaaaagcaagaaactggcgctcgctccttgcaaccaggccggaatgggcgtagtcggtaaggtgggcgagatccagtgttcgtcagaagagtctgcacggaccattaaaaaggatgggtgcatctggaacgccgacctggttggaatagaacttagagtggatgacgctgtctgttacagtaagattacatccgtggaggccgttgcaaattatagcgctatcccaactaccattggcgggctgaggtttgagcgctctcacgatagccagggaaaaatctccggctcacccttggacataacagccatccgaggtagtttcagcgtgaactaccgggggctccgtctgtctttatccgaaattaccgcgacttgcacgggagaggtaacaaatgtctcaggctgctacagttgtatgaccggtgccaaggtgagcatcaaactgcattcctctaagaactcgactgctcacgtgagatgcaaaggcgatgaaaccgcatttagcgtcctagagggggttcactcatatattgtgtccctcagtttcgaccatgccgtagtggatgaacaatgtcagctgaattgcggaggccacgagtctcaggtcacacttaaggggaacttgatctttctggacgtgcctaagttcgttgacggaagctacatgcagacctatcattccactgtgcccacaggcgctaatataccatcacctacggattggctcaacgccctgtttggtaatgggttatctaggtggattctgggagtcatcggcgtgcttttgggcgggctcgcactgttctttctaatcatgttcctgctcaaactgggaaccaagcaagtttttcgcagccggactaaacttgcgtga

SEQ ID NO: 11648 - RNA, 3222 nt, synthetic construct
  misc_feature 1..3222: note = derived and/or modified CDS sequence (opt3) from SFTSV/Phlebovirus(SD4/China/2010 strain SD4)__HM802203.1__GP
  source 1..3222: mol_type = other RNA
atgatgaaggtgatctggttcagctccctgatttgctttgtcatacagtgttctggcgactcagggcccatcatttgcgccggacctatccacagtaacaaaagcgctgatattccacatctccttggttactccgagaagatctgtcaaatagacagactgatccacgtttcttcgtggttgaggaatcattcacagttccagggctatgtggggcagcggggaggccgcagccaagtaagttactatccggcagaaaactcctactctcgatggagcggtttactgtccccctgcgatgccgactggctagggatgctcgtggtcaaaaaggcgaaaggatcagatatgattgtgcctggcccaagttataagggcaaggttttcttcgagcgtcccacctttgacgggtacgtgggatggggttgtggcagcgggaaatctagaacagaatccggagagctgtgctcaagcgatagtggcacttcttccggtcttctgcctagcgacagggtcttgtggatcggggatgtggcttgtcagccaatgacgcccattcctgaagagaccttcctcgagctgaagtcgttttctcagtccgaatttccagacatctgcaaaatagatggaattgtatttaatcagtgtgagggcgaatcactgccgcaacccttcgacgttgcctggatggatgtgggccacagtcataagatcattatgcgggagcacaaaacaaagtgggtccaggagagctcctctaaggactttgtgtgctataaagaagggactggaccttgtagcgagtcagaagagaagacctgcaaaacaagtggttcctgccgcggcgacatgcagttctgtaaggtggcagggtgcgaacacggagaggaggccagcgaagctaaatgtagatgctctctcgtccataagccaggcgaggttgtggtatcatacggtgggatgagggtgcggcccaaatgttacggctttagtcgcatgatggcaaccttagaagtcaaccctccagagcagcgaatcggacaatgcactggctgtcacctggaatgcatcaatgggggagtgagacttattacattgaccagcgagctgaagtccgccacggtttgtgcttctcatttctgctcgagcgccacttccggtaagaaatcaaccgagatacagttccacagtggctctctagtggggaagacagcgatccacgtcaaaggagcactcgtggatggcactgaatttaccttcgagggtagctgtatgtttcccgacgggtgcgatgccgtagactgcacattctgtagggaatttctgaagaacccgcagtgctatcctgctaaaaagtggcttttcattatcatagttattctgttgggctacgccggactcatgctgttaaccaatgtgctgaaggcaatcggcgtctgggggtcctgggtgatcgctcccgtcaaactcctttttgccattatcaagaaactgatgcggacggtgtcatgtttgatgggaaagctaatggatcgtggtcgccaagttattcatgaggaaataggcgagaacagagaggggaatcaggacgatgtgaggatcgaaatggcgcggccacgacgcgtaagacactggatgtatagccctgtcattctgactatcctcgccacaggactggcagagggctgcgacgaaatggtgcatgctgattctaaacttgtttcctgtaggcagggtagtgggaacatgaaggagtgcgtgaccactggccgggccctgttgcccgctgtcaatccaggacaggaggcctgtctccacttcacagcacccggcagccctgactctaagtgcctgaaaatcaaggtgaaacgcattaacttaaagtgtaaaaagtcctcaagttactttgtaccagatgccagatcgaggtgcaccagcgtgcgtcggtgtcgatgggctggggactgccaatccggatgcccgccccatttcacgtctaatagcttttcagacgattgggcgggcaagatggacagagcaggtctggggttcagtggatgttccgatggctgcggtggcgccgcttgtgggtgctttaacgccgcaccttcttgtatattctggaggaaatgggttgaaaatccacacggaatcatttggaaggtcagcccctgcgccacctgggtgccttccgctgtgatcgagctaacaatgccatcaggcgaagtccgcactttccaccccatgagcgggattccgacccaggtttttaaaggagtgagtgtgacatatctcggctctgacatggaggtatccggtctgactgatctttgtgaaatcgaggagttgaaaagcaagaagctggccctcgcaccttgcaaccaggcggggatgggagtcataggcaaagtgggtgaaatccagtgttcgtcagaggaatctgctcggaccattaagaaggacggctgcatctggaacgccgatctggttgggattgagcttagagtggacgatgcagtctgttacagtaaaatcacatccgtggaagccgttgctaattatagcgccataccaaccactattggaggcctgaggttcgagcgctctcatgacagccaagggaagatctccggatcacccttggatattacggcaatccgaggcagttttagcgtgaactaccggggtctccgtctgtctttatccgagataacagctacctgcactggggaagtaaccaatgtctcaggatgctacagttgtatgacaggcgccaaagtgagcatcaagctgcactcctctaaaaactcgaccgcgcatgtgagatgcaagggtgacgagactgccttcagcgtcctagaaggcgttcactcatatacagtgtccctcagttttgatcacgctgtagtggacgagcagtgtcagctgaattgcgggggacatgaatctcaggtcacgcttaagggcaacttgattttcctggacgtgcctaaatttgttgatgggagctacatgcaaacctatcactccactgtgcccacaggagcaaatatcccatcacctaccgactggctcaacgccctgttcggcaatggtttatctaggtggattctgggggtcatcggagtgcttttgggcggcctcgctctgtttttcctaataatgagcctgtttaagctcgggacaaaacaggttttccgcagtcggactaagctggcctga

SEQ ID NO: 11649 - RNA, 3222 nt, synthetic construct
  misc_feature 1..3222: note = derived and/or modified CDS sequence (opt3) from SFTSV/Phlebovirus(SDYY104/China/2011)__KU239112.1__GP
  source 1..3222: mol_type = other RNA
atgatgaaggtgatctggttcagctccctgatttgcctcgtcatacagtgttctggcgactcagggcccatcatttgcgccggacctatccacagtaacaaaagcgctggtattccacatcttctgggctactccgagaagatctgtcaaatagatagattgatccacgtttcttcgtggttaaggaatcattcacagtttcaggggtatgtgggacagcggggcggtcgcagccaagtaagttactatccggcagaaaactcctactctcgatggagcgggctgctatccccctgcgacgccgattggctcggaatgctggtggtcaaaaaggcgaaagagtcagacatgattgtgcctggcccaagttataagggcaaggttttctttgaacgtcccaccttcgatgggtacgtgggatggggttgtggcagcgggaaatctagaacagagtccggagaactttgctcaagcgacagtggcacttcttccggtctgttgcctagcgatagggtcctctggatcggggacgtggcttgtcagccaatgacgcccattcctgaggagacctttctggaacttaattcgttctctcagtccgagtttccagatatctgcaagatagacggaattgtattcaaccagtgtgaaggcgagtcactcccgcaaccctttgatgttgcctggatggacgtgggccacagtcataaaatcattatgcgggagcacaagacaaaatgggtccaggaaagctcctctaaggatttcgtgtgctataaggaggggactggaccttgtagcgaatcagaggaaaaagcatgcaagaccagtggttcctgccgcggcgacatgcagttttgtaaagtggccgggtgcgagcacggagaggaagctagcgaggcaaagtgtagatgctctttagtccataaaccaggcgaagttgtggtatcatacggtgggatgagggtgcggcccaagtgttacggcttcagtcgcatgatggccacactggaggtcaatcctccagaacagcgaatcggacaatgcaccggctgtcaccttgagtgcatcaacgggggagtgagattgattactctgacaagcgagctaaggtccgctaccgtttgtgcctctcatttttgctcgagcgcgacgtccggtaaaaagtcaactgaaatacacttccacagtggctctctcgtggggaagaccgcaatccatgtcaaaggagccctggtggacggcacagagttcacttttgaaggtagctgtatgttccccgatgggtgcgacgctgtagattgcaccttttgtcgggagttccttaagaatccgcagtgctatcctgccaaaaagtggctgtttattatcatagttattttgctcggctacgcaggactgatgttactgacaaacgtgctcaaagctatcggcgtctgggggtcctgggtgatcgcccccgtcaagctgatgttcgcgattatcaagaaactgatgcgtaccgtgtcatgtttggttggaaagctaatggaccgcggtagacaggtgattcacgaagagataggcgagaatggggaaggaaaccaagatgacgtaaggatcgagatggcccggccacgacgcgtcagacattggatgtatagccctgtgattctgacgatcctcgcaatcggcctggctgaaggttgcgatgagatggttcacgccgactctaaacttgtgtcctgtaggcaggggagtggcaatatgaaggagtgcattactacaggacgggctctgttgcccgccgtcaacccaggccaggaagcatgtctccattttaccgcccccgggagccctgattctaaatgcctgaagataaaggtgaaacgcatcaatttaaagtgtaaaaagtcctcaagttacttcgtaccagacgctagatcgaggtgcactagcgtgcgtcggtgtcgatgggcgggagattgccagtccggctgcccgccccactttacatctaacagcttctcagacgactgggcaggtaaaatggatagagccgggctgggatttagtggctgttccgacggttgcggcggggctgcctgtggatgcttcaatgcagccccttcttgtatcttttggaggaagtgggttgagaacccacacggcattatttggaaggtcagcccctgcgctgcctgggtgccttccgcagtgatcgaactaaccatgccatcaggggaggtccgcacgttccatcccatgagcggaataccgacccaagttttcaaaggcgtgagtgtgacatatctcggttctgatatggaagtatccgggctgactgacctttgtgagatcgaggaacttaagagcaaaaagctggcgctcgctccttgcaaccaggccggaatgggcgtcgtgggtaaagttggcgagattcagtgttcgtcagaagagtctgcacggaccatcaagaaagatgggtgcatttggaatgccgacctggtgggaatcgaacttagagtcgatgacgctgtgtgttacagtaagataacatccgttgaggccgtggcaaactatagcgctattccaactaccatcggcgggctgaggtttgagcgctctcacgatagccagggaaagatttccggctcacccttggacatcacagccatacgaggtagtttcagcgtaaattaccgggggctccgtctgtctttatccgaaatcaccgcgacttgcacgggagaggtcacaaacgtgtcaggctgctacagttgtatgaccggtgccaaagtgagcattaagctgcattcctctaaaaattcgactgctcacgtcagatgcaagggcgatgaaaccgcatttagcgttctagagggggtgcactcatatatcgtatccctcagtttcgaccatgccgtggtcgatgaacaatgtcagctgaactgcggaggccacgagtctcaggtgacacttaaagggaatttgatttttctggacgttcctaagttcgtggacggaagctacatgcagacctatcattccactgtccccacaggcgctaacatcccatcacctacggattggctcaatgccctgtttggtaacgggttatctaggtggatactgggagtgattggcgttcttttgggcgggctcgcactgttctttctaatcgtgttcctgctcaagctgggaaccaaacaagcgtttcgcagccggactaagttggcctga

SEQ ID NO: 11650 - RNA, 3417 nt, synthetic construct
  misc_feature 1..3417: note = derived and/or modified CDS sequence (opt1) from ANDV(Chile-9717869)__AF291703.2__GP
  source 1..3417: mol_type = other RNA
atggagggctggtacctggtggtcctcggggtgtgctacaccctgaccctggccatgcccaagacgatctacgagctcaagatggagtgcccgcacaccgtgggcctggggcagggctacatcatcgggagcaccgagctgggcctcatctccatcgaggccgccagcgacatcaagctggagtccagctgcaacttcgacctgcacaccacgtccatggcccagaagtccttcacccaggtcgagtggcgcaagaagtccgacaccaccgacacgaccaacgccgccagcaccaccttcgaggcccagacgaagaccgtgaacctccgggggacctgcatcctggcgcccgagctgtacgacaccctcaagaaggtgaagaagacggtcctgtgctacgacctgacctgcaaccagacccactgccagcccaccgtgtacctcatcgcccccgtgctgacgtgcatgagcatccgcagctgcatggcctccgtcttcaccagccggatccaggtgatctacgagaagacccactgcgtgaccgggcagctgatcgagggccagtgcttcaacccggcccacacgctcaccctgtcccagcccgcgcacacctacgacaccgtcacgctgcccatcagctgcttcttcacccccaagaagtccgagcagctcaaggtgatcaagaccttcgaggggatcctgaccaagacgggctgcaccgagaacgccctgcaggggtactacgtgtgcttcctcggcagccactccgagccgctgatcgtccccagcctggaggacatccgctccgccgaggtggtgagccggatgctcgtccacccccgcggcgaggaccacgacgccatccagaacagccagtcccacctccggatcgtggggcccatcaccgccaaggtgccgagcacctccagcacggacaccctgaagggcaccgcgttcgccggggtccccatgtactccagcctgtccaccctggtgcgcaacgccgaccccgagttcgtgttcagccccggcatcgtcccggagtccaaccacagcacgtgcgacaagaagaccgtgcccatcacctggaccggctacctgcccatctccggggagatggagaaggtcaccggctgcacggtgttctgcaccctcgccgggcccggcgccagctgcgaggcgtactccgagaacgggatcttcaacatcagctccccgacctgcctggtgaacaaggtccagcggttccgcggcagcgagcagaagatcaacttcatctgccagcgggtggaccaggacgtggtcgtgtactgcaacggccagaagaaggtgatcctgaccaagacgctcgtcatcgggcagtgcatctacaccttcacctccctgttcagcctgatgcccgacgtggcccactccctcgccgtggagctgtgcgtccccggcctgcacgggtgggccaccgtgatgctcctgagcacgttctgcttcggctgggtgctgatccccgccgtcaccctcatcatcctgaagtgcctgcgcgtgctcaccttcagctgctcccactacaccaacgagagcaagttcaagttcatcctggagaaggtgaagatcgagtaccagaagacgatggggtccatggtctgcgacgtgtgccaccacgagtgcgagaccgcgaaggagctggagagccaccggcagtcctgcatcaacggccagtgcccgtactgcatgaccatcaccgaggccacggagagcgccctgcaggcccactactccatctgcaagctcaccggccgcttccaggaggccctgaagaagtccctgaagaagcccgaggtgaagaaggggtgctaccggaccctcggcgtcttccgctacaagagccggtgctacgtggggctggtgtggtgcctgctcctgacctgcgagatcgtcatctgggcggccagcgccgagacgcccctgatggagtccggctggagcgacaccgcccacggggtgggcgagatccccatgaagaccgacctcgagctggacttctccctgccgagctccagctcctacagctaccgccggaagctcaccaaccccgcgaacaaggaggagagcatccccttccacttccagatggagaagcaggtcatccacgccgagatccagccgctgggccactggatggacgccacgttcaacatcaagaccgccttccactgctacggggcctgccagaagtactcctacccctggcagaccagcaagtgcttcttcgagaaggactaccagtacgagaccggctgggggtgcaaccccggcgactgccccggcgtggggacgggctgcaccgcgtgcggggtgtacctggacaagctcaagtccgtgggcaaggcctacaagatcatcagcctgaagtacacccgcaaggtctgcatccagctggggaccgagcagacgtgcaagcacatcgacgccaacgactgcctcgtgaccccgtccgtgaaggtctgcatcgtgggcaccgtgagcaagctgcagccctccgacaccctcctgttcctgggccccctggagcagggcggcatcatcctcaagcagtggtgcaccacgagctgcgccttcggggaccccggcgacatcatgtccaccccgagcgggatgcggtgccccgagcacaccggctccttccgcaagatctgcggcttcgccaccacgcccgtctgcgagtaccaggggaacaccatcagcggctacaagcgcatgatggcgaccaaggactccttccagagcttcaacctgaccgagccccacatcacgaccaacaagctggagtggatcgacccggacgggaacacccgggaccacgtgaacctcgtgctgaaccgcgacgtctccttccaggacctgagcgacaacccctgcaaggtggacctccacacccaggccatcgagggcgcctgggggtccggcgtgggcttcacgctgacctgcaccgtcgggctgaccgagtgccccagcttcatgacgtccatcaaggcctgcgacctcgccatgtgctacggcagcaccgtgaccaacctggcgcgggggagcaacaccgtgaaggtcgtgggcaagggcgggcactccggcagctccttcaagtgctgccacgacacggactgcagctccgaggggctgctcgccagcgcgccccacctggagcgcgtgaccggcttcaaccagatcgactccgacaaggtctacgacgacggggccccgccctgcaccttcaagtgctggttcaccaagagcggcgagtggctgctcggcatcctgaacgggaactggatcgtggtggtcgtgctggtcgtgatcctcatcctgtccatcatcatgttcagcgtgctgtgcccccggcgcggccacaagaagacggtctga

SEQ ID NO: 11651 - RNA, 3417 nt, synthetic construct
  misc_feature 1..3417: note = derived and/or modified CDS sequence (opt1) from ANDV(AH-1)__AF324901.2__GP
  source 1..3417: mol_type = other RNA
atggagggctggtacctggtggccctcggggtctgctacaccctgaccctggccatgcccaagacgatctacgagctcaagatggagtgcccgcacaccgtgggcctggggcagggctacatcatcgggagcaccgagctgggcctcatctccatcgaggcggccagcgacatcaagctggagtccagctgcaacttcgacctgcacaccacgtccatggcccagaagtccttcacccaggtggagtggcgcaagaagtccgacaccaccgacacgaccaacgccgccagcaccaccttcgaggcgcagacgaagaccgtcaacctccgggggacctgcatcctggcccccgagctgtacgacaccctcaagaaggtgaagaagacggtgctgtgctacgacctgacctgcaaccagacccactgccagcccaccgtctacctcatcgcccccgtgctgacgtgcatgagcatccgcagctgcatggcctccgtgttcaccagccggatccaggtcatctacgagaagacccactgcgtgaccgggcagctgatcgagggccagtgcttcaacccggcgcacacgctcaccctgtcccagcccgcccacacctacgacaccgtgacgctgcccatcagctgcttcttcacccccaagaagtccgagcagctcaaggtcatcaagaccttcgaggggatcctgaccaagacgggctgcaccgagaacgccctgcaggggtactacgtgtgcttcctcggcagccactccgagccgctgatcgtgcccagcctggaggacatccgctccgccgaggtcgtgagccggatgctcgtgcaccccatcggcgaggaccacgacgccatccagaacagccagtcctacctgcgcatcgtcgggcccatcaccgcgaaggtgccgagcacctccagcacggacaccctgaagggcatcgccttcgccggggtgcccatgtactccagcttctccaccctcgtccggaacgccgaccccgagttcgtgttcagccccggcatcatcccggagtccaaccacagcgtgtgcgacaagaagaccgtccccatcacctggacgggctacctgcccatctccggggagatggagaaggtgaccggctgcaccgtcttctgcaccctggccgggcccggcgcgagctgcgaggcctactccgagaacgggatcttcaacatcagctccccgacgtgcctcgtgaacaaggtgcagcgcttccggggcagcgagcagaagatcaacttcatctgccagcgcgtcgaccaggacgtggtggtctactgcaacggccagaagaaggtgatcctgaccaagaccctggtgatcgggcagtgcatctacaccttcacgtccctcttcagcctgatgcccgacgtcgcccactccctggccgtggagctctgcgtgcccggcctgcacgggtgggccaccgtcatgctgctcagcaccttctgcttcggctgggtgctgatccccgcggtgaccctgatcatcctcaagtgcctgcgggtcctgacgttcagctgctcccactacaccaacgagagcaagttcaagttcatcctcgagaaggtgaaggtggagtaccagaagaccatggggtccatggtctgcgacgtgtgccaccacgagtgcgagaccgccaaggagctggagagccaccgccagtcctgcatcaacggccagtgcccgtactgcatgacgatcaccgaggccaccgagagcgccctgcaggcccactactccatctgcaagctgaccggccggttccaggaggcgctcaagaagtccctgaagaagcccgaggtgaagaaggggtgctaccgcacgctgggcgtcttccggtacaagagccgctgctacgtggggctcgtgtggtgcctgctgctgacctgcgagatcgtcatctgggccgccagcgccgagacgcccctcatggagtccggctggagcgacaccgcgcacggggtgggcgagatccccatgaagacggacctggagctcgacttctccctgccgagctccagctcctacagctaccggcgcaagctgaccaaccccgccaacaaggaggagagcatccccttccacttccagatggagaagcaggtcatccacgccgagatccagccgctcggccactggatggacgccaccttcaacatcaagaccgccttccactgctacggggcgtgccagaagtactcctacccctggcagacgagcaagtgcttcttcgagaaggactaccagtacgagaccggctgggggtgcaaccccggcgactgccccggcgtggggaccggctgcaccgcctgcggggtgtacctggacaagctgaagtccgtgggcaaggcctacaagatcatcagcctcaagtacacgcggaaggtctgcatccagctggggaccgagcagacctgcaagcacatcgacgccaacgactgcctggtgaccccgtccgtgaaggtctgcatcgtgggcacggtgagcaagctccagccctccgacaccctgctgttcctcggccccctggagcagggcggcatcatcctgaagcagtggtgcaccaccagctgcgccttcggggaccccggcgacatcatgtccaccccgagcgggatgcgctgccccgagcacacgggctccttccggaagatctgcggcttcgcgaccacccccgtctgcgagtaccaggggaacaccgtgagcggctacaagcgcatgatggccacgaaggactccttccagagcttcaacctcaccgagccccacatcaccaccaacaagctggagtggatcgacccggacgggaacacgcgcgaccacgtgaacctggtcctcaaccgggacgtgtccttccaggacctgagcgacaacccctgcaaggtggacctgcacacccaggccatcgagggcgcctgggggtccggcgtcggcttcaccctgacctgcacggtggggctcaccgagtgccccagcttcatgacctccatcaaggcctgcgacctggcgatgtgctacggcagcaccgtggccaacctcgcccgcgggagcaacacggtcaaggtggtgggcaagggcgggcactccggcagctccttcaagtgctgccacgacaccgactgcagctccgaggggctgctggccagcgcgccccacctcgagcgggtcaccggcttcaaccagatcgactccgacaaggtgtacgacgacggggccccgccctgcaccttcaagtgctggttcaccaagagcggcgagtggctgctgggcatcctcaacgggaactggatcgtggtcgtggtcctggtggtgatcctgatcctctccatcatcatgttcagcgtcctgtgcccccgccggggccacaagaagaccgtgtga

SEQ ID NO: 11652 - RNA, 3417 nt, synthetic construct
  misc_feature 1..3417: note = derived and/or modified CDS sequence (opt1) from ANDV(CHI-7913)__AY228238.1__GP
  source 1..3417: mol_type = other RNA
atggagggctggtacctggtggccctcgggatctgctacaccctgaccctggccatgcccaagacgacctacgagctcaagatggagtgcccgcacaccgtcggcctggggcagggctacatcatcgggagcaccgagctgggcctcatctccatcgaggccgccagcgacatcaagctggagtccagctgcaacttcgacctgcacacgacctccatggcccagaagtccttcacccaggtggagtggcgcaagaagtccgacaccacggacaccaccaacgccgccagcaccacgttcgaggcccagaccaagaccgtgaacctccgggggacctgcatcctggcccccgagctgtacgacacgctcaagaaggtcaagaagaccgtgctgtgctacgacctgacctgcaaccagacccactgccagcccacggtgtacctcatcgcccccgtcctgacctgcatgagcatccgcagctgcatggcccgggtgttcacctcccgcatccaggtgatctacgagaagacccactgcgtcacggggcagctgatcgagggccagtgcttcaacccggcgcacaccctcaccctgagccagcccgcccacacctacgacacggtgaccctgcccatctcctgcttcttcacccccaaggagagcgagcagctcaaggtgatcaagaccttcgaggggatcctgacgaagaccggctgcaccgagaacgccctgcaggggtactacgtctgcttcctcggctcccacagcgagccgctgatcgtgccctccctggaggacatccggagcgccgaggtggtctcccgcatgctcgtgcacccccggggcgaggaccacgacgccatccagaacagccagagccacctccgcatcgtggggcccatcaccgcgaaggtcccgtccacgagctccaccgacaccctgaagggcaccgccttcgccggggtgcccatgtacagctccctgagcaccctggtgaagaacgccgaccccgagttcgtcttctcccccggcatcatcccggagagcaaccactccgtgtgcgacaagaagacggtgcccatcacctggaccggctacctgcccatcagcggggagatggagaaggtcaccggctgcacggtgttctgcaccctcgccgggcccggcgcgtcctgcgaggcctacagcgagaacgggatcttcaacatctccagcccgacctgcctggtcaacaaggtgcagcggttccgcggctccgagcagaagatcaacttcatctgccagcgggtggaccaggacgtcgtggtgtactgcaacggccagaagaaggtcatcctgaccaagacgctcgtgatcgggcagtgcatctacaccttcaccagcctgttctccctgatgcccgacgtggcccacagcctcgccgtcgagctgtgcgtgcccggcctgcacgggtgggccaccgtgatgctcctgtccacgttctgcttcggctgggtcctgatccccgcggtgaccctcatcatcctgaagtgcctgcgcgtgctcaccttcagctgcagccactacaccaacgagtccaagttcaagttcatcctggagaaggtcaaggtggagtaccagaagacgatggggagcatggtgtgcgacgtctgccaccacgagtgcgagaccgccaaggagctggagtcccaccggcagagctgcatcaacggccagtgcccgtactgcatgaccatcaccgaggccacggagtccgccctgcaggcccactacagcatctgcaagctcaccggccgcttccaggaggcgctgaagaagtccctgaagaagcccgaggtgaagaaggggtgctaccggaccctcggcgtgttccgctacaagagccggtgctacgtcgggctggtgtggtgcctgctcctgacctgcgagatcgtgatctgggccgcctccgccgagacgcccctgatggagagcggctggtccgacaccgcgcacggggtcggcgagatccccatgaagaccgacctcgagctggacttcagcctgccgtccagctccagctactcctaccgccggaagctcaccaaccccgccaacaaggaggagagcatcagcttccacttccagatggagaagcaggtcatccacgccgagatccagcccctgggccactggatggacgccacgttcaacaccaagaccgccttccactgctacggggcgtgccagaagtactcctacccgtggcagaccagcaagtgcttcttcgagaaggactaccagtacgagacgggctgggggtgcaaccccggcgactgccccggcgtggggaccggctgcaccgcctgcggggtgtacctggacaagctcaagtccgtgggcaaggcctacaagatcatcagcctgaagtacacccgcaaggtgtgcatccagctggggacggagcagacctgcaagcacatcgacgccaacgactgcctcgtcaccccctccgtgaaggtgtgcatcgtcggcaccgtgagcaagctgcagccgtccgacaccctcctgttcctgggccccctggagcagggcggcgtgatcctcaagcagtggtgcacgaccagctgcgccttcggggaccccggcgacatcatgtccacccccagcgggatgcggtgcccggagcacaccggctccttccgcaagatctgcggcttcgcgacgacccccgtctgcgagtaccaggggaacaccatcagcggctacaagcgcatgatggccaccaaggactccttccagagcttcaacctgacggagccccacatcaccgccaacaagctggagtggatcgaccccgacgggaacacccgggaccacgtgaacctcgtgctgaaccgcgacgtctccttccaggacctgagcgacaacccgtgcaaggtggacctccacacccaggccatcgagggcgcctgggggtccggcgtgggcttcacgctgacctgcaccgtcgggctgaccgagtgccccagcttcatgacgtccatcaaggcgtgcgacctcgccatgtgctacggcagcaccgtggccaacctggcccgggggagcaacaccgtgaaggtcgtgggcaagggcgggcactccggcagctccttcaagtgctgccacgacaccgactgcagctccgaggggctgctcgcgagcgcgccccacctggagcgcgtgacgggcttcaaccagatcgactccgacaaggtctacgacgacggggcgcccccgtgcaccttcaagtgctggttcaccaagagcggcgagtggctgctcggcatcctgaacgggaactggatcgtggtggtcgtgctggtcgtgatcctcatcctgtccatcatcatgttcagcgtgctgtgcccccggcgcggccacaagaagaccgtctga

SEQ ID NO: 11653 - RNA, 3417 nt, synthetic construct
  misc_feature 1..3417: note = derived and/or modified CDS sequence (opt1) from Hu39694(Hu39694)__AF028023.1__GP
  source 1..3417: mol_type = other RNA
atggagggctggtacctgatcgtgctcggggtctgcagcaccctgaccctggccatgccccgcacgatctacgagctccggatggagtgcccccacaccgtgggcctggggcagggctacatcatcgggtccaccgagctgggcctcatccccatcgagaccgtgagcgacctgaagctggagtccagctgcaacttcgacctccacacgacctccatgacccagaagtcctacacccaggtcgagtggcgcaagaagtccgacacgaccgacaccaccaacgccgcgagcacgaccttcgaggcccagaccaagaccgtgaacctgcggggcacgtgcgtgctggccagcgagctctacgacaccctgaagaagatcaagaagaccgtcctgtgctacgacctgacctgcaaccagacgcactgccagcccaccgtgtacctgatcgcccccgtgagcacgtgcatgtccatccgcagctgcatggcctccgtcttcaccaaccggatccaggtgatctacgagaagacccactgcgtgaccgggcagctggtcgagggccagtgcttcaacccggcgcacaccctcaccctgagccagcccgcccacacgtacgagatggtgaccctgcccgtgacctgcttcttcacccccaagaagtccgaccagctcaagctgatcaagacgttcgaggggatcatcagcaagaccggctgcaccgagaacgccctgcaggggtactacgtctgcttcctcggctcccacagcgagccgctgcacgtgccctccctggaggacatccgcagcgtggaggtcttcagccggatgatcatccacccccgcggcgaggaccacgaccccatccagaactcccaggggttcctccggatcgtgggcccgatcaccgccaaggtgcccagcacgtccagcaccgacaccctgaaggggaccgcgttcgccggcgtccccatgtactccagcctgtccaccctcgtgcgcacgaccgaccccgagtacgtgttcagcccgggcatcatccccgagtccaaccacagcacgtgcgacaagaagaccatccccctgacctggaccgggtacctgcccatcgccggcgagatggagaaggtcaccgggtgcaccgtgttctgcacgctcgccggcccgggggcctcctgcgaggcgtacagcgagcacggcatcttcaacatctccagcccgacctgcctggtccacaaggtgcagaagttccggggctccgagcagaagatcaacttcatctgccagcgcgtggaccaggacgtcgtggtgtactgcaacgggcagaagaaggtcatcctgaccaaggacctcgtgatcggccagtgcatctacaccttcacgagcctgttctccctgatgcccgacgtggcccacagcctcgccgtcgagctgtgcgtgcccgggctgcacggctgggccaccgtgatgctcctgtccaccttctgcttcgggtggatcctgatccccgccatcaccctcgtcgtgctgaagttcctgaagatggcgacgttcagctgcagccactacaccaacgagtccaagttcaagttcatcctcgagaaggtgaaggtcgagtaccagaagaccatgggcagcatggtgtgcgacatctgccaccacgagtgcgagaccgccaaggagctggagtcccacaagcagagctgcatcaacggccagtgcccctactgcatgacgatgaccgaggccaccgagtccgccctgcaggcccactacagcatctgcaagctgaccgggcggttccaggaggcgctcaagaagtccctgaagcgccccgaggtgaagaagggctgctaccggacgctgggggtcttccgctacaagagccggtgctacgtgggcctcgtgtggtgcgtcctgctgacctgcgagctcatcgtgtgggccgcctccgccgagacgcccctgctggagagcgggtggtccgacaccgcccacggcgtgggcgaggtcccgatgaagaccgacctcgagctggacttcagcctgccctccagctccagctactcctaccgccggaagctcaccaaccccgcgaacaaggaggagagcatcccgttccacttccagatggagaagcaggtcatccacgccgagatccagaccctggggcactggatggacgccaccttcaacatcaagacggccttccactgctacggcgcgtgccagaagtacagctacccctggcagaccgccaagtgcttcttcgagaaggactaccagtacgagaccgggtggggctgcaaccccggcgactgccccgggttcggcaccgggtgcacggcctgcggcgtgtacctggacaagctcaagtccgtggggaaggcctacaagatcatcagcctgaagtacacccgcaaggtgtgcatccagctgggcaccgagcagacctgcaagcacatcgacgccaacgactgcctcgtgaccccgtccgtcaaggtgtgcatcatcggcacggtgagcaagctgcagccctccgacaccctcctcttcctggggcccctggagcagggcgggatcctcctgaagcagtggtgcaccaccagctgcgcgttcggcgaccccggggacatcatgtccacgaccagcggcatgcggtgcccggagcacaccggctccttccgcaagatctgcgggttcgccaccacgcccgtctgcgagtaccagggcaacaccatcagcgggtacaagcgcatgatggccaccaaggactccttccagagcttcaacctgaccgacccccacatcacgaccaacaagctcgagtggatcgaccccgacggcaacacccgggaccacgtgaacctggtgctgaaccgcgacgtctccttccaggacctcagcgacaacccgtgcaaggtggacctgcacacccaggccatcgagggggcctggggctccggcgtggggttcacgctgacctgcaccgtcggcctcaccgagtgccccagcttcatcacgtccatcaaggcgtgcgacatggccatgtgctacgggagcaccgtgtccaacctggcccggggcagcaacaccgtgaaggtcgtggggaagggcggccacagcgggctgcactcccgctgctgccacgacaccgactgcagctccgagggcctcgtggccagcgccccgcacctggagcgggtcacggggttcaaccagatcgactccgacaaggtgtacgacgacggcgcgccgccctgcaccttcaagtgctggttcaccaagagcggcgagtggctgctcgggatcctgaacggcaactggatcgtggtcgtggtgctggtcgtggtcctcatcttctccatcatcctgttcaacatcctgtgcccccgccgggggcacaagaagaccgtgtga

SEQ ID NO: 11654 - RNA, 3417 nt, synthetic construct
  misc_feature 1..3417: note = derived and/or modified CDS sequence (opt1) from LECV(Of22819)__AF028022.1__GP
  source 1..3417: mol_type = other RNA
atggagggctggtacctgatcgtgctcggggtctgcagcaccctgaccctggccatgcccaagacgatctacgagctcaagatggagtgcccgcacaccgtgggcctggggcagggcatcatcgtggggtccaccgagctgggcctcatccccatcgagaccgccagcgacctgaagctggagtccagctgcaacttcgacctccacacgacctccatgacccagaagtcctacacccaggtcgagtggcgcaagaagtccgacacgaccgacaccaccaacgccgccgccacgaccttcgagagccaggccaagaccgtgaacctgcgggggacctgcgtgctggccgccgagctctacgacacgctgaagaaggtcaagaagaccgtgctgtgctacgacctgacctgcaaccagacccactgccagcccacggtgtacctgatcgcccccgtcatcacgtgcatgagcatccgcagctgcatggcctccgtgttcatcagccggatccagatcatctacgagaagacccactgcgtgaccggccagctgatcgagggccagtgcttcaacccggcccacaccctcaccctggcgcagcccgcccacacctacgagaccgtcacgctgcccgtgacctgcttcttcacccccaagaagtccgaccagctcaagctgatcaagaccttcgaggggatcatcagcaagacgggctgcaccgagaacgccctgcaggggtactacgtgtgcttcctcggctcccacagcgagccgctgcacgtcccctccctgaaggacatccgcagcgccgaggtggtgacccggatgatcgtccacccccgcggcgaggaccacgaccccatccagaactcccaggggtacctccggatcgtgggcccgctgaccgccaaggtgcccagcacgagctccagcgacaccctgcaggggaccgcgttcgccggcgtccccatgtactccagcctctccaccctggtgcgcaacaccgaccccgagttcgtgttcagcccgggcatcatccccgagtccaaccacagcgcctgcgacaagaagacgatccccctgacctggaccgggtacctccccatctccggcgagatggagaaggtcaccgggtgcacggtgttctgcaccctggccggcccgggggccagctgcgaggcgtactccgagagcggcatcttcaacatctccagcccgacctgcctggtcaacaaggtgcagaagttccggggctccgagcagaagatcaacttcatctgccagcgcgtggaccaggacgtcgtggtgtactgcaacgggcagaagaaggtcatcctcaccaagacgctggtgatcggccagtgcatctacaccttcaccagcctgttctccctcatgcccgacgtggcccacagcctggccgtcgagctgtgcgtgcccgggctccacggctgggccaccgtgatgctgctgtccacgttctgcttcgggtggatcctcatccccgccatcaccctggtcgtgctgaaggtgctcaaggtcgcgaccttcagctgcagccactacaccaacgagtccaagttcaagttcatcctggagaaggtgaaggtggagtaccagaagacgatgggcagcatggtctgcgacatctgccaccacgagtgcgagaccgccaaggagctggagtcccacaagcagagctgcatcaacggccagtgcccctactgcatgaccatgaccgaggccacggagtccgccctgcaggcccacttcgcgatctgcaagctcaccgggcggttccaggaggccctgaagaagtccctgaagaagcccgaggtgcgcaagggctgctaccggaccctcggggtgttccgctacaagagccggtgctacgtcggcctggtgtggtgcgtgctgctgacctgcgagctcatcgtctgggccgccagcgcggagacgcccctgctcgagtccgggtggagcgacaccgcccacggcgtgggcgaggtgccgatgaagaccgacctggagctggacttctccctccccagctccagctcctacagctaccgccggaagctgaccaaccccgccaacaaggaggagtccatcccgttccacttccagatggagaagcaggtcatccacgccgagatccagaacctggggcactggatggacgccacgttcaacatcaagaccgcgttccactgctacggcgcctgccagaagtacagctacccctggcagaccgccaagtgcttcttcgagaaggactaccagtacgagaccgggtggggctgcaaccccggcgactgccccggggtgggcacggggtgcaccgcctgcggcgtgtacctcgacaagctcaagagcgtcgggaaggcctacaagatcatctccctgaagtacacccgcaaggtgtgcatccagctcggcaccgagcagacgtgcaagcacatcgacgcgaacgactgcctggtgaccccgagcgtcaaggtgtgcatcgtgggcaccgtctccaagctgcagcccagcgacaccctcctgttcctggggcccctcgagcagggcgggatcatcctgaagcagtggtgcaccacgtcctgcgccttcggcgaccccggggacatcatgagcaccacctccggcatgcggtgcccggagcacaccggcagcttccgcaagatctgcgggttcgccacgacccccgtgtgcgagtaccagggcaacaccatctccgggtacaagcggatgatggccaccaaggacagcttccagtccttcaacctgacggacccccacatcaccaccaacaagctcgagtggatcgaccccgacggcaacacccgcgaccacgtgaacctggtcctgaaccgcgacgtgagcttccaggacctctccgacaacccgtgcaaggtggacctgcacacgcaggccatcgagggggcgtggggcagcggcgtcgggttcaccctgacctgcaccgtgggcctcacggagtgcccctccttcatgaccagcatcaaggcctgcgacctggccatgtgctacgggtccaccgtgcacaacctggcccggggcagcaacaccgtcaaggtggtggggaagggcggccactccgggagcagcttcaagtgctgccacgacacggactgctccagcgagggcctcgtcgcgtccgcgccccacctggagcgcgtgaccgggttcaaccagatcgacagcgacaaggtgtacgacgacggcgcgcccccgtgcaccttcaagtgctggttcaccaagtccggcgagtggctgctcgggatcctgaacggcaactggatcgtcgtggtcgtgctggtggtcgtgctcatcttcagcatcatcctgttctccatcctgtgcccccggcgcgggcacaagaagacggtgtga

SEQ ID NO: 11655 - RNA, 3417 nt, synthetic construct
  misc_feature 1..3417: note = derived and/or modified CDS sequence (opt1) from ORNV(Ol22996)__AF028024.1__GP
  source 1..3417: mol_type = other RNA
atggagggctggtacctgatcgtgctcggggtctgcagcaccgtgaccctggccatgcccaagacgatctacgagctgaagatggagtgcccccacaccgtgggcctcgggcagggctacatcatcgggtccaccgagctgaacctgatccccatcggcgccgcgagcgacctcaagctggagtccagctgcgacttcgacctgtacaccacgcccatgacccagaagtcctacacccaggtcgagtggcgcaagaagtccgagaccacggacaccaccaacgccgccgccaccacgttcgagagccagaccaagaccgtgaacctccgggggacctgcatcctggccagcgagctgtacgacacgctcaacaagatcaagaagcccgtgctgtgctacgacctgaactgcaaccagacccgctgccagccgaccgtctacctcatcgcgcccgtgatcacgtgcatgtccatccggagctgcatggcctccgtgagcaactcccgcatccagatcatctacgagaagacccactgcgtcaccggccagctggtggagggccagtgcttcaaccccagccacaccctgaccctcgcccagcccgcccacacgtacgagaccgtgaccctgccggtgacctgcttcttcacgcccaagaagtccgaccagctgaagctcgtgaagaccttcgaggggatcatcaccaagaccggctgcacggagaacgcgctgcaggggtactacgtgtgcttcctgggcagccactccgagcccctccacgtccccagcctggaggacatccggtccgccgaggtggtgagccgcatgatcgtccacccgcggggcgaggaccacgaccccatccagaacagccaggggcacctccgcatcgtgggccccatcaccgccaaggtgccctccaccagctccagcgacaccctgcaggggacggccttctccggcgtcccgatgtacagctccctgagcaccctggtgcggtccgccgaccccgagttcgtgttcagccccggcatcctccccgagtccaaccacagcgtctgcgacaagaagaccctgccgctgacctggaccgggtacctccccatctccggcgagatggagaaggtgacggggtgcaccgtcttctgcaccctggcgggccccggggccagctgcgaggcctactccgagaacggcatcttcaacatcagctccccgacctgcctggtgaacaaggtgcagaagttccgcggcagcgagcagaagatcaacttcatctgccagcggatggaccaggacgtcgtggtgtactgcaacgggcagaagaaggtcatcctcacgaagaccctggtgatcggccagtgcatctacaccttcacctccctgttcagcctcatgcccgacgtggcccacagcctggccgtcgagctgtgcgtgcccgggctccacggctgggcgacggtgatgctgctgtccaccttctgcttcgggtggatcctcatccccgccatcaccctggtcgtgctgaagttcctcaagatggccaccttcagctgctcccactacacgaacgagagcaagttcaagctgatcctggagaaggtgaaggtcgagtaccagaagaccatgggctccatggtgtgcgacatctgccaccacgagtgcgagaccgccaaggtgctggagagccacaagcagtcctgcatcaacggccagtgcccctactgcatgaccatgacggaggccaccgagagcgcgctccaggcccactactccatctgcaagctgaccgggcgcttccaggaggccctgaagaagtccctcaagaagccggaggtcaagcggggctgctaccgcaccctgggggtgttccggtacaagagccgctgctacgtgggcctggtctggtgcgtgctcctgacgtgcgagctgatcgtgtgggccgccagcgcggagacgcccctcctggagtccgggtggagcgacaccgcccacggcgtcggcgagatccccatgaagaccgacctggagctcgacttctccctgccgagctccagcagctactcctaccggcgcaagctgaccaaccccgccaacaaggaggagagcatccccttccacttccagatggagaagcaggtcatccacgccgagatccagaccctcgggcactggatggacgcgaccttcaacatcaagaccgccttccactgctacggcgcctgccagaagtactcctacccctggcagacggccaagtgcttcttcgagaaggactaccagtacgagaccgggtggggctgcaacccgggcgactgccccggggtgggcaccgggtgcaccgcctgcggcgtctacctggacaagctcaagagcgtggggaaggcgtacaagatcatctccctgaagtacacgcggaaggtgtgcatccagctgggcaccgagcagacctgcaagcacatcgacgccaacgactgcctggtcacccccagcgtgaaggtgtgcatcgtcggcacggtgtccaagctccagcccagcgacaccctgctgttcctcgggccgctggagcagggcgggatcatcctgaagcagtggtggaccacctcctgcgccttcggcgaccccggggacatcatgagcaccacgtccggcatgcgctgccccgagcacaccggcagcttccggaagatctgcgggttcgccaccacccccgtgtgcgagtaccagggcaacacgatctccgggtacaagcgcatgatggccaccaaggacagcttccagtccttcaacctcaccgacccgcacatcaccacgaacaagctggagtggatcgaccccgacggcaacacccgcgaccacgtcaacctggtgctcaaccgggacgtgagcttccaggacctgtccgacaacccctgcaaggtcgacctgcacacccaggcgatcgagggggcctggggcagcggcgtggggttcaccctcacgtgcaccgtgggcctgaccgagtgcccctccttcatgaccagcatcaaggcctgcgacctggccatgtgctacgggagcacggtcaccaacctcgcccgcggctccaacaccgtgaaggtggtcgggaagggcggccacagcgggtccagcttcaagtgctgccacgacaccgactgctccagcgagggcctggtggcgtccgccccgcacctggagcgggtgacggggttcaaccagatcgacagcgacaaggtctacgacgacggcgccccgccctgcaccttccgctgctggttcaccaagtccggcgagtggctcctggggatcctgaacggcaactggatcgtggtggtcgtgctcatcgtcgtgctgatcttcagcatcgtgctgttctccatcctctgcccccggcgcgggcacaagaaggccgtctga

SEQ ID NO: 11656 - RNA, 3426 nt, synthetic construct
  misc_feature 1..3426: note = derived and/or modified CDS sequence (opt1) from BCCV__L39950.1__GP
  source 1..3426: mol_type = other RNA
atgggccgcctgtacctcatcgtgctgggggtcctgatcaccgccaccgccggcttcccccggagcgtgcacgagctcaagatcgagtgcccgcacacggtggtcctggggcagggctacgtgaccgggtccgtggagctgggcttcatcgccctcgaccaggtcaccgacctgaagatcgagagctcctgcagcttcgaccaccacgccgcccccaccacgacccagaacttcacccagctgaagtgggccaagaccgcctccacgaccgacaccaccaacgcggccgagacgaccttcgagagcaagtccaccgaggtgcacctcaagggcgtgtgcaccatccccagcaacgtcctggacgggccctcccgcccggtgacgggccggaagaccgtggtctgctacgacctggcctgcaaccagacccactgccagcccaccgtgcacctcctggcccccatccagacgtgcatgagcgtgcgctcctgcatgatcagcctgctcgcgtcccggatccaggtcgtgtacgagaagacctactgcgtgaccgggcagctgatcgagggcctgtgcttcaaccccgtcccgaacctcgccctgacccagcccgggcacacgtacgacaccttcaccctgcccatcacgtgcttcctcgtggccaagaagggcgccaacctgaagatcgccgtggagctggagaagctcaccaccaagaccggctgcgcggagaacgccctgcaggcctactacatctgcttcatcgggcagcacagcgagcccctgaccgtcccgatgctcgaggactaccgctccgccgagatcttcacgcggatcatgatgaaccccaagggcgaggaccacgacatggagcagagctcccagggggccctgcgcatcgtgggccccatcaagggcaaggtgcccccgaccgagaccagcgacaccgtccaggggatcgcgttcgccggcctgcccatgtactccagcttcagctccctcgtgcggaaggccgagcccgagtacctgttcagccccgggatcatcgccgagtccaaccacagctcctgcgacaagaagacgctgccgctcacctggcgcggcttcctgagcatgtccggggagatcgagcggatcaccggctgcaacgtcttctgcaccctggccggccccggggcgagctgcgaggcctactccgagaacggcatcttcaacatcagctccccgacctgcctcgtgaacaaggtgcagaagttccgcgggagcgagcagcggatcaacttcatctcccagcgcatcgaccaggacgtcatcgtgtactgcaacggccagaagaaggtgatcctgacgaagaccctggtcatcgggcagtgcatctacaccttcaccagcatcttctccctcatccccagcgtggcccactccctggccgtggagctgtgcgtccccggcatccacggctgggccacgatcgcgctcgtgatcaccttctgcttcgggtggctgctgatccccaccaccacgatggtggtcctcaagtgcctgcggctgctcacctacagctgctcccactacagcaccgagagcaagttcaaggtgatcctggagaaggtgaaggtcgagtaccagaagaccatgggctccatggtgtgcgacatctgccaccacgagtgcgagacggccaaggagctggagagccacaagaagtcctgcgccgacgggcagtgcccctactgcatgaccatcaccgaggccaccgagagcgcgctgcaggcccactacgccgtgtgcaagctcacgggccgcttccacgaggccctgaagaagtccctgaagaagcccgaggtccagcgggggtgctaccgcaccctcggcgtgttccggtacaagagccgctgctacgtgggcctggtctggatgtgcctgctcaccctggagctgatcgtgtgggccgcgtccgccgacaccccgctcctggagcccgggtggagcgacacggcccacggcgtgggggacatccccatgaagaccgacctggagctcgacttcgccatcccgtccagctccagctactcctaccggcgccgcctggtcaaccccgccaacagcgacgagaccgtgcccttccacttccagctggagcgccaggtgatccacgcggagatccagtccctcggccactggatggacgccaccttcaacatcatcagcgccttccactgctacggcgagtgcaagaagtactcctacccctggcagacggccaagtgcttcttcgagaaggactaccagtacgagaccagctggagctgcaacccgcccgactgccccggggtcggcaccgggtgcaccgcctgcggcatctacctggacaagctgaagtccgtggggaaggcgtacaaggtgatcacgctcaagtacgcccggaaggtctgcatccagctgggcaccgagcagacctgcaagaacatcgacgtgaacgactgcctggtgaccagctccatcaaggtctgcatgatcggcacgatcagcaagttccagcccggggacaccctcctgttcctgggcccgctcgaggagggcgggctggtgctgaagcagtggtgcaccaccacgtgctccttcggggaccccggcgacatcatgagcaccacctccggcatgcggtgccccgagcacaccgggagcttccgcaagatctgcggcttcgccaccacgcccgtgtgcgagtaccaggggaacaccgtctccggcttcaagcggctcatggccaccaaggacagcttccagtccttcaacgtgagcgaggtgcacatcaccacgaccaagctggagtggtccgacccggacagcaacatcaaggaccacatcaacctgatcctcaaccgcgacgtctccttccaggacctgagcgacaacccctgcaaggtggacctgtccacccaggcgatcgacggggcctggggcagcggcgtggggttcaccctcacgtgcatcgtcggcctgaccgagtgctccagcttcatgaccagcatcaaggtgtgcgacatggccatgtgctacggggcctccgtggtcaacctggtgcggggcagcaacaccgtgaagatcgtcgggaagggcggccactccgggagcacgttccgctgctgccacgacaaggactgcacctccaacggcctcctggccagcgcgccccacctggagcgggtgaccgggttcaaccagatcgactccgacaaggtgtacgacgacggcgcgcccccgtgcagcatcaagtgctggttcgccaagtccggcgagtggctcctggggatcctgaacggcaactgggtcgtggtcgccgtgctcgtgatcatcctgctgatcagcatcttcctcttctccttcttctgccccatccgcagccacaagaagcagctgtga

SEQ ID NO: 11657 - RNA, 3408 nt, synthetic construct
  misc_feature 1..3408: note = derived and/or modified CDS sequence (opt1) from DOBV(DOBV/Ano-Poroia/Afl9/1999)__NC_005234.1__GP
  source 1..3408: mol_type = other RNA
atgatcatgtggggcctgctcctgaccatgatcctgatcgacttcggggccagcctccgcaacgtgtacgacatgaagatcgagtgcccccactccatcaacttcggcgagagctccgtcaccgggaaggtggagctgccgcccctgctcctgacggacgccgaggccctggtgcccgagagctcctgcaacatggacaaccaccagagcatgtccatcatccagaaggtcaccaaggtgagctggcggaagaaggccgacaaggcccaggccgccaaggactccttcgagaccaccagctccgaggtgaacctcaagggcacgtgcgcgctgagccaccgcatggtcgaggagtcctaccggaaccgccggagcgtgatctgctacgacctgtcctgcaacagcacccactgcaagcccaccatgcacatgatcgtgccggtccactcctgcaacatgatgaagtcctgcctcgtggggctgggcccctaccgcatccagatcgtgtacgagcggacctactgcacgaccggcatcctgaccgaggggaagtgcttcgtccccgaccagtccatcgtgaacgtgatcaagaacggcgtcttcgacatcgccagcgtgagcatcgtgtgcttcttcatccgcgtcaaggggaccaactacaagatcatggcctccatcaagacggccaccgcgaacaactgcaacgacaccgacaacaaggtgcagggctactacctctgcatcgtcgggggcaacagctcccccgtgtacgccccgagcaccacggacttccggtccatggaggccctggccagcctgctccgcgcgccccacggcgaggaccacgacctgtccggggaggaggtggccacctacagcatcgccggccagatcgaggggaagatcccccacaccgccaacgccgccaacatgctgttcaccgcgttctccggcatccccagctactccagcctctccgtgttcatcggcagccaggacgggccggtcatctactcccccggcctgttcccccggctgaaccagagctcctgcgacaagatcgccctccccctgatctgggaggggtacatcgacctgccgggctactacgagacggtgcacccctgcaacgtcttctgcgtgctcagcgggcccggcgcctcctgcgaggccttcagcgagggcgggatcttcaacatcaccagcccgacctgcctggtgtccaagcagaaccgcttccgggccgcggagcagcaggtcaacttcgtgtgccagcgcgtggaccaggacatcgtcatctactgcaacggccagaagaagaccatcctgacgaagaccctcgtgatcgggcagtgcatctacagcgtgacctccctgttcagcatcatgcccggcgtcgcccactccatcgccatcgagctgtgcgtgcccgggttccacggctgggccaccgccgcgctcctgacgaccttctgcttcggctggatcctgatcctcagcatcaccctggccgtgctggtcgtgctcaagttcttcgccgccatcctgcacaactccagccaggagaaccggttcaagatcatcctgcgcaagatcaaggaggagttcgagaagaccaaggggtccatggtgtgcgaggtctgcaagtacgagtgcgagacgggcaaggagctcaaggcgcacaacctgagctgcccccagtcccagtgcccctactgcttcacccactgcgagccgaccgagagcgccttccaggcccactacaaggtgtgccaggccacccaccggttccgcgacgacctgaagaagacgatcacgccccagtccaccagccccgggtgctaccggaccctcaacctgttccgctacaagtcccggtgctacatcttcaccgtgtgggtcaccctgctcatcatcgagagcatcatgtgggccgcgtccgccagcgagaccgtgctggagcccagctggaacgacaacgcccacggcgtgggggtcgtgccgatgcacaccgacctggagctggacttctccctccccagctccagcaagtacacctacaagcgcaagctgacgagccccctgaaccaggagcagagcgtggacctccacatcgagatcgagtcccagggcatcagcacctccgtccacgccctgggccactggttcgacgggcgcctgaacctcaagaccagcttccactgctacggcgcctgcaccaagtacgagtacccgtggcacacggcgaagtgccacttcgagcgggacttcgagtacgagaacaactgggggtgcaaccccgccgactgccccggcatcggcaccgggtgcaccgcctgcggcctgtacatcgaccagctgaagcccgtggggtccgcctacaagctcatcaccgtgcgctacagccggaaggtctgcgtgcagttcggcgaggagaacctgtgcaagacgatcgacatgaacgactgcttcgtgacccgccacgtcaaggtgtgcatcatcgggaccgtgtccaagttcagccagggcgacaccctggtcttcctcggcccgatggagggcggcgggctgatcttcaaggactggtgcacgtccacgtgccagttcggggaccccggggacatcatgagccccaaggacaagggcttctcctgccccgacttcaccggccacttccggaagaagtgcaacttcgccaccaccccggtgtgcgagtacgacgggaacatggtgagcggctacaagaaggtcatggcgaccatcgactccttccagagcttcaacaccagctccatccactacaccgacgagcgcatcgagtggaaggaccccgacgggatgctgaaggaccacctcaacatcctggtgacgaaggacatcgacttcgagaacctgggcgagaacccctgcaaggtggggctccagaccagctccatcgagggcgcctggggcagcggggtcggcttcaccctgacctgccagatctccctgacggagtgcagccggttcctcacctccatcaaggcctgcgacatggccatctgctacggggcgcagagcgtgaccctgatccgcggccagaacaccgtgaaggtctccgggaagggcggccacagcgggtccagcttcaagtgctgccacggcacggactgctcccagcaggggctgcaggccagcgcgccccacctcgacaaggtgaacggcatcgtggagcaggagtccgagaaggtctacgacgacggcgccccgcagtgcgggatcagctgctggttcgtgaagtccggcgagtggatcaccgggatcttcaacggcaactggatcgtgatcgtcgtgctggtgttcttcttcatcctgagcctcatcctgctgtccctcctgtgccccatccggaagcacaagcgcagctga

SEQ ID NO: 11658 - RNA, 3408 nt, synthetic construct
  misc_feature 1..3408: note = derived and/or modified CDS sequence (opt1) from DOBV(DOB/Saaremaa/160V)__AJ009774.2__GP
  source 1..3408: mol_type = other RNA
atgatcatgtggggcctgctcctgaccatgagcctgatcaacctcggggcctccctgcgcaacgtgtacgacatgaagatcgagtgcccccacagcatcaacttcggcgagtccagcgtcaccgggaaggtggagctgccgcccatcctcctgacggacgccgaggccctggtgcccgagtccagctgcaacatggacaaccaccagtccctcagcatcacccagaaggtcaccaaggtgtcctggcggaagaaggccgaccaggtgcaggccgccaaggacagcttcgagaccacgtccaacgagatcaacctgaaggggacctgcaccctgacccaccgcatggtcgaggagagctaccggaaccgcaagtccgtgatctgctacgacctcagctgcaactccacgcactgcaagcccaccatgcacatgatcgtgccggtccacagctgcaacatgatgaagtcctgcctggtggggctgggcccctaccgggtgcaggtcgtgtacgagcgcacctactgcaccacgggcatcctcaccgaggggaagtgcttcgtgcccgaccagagcatcatctccgtcatcaagaacggcgtgttcgacatcgccagcgtgagcatcgtctgcttcttcatccgggtgaaggggacctcctacaagatcatggcgagcatcaagacctccaaccccaacaactgcaacgacacggacaacaaggtgcagggctactacctgtgcatcgtcggggccaacagctccccggtgtacgcccccagcaccaccgacttccgctccaccgaggccctggcgagcctcctgcggagcccccacggcgaggaccacgacctgtccggcgaggaggtggccacgtactccatcgccgggcagatcgagggcaagatcccccacaccgccaacgccgcgaacatggccttcaccgccttcagcgggatcccgtcctacagctccctcagcgtcttcgccggcaaccaggacggcaccatcatcttctcccccgggctgttccccaagctgaaccagagctcctgcgacaaggtggccctccccctgatctgggagggctacatcgacctgccggggtactacgagacgatccacccctgcaacgtcttctgcgtgctcagcggccccggggcgagctgcgaggccttctccgagggcggcatcttcaacatcaccagcccgacctgcctggtgtccaagcagaaccgcttccgggccgccgagcagcagatcaacttcgtctgccagcgcgtggaccaggacatcgtgatctactgcaacgggcagaagaagaccatcctgacgaagaccctcgtcatcggccagtgcatctacagcgtgacctccctgttcagcatcatgccctccgtggcccacagcatcgcgatcgagctgtgcgtccccgggttccacggctgggccaccgccgccctcctgacgaccttctgcttcgggtggatcctgatcccctccatcaccctcgccgtgctgatcgtgctgaagttcttcgcggccatcctccacaacagctcccaggagaaccggttcaagatcatcctgcgcaagatcaaggaggagttcgagaagaccaagggcagcatggtctgcgaggtgtgcaagtacgagtgcgagacgggcaaggagctgaaggcccacaacctctcctgcccccagagccagtgcccgtactgcttcacccactgcgagctgaccgagtccgccttccaggcgcactaccgggtgtgccaggccacccaccgcttccgggacgacctgaagaagaccatcacgccccagagcacctcccccgggtgctaccgcaccctcaacctgttccggtacaagagccgctgctacatcttcaccgtctgggtggtgctgctcatcatcgagagcatcctgtgggccgcctccgccagcgagctggtcctggagcccaactggaacgacaacgcgcacggcgtggggatcgtgccgatgcacacggacctcgagctggacttctccctgcccagctccagcaagtacacctacaagcggaagctcacctcccccatcaaccaggagcagagcatcgacctgcacatcgagatcgagtcccagggcatcagcacctccgtccacgccctggggcactggttcgacggccgcctcaacctgaagacgagcttccactgctacggcgcctgcaccaagtacgagtacccgtggcacaccgccaagtgccacttcgagcgcgacttcgagtacgagaacaactggtcctgcaacccgcccgactgccccgggatcggcaccgggtgcacggcctgcggcctgtacctcgaccagctgaagcccgtgggcagcgcgtacaagctgatcaccgtgcggtactcccgcaaggtctgcgtgcagttcggggaggagaacctctgcaagaccatcgacatgaacgactgcttcgtgacccggcacgtcaaggtgtgcatcatcggcacggtgagcaagttctcccagggggacaccctggtcttcctgggccccatggagggcggcggcctcatcttcaaggactggtgcaccaccacgtgccagttcggggaccccggcgacatcatgagccccaaggacaaggggttctcctgcccggacttcaccggccacttccgcaagaagtgcaacttcgccaccacccccgtgtgcgagtacgacgggaacatggtgagcggctacaagaaggtcatggccacgatcgacagcttccaggccttcaacacctcctacatccactacaccgacgagcagatcgagtggaaggaccccgacggcatgctgaaggaccacctgaacatcctcgtgaccaaggacatcgacttcgagaacctgggggagaacccctgccgggtgggcctgcagacggccagcatcgagggggcgtggggctccggggtcggcttcaccctgacctgccagatcagcctcaccgagtgctcccgcttcctgacgagcatcaaggcctgcgacatggccatctgctacggcgcccagtccgtgaccctcgtgcgggggcagaacaccgtcaaggtgagcggcaagggcgggcactccgggagctccttcaagtgctgccacggcaacgactgcagccagcagggcctgcaggcgtccgccccgcacctggacaaggtgaacgggatcgtcgagcaggagagcacccaggtgtacgacgacggcgcgccccagtgcgggatctcctgctggttcatcaagagcggcgagtggatcaagggcatcttctccgggaactggatcgtgatcgtcgtgctcatcgtgctgttcatcctgagcctcatcctgctgtccttcctctgccccatccgcaagcacaagcggagctga

SEQ ID NO: 11659 - RNA, 3408 nt, synthetic construct
  misc_feature 1..3408: note = derived and/or modified CDS sequence (opt1) from DOBV(East Slovakia/400Af/98)__AY168577.1__GP
  source 1..3408: mol_type = other RNA
atgatcatgtggggcctgctcctgaccatgatcctgatcgacttcgggaccagcctccgcaacgtgtacgacatgaagatcgagtgcccccactccatcaacttcggcgagagctccgtcacggggaaggtggagctgccgcccctgctcctgaccgacgccgaggccctggtgcccgagagctcctgcaacatggacaaccaccagagcatgtccatcatccagaaggtcaccaaggtgagctggcggaagaaggccgacaaggcccaggccgccaaggactccttcgagaccacgagctccgaggtgaacctcaaggggacctgcaccctgagccaccgcatggtcgaggagtcctaccggaaccgccggagcgtgatctgctacgacctgtcctgcaacagcacccactgcaagcccacgatgcacatgatcgtgccggtccactcctgcaacatgatgaagtcctgcctcgtggggctgggcccctaccgcatccaggtggtctacgagcggacctactgcaccaccggcatcctgacggaggggaagtgcttcgtgcccgaccagagcatcgtgaacgtcatcaagaacggcgtgttcgacatcgccagcgtgagcatcgtctgcttcttcatccgcgtgaaggggaccaactacaagatcatggcgtccatcaagaccgccaccgccaacaactgcaacgacacggacaacaaggtgcagggctactacctctgcatcgtcgggggcaacagctcccccgtgtacgccccgagcaccaccgacttccggtccatggaggcgctggccagcctgctccgcgcgccccacggcgaggaccacgacctgtccggggaggaggtggccacctacagcatcgccggccagatcgaggggaagatcccccacacggccaacgccgccaacatgctgttcaccgccttctccggcatccccagctactccagcctctccgtctacatcggcagccaggacgggccggtggtctactcccccggcctgttccccaagctgaaccagagctcctgcgacaaggtggccctccccctgatctgggaggggtacatcgacctgccgggctactacgagaccgtgcacccctgcaacgtcttctgcgtgctcagcgggcccggcgcgtcctgcgaggccttcagcgagggcgggatcttcaacatcaccagccccacgtgcctggtgtccaagcagaaccggttccgcgccgccgagcagcaggtcaacttcgtgtgccagcgggtggaccaggacatcgtcatctactgcaacggccagaagaagaccatcctgaccaagaccctcgtgatcgggcagtgcatctacagcgtgacgtccctgttcagcatcatgccgggcgtcgcccactccatcgcgatcgagctgtgcgtgcccgggttccacggctgggccaccgccgccctcctgaccaccttctgcttcggctggatcctgatccccagcatcacgctcgccgtgctggtcgtgctgaagttcttcgcggccatcctccacaactccagccaggagaaccgcttcaagatcatcctgcggaagatcaaggaggagttcgagaagaccaaggggtccatggtgtgcgaggtctgcaagtacgagtgcgagaccggcaaggagctgaaggcccacaacctcagctgcccccagtcccagtgcccgtactgcttcacccactgcgagcccacggagagcgccttccaggcgcactacaaggtgtgccaggccacccaccgcttccgggacgacctgaagaagaccatcacgccccagtccaccagccccgggtgctaccgcaccctgaacctcttccggtacaagtcccgctgctacatcttcaccgtgtgggtcaccctgctgatcatcgagagcatcatgtgggccgcctccgccagcgagaacgtgctcgagccgagctggaacgacaacgcgcacggcgtgggggtcgtgcccatgcacaccgacctggagctggacttctccctgcccagctccagcaagtacacgtacaagcggaagctcacctccccgctgaaccaggagcagagcgtggacctgcacatcgagatcgagtcccagggcatcagcacctccgtccacgccctcggccactggttcgacgggcgcctgaacctgaagaccagcttccactgctacggcgcctgcacgaagtacgagtacccctggcacaccgccaagtgccacttcgagcgcgacttcgagtacgagaactcctgggggtgcaaccccgccgactgccccggcatcggcaccgggtgcaccgcgtgcggcctctacatcgaccagctgaagccggtggggagcgcctacaagctgatcacggtgcggtactcccgcaaggtctgcgtgcagttcggcgaggagaacctctgcaagaccatcgacatgaacgactgcttcgtgacccggcacgtcaaggtgtgcatcatcgggaccgtgagcaagttctcccagggcgacacgctggtcttcctgggccccatggagggcggcgggctcatcttcaaggactggtgcaccagcacgtgccagttcggcgaccccggggacatcatgtcccccaaggacaagggcttcagctgcccggacttcaccggccacttccgcaagaagtgcaacttcgccaccacccccgtgtgcgagtacgacgggaacatggtgtccggctacaagaaggtcatggccaccatcgacagcttccagagcttcaacacctccagcatccactacacggacgagcggatcgagtggaaggaccccgacgggatgctgaaggaccacctgaacatcctcgtgaccaaggacatcgacttcgagaacctgggcgagaacccctgcaaggtggggctgcagacctccagcatcgagggcgcctggggctccggggtcggcttcaccctcacgtgccagatcagcctgaccgagtgctcccgcttcctgaccagcatcaaggcgtgcgacatggccatctgctacggggcccagtccgtgaccctcatccggggccagaacacggtgaaggtcagcgggaagggcggccactccgggagctccttcaagtgctgccacggcaccgactgcagccagcaggggctgcaggcctccgcgccgcacctggacaaggtgaacggcatcgtggagcaggagagcgagaaggtctacgacgacggcgcgccccagtgcgggatctcctgctggttcgtcaagagcggcgagtggatcaccgggatcttcaacggcaactggatcgtgatcgtggtgctcatcttcttcttcatcctgtccctgatcctcctgagcctgctctgccccatccgcaagcacaagcggagctga

SEQ ID NO: 11660 - RNA, 3408 nt, synthetic construct
  misc_feature 1..3408: note = derived and/or modified CDS sequence (opt1) from DOBV(East Slovakia/862Aa/97)__AY168578.1__GP
  source 1..3408: mol_type = other RNA
atgatcatgtggggcctgctcctgaccatgagcctgatcaacctcggggcctccctgcgcaacgtgtacgacctgcggatcgagtgcccccacagcatcaacttcggcgagtccagcgtcaccgggaaggtggagctcccgcccatccccctgacggacgccgagaccctggtgcccgagtccagctgcaacatggacaaccaccagtccctcagcatcacccagaaggtcaccaaggtgtcctggcgcaagaaggcggacaaggtgcaggccgccaaggacagcttcgagacgacctccagcgagatcaacctgaaggggacctgcaccctggcccaccggatggtcgaggagtcctaccgcaaccgcaagagcgtgatctgctacgacctctcctgcaacagcacgcactgcaagccgaccatgtacatgatcgtgcccgtccactcctgcaacatgatgaagtcctgcctggtggggctgggcccctaccggatccaggtggtctacgagcggacctactgcaccacgggcatcctcatcgaggggaagtgcttcgtgcccgaccagagcatcatcagcgtgatcaagaacggcgtcttcgacatcgccagcgtgtccatcgtgtgcttcttcatccgcatcaaggggaacagctacaagatcatgaccaacatcaagaccgcgaacccgaacaactgcaacgacaccgacaacaaggtccagggctactacctgtgcatcgtgggggccaactccagccccgtgtacgccccctccacgaccgacttccggagcatggaggtcctggcctccctcctgcgcagcccccacggcgaggaccacgacctgtccggcgaggaggtggcgacctacagcatcgccggccaggtggagggcaaggtcccgcacaccgagaacgccgccaacatgctgttcacggccttctccgggatccccagctactccagcctctccgtgttcgcgggcaaccaggacggcaccgtcatctacagccccgggctgttccccaagctcaaccagtccagctgcgagaaggtggccctgccgctgatctgggagggctacatcgacctccccgggtactacgagaccatccacccctgcaacgtgttctgcgtcctgtccggccccggggccagctgcgaggccttcagcgagggcggcatcttcaacatcacctccccgacgtgcctggtgagcaagcagaaccggttccgcgccgcggagcagcagatcaacttcgtgtgccagcgggtcgaccaggacatcgtgatctactgcaacgggcagaagaagaccatcctcaccaagaccctggtgatcggccagtgcatctactccgtcacgagcctgttctccatcatgcccggggtggcccacagcatcgccatcgagctctgcgtgcccggcttccacgggtgggccaccgccgcgctgctgaccaccttctgcttcggctggatcctcatcccctccatcacgctggccatcctgatcgtcctcaagttcttcgccgccatcctgcacaacagctcccaggagaaccgcttcaaggtgatcctgcggaagatcaaggaggagttcgagaagaccaagggcagcatggtgtgcgaggtctgcaagtacgagtgcgagaccgggaaggagctcaaggcccacaacctgtcctgcccgcagagccagtgcccctactgcttcacccactgcgagctgacggagtccgcgttccaggcccactaccgcgtgtgccaggccacccaccggttccgcgacgacctcaagaagaccatcacgccccagagcacctcccccggctgctaccggacgctgaacctgttccgctacaagagccggtgctacatcttcaccgtgtgggtcgtgctcctgatcatcgagtccatcctgtgggccgcgagcgccagcgagatcgtgctggagccgtcctggaacgacaacgcccacggggtcggcgtggtgcccatgcacaccgacctcgagctggacttcagcctgccctccagctccaagtacacctacaagcgcaagctcacgagcccgatcaaccaggagcagtccgtcgacctgcacatcgagatcgagagccagcgcatctccaccagcgtgcacgccctggggcactggttcgacggccggctcaacctgaagacctccttccactgctacggcgcctgcaccaagtacgagtacccctggcacacggcgcgctgccacttcgagcgggacttcgagtacgagaacagctggtcctgcaaccccgccgactgccccgggatcggcaccgggtgcaccgcctgcggcctgtacctcgaccagctgaagccggtgggcagcgcctacaagctgatcaccgtccgctactcccggaaggtgtgcgtgcagttcggggaggagaacctctgcaagatcatcgacatgaacgactgcttcgtcagccgccacgtgaaggtgtgcatcatcggcacggtctccaagttcagccagggggacaccctggtgttcctgggccccatggagggcgggggcctcatcttcaaggactggtgcaccaccacgtgccagttcggggaccccggcgacatcatgtcccccaaggacaaggggttcagctgcccggacttcaccggccacttccggaagaagtgcaacttcgccaccacccccgtgtgcgagtacgacgggaacatggtcagcggctacaagaaggtgatggcgacgatcgactccttccaggccttcaacaccagctacatccactacaccgacgagcgcatcgagtggaaggaccccgacggcatgctgaaggaccacatcaacatcctggtgaccaaggacatcgacttcgagaacctcggggagaacccctgcaaggtcggcctgcagacggcctccatcgagggggcctggggcagcggggtgggcttcaccctgacctgccagatctccctcaccgagtgcagccggttcctgacgtccatcaaggcctgcgacatggcgatctgctacggcgcccagagcgtgaccctggtccgcgggcagaacaccgtgaaggtgtccggcaagggcgggcacagcgggtccagcttcaagtgctgccacggcaccgactgctcccagcagggcctccaggccagcgccccgcacctggacaaggtcaacgggatcgtggagcaggagtccacccaggtgtacgacgacggcgcgccccagtgcgggatcagctgctggttcatcaagtccggcgagtggatcaagggcatcttcaacgggaactggatcgtcatcgtggtgctgatcttcttcttcatcctcagcctgatcctgctctccttcctgtgccccatccggaagcacaagcgcagctga

SEQ ID NO: 11661 - RNA, 3408 nt, synthetic construct
  misc_feature 1..3408: note = derived and/or modified CDS sequence (opt1) from DOBV(A35)__GU904036.1__GP
  source 1..3408: mol_type = other RNA
atgatcatgtggggcctgctcctgaccctgagcctcatctccctgggggccagcctgcgcaacgtgtacgacctccggatcgagtgcccccactccatcaacttcggcgagagctccgtcaccgggaaggtggagctgccgcccatccccctgacggacgccgagaccctcgtgcccgagagctcctgcaacatggacaaccaccagagcctgtccatcacccagaaggtcaccaaggtgagctggcgcaagaaggcggacaaggtgcaggccgccaaggactccttcgagacgaccagctccgagatcaacctgaaggggacctgcaccctcgcccaccggatggtcgaggagagctaccgctcccgcaagagcgtgatctgctacgacctgtcctgcaacagcacgcactgcaagccgaccatgtacatgatcgtgcccgtccactcctgcaacatgatgaagtcctgcctggtggggctcggcccctaccggatccaggtggtctacgagcggacctactgcaccacgggcatcctgatcgaggggaagtgcttcgtgcccgaccagagcatcatcagcgtgatcaagaacggcgtcttcgacatcgccagcgtgtccatcgtgtgcttcttcatccgcatcaaggggaacagctacaagatcatgaccaacatcaagaccgcgaacccgaacaactgcaacgacaccgacaacaaggtccagggctactacctgtgcatcgtgggggccaactccagccccgtgtacgccccctccacgaccgacttccggagcatggaggtcctcgcctccctgctgcgcagcccccacggcgaggaccacgacctctccggcgaggaggtggcgacctacagcatcgccggccaggtggagggcaaggtcccgcacaccgagaacgccgccaacatgctgttcacggccttctccgggatccccagctactccagcctgtccgtgttcgcgggcaaccaggacggcaccgtcatctacagccccggcctcttccccaagctgaaccagtccagctgcgagaaggtggccctgccgctcatctgggaggggtacatcgacctgcccgggtactacgagaccatccacccctgcaacgtgttctgcgtcctgagcggccccggggcctcctgcgaggccttcagcgagggcggcatcttcaacatcacctccccgacgtgcctcgtgagcaagcagaaccggttccgcgccgcggagcagcagatcaacttcgtgtgccagcgggtcgaccaggacatcgtgatctactgcaacgggcagaagaagaccatcctgaccaagaccctggtgatcggccagtgcatctactccgtcacgagcctcttctccatcatgcccggggtggcccacagcatcgccatcgagctgtgcgtgcccggcttccacgggtgggccaccgccgcgctgctcaccaccttctgcttcggctggatcctgatcccctccatcacgctggccatcctcatcgtcctgaagttcttcgccgccatcctgcacaacagctcccaggagaaccgcttcaaggtgatcctccggaagatcaaggaggagttcgagaagaccaagggcagcatggtgtgcgaggtctgcaagtacgagtgcgagaccgggaaggagctgaaggcccacaacctgtcctgcccgcagagccagtgcccctactgcttcacccactgcgagctcacggagtccgcgttccaggcccactaccgcgtgtgccaggccacccaccggttccgcgacgacctgaagaagaccatcacgccccagagcacctcccccggctgctaccggacgctgaacctcttccgctacaagagccggtgctacatcttcaccgtgtgggtcgtgctgctgatcatcgagagcatcctgtgggccgcgtccgccagcgagatcgtgctcgagccgtcctggaacgacaacgcccacggggtcggcgtggtgcccatgcacaccgacctggagctggacttcagcctcccctccagctccaagtacacctacaagcgcaagctgacgagcccgatcaaccaggagcagtccgtcgacctgcacatcgagatcgagagccagcgcatctccaccagcgtgcacgccctcgggcactggttcgacggccggctgaacctgaagacctccttccactgctacggcgcctgcaccaagtacgagtacccctggcacacggcgcgctgccacttcgagcgggacttcgagtacgagaacagctggtcctgcaaccccgccgactgccccgggatcggcaccgggtgcaccgcctgcggcctctacctggaccagctgaagccggtgggcagcgcctacaagctcatcaccgtccgctactcccggaaggtgtgcgtgcagttcggggaggagaacctgtgcaagatcatcgacatgaacgactgcttcgtcagccgccacgtgaaggtgtgcatcatcggcacggtctccaagttcagccagggggacaccctggtgttcctcggccccatggagggcgggggcctgatcttcaaggactggtgcaccaccacgtgccagttcggggaccccggcgacatcatgagccccaaggacaaggggttctcctgcccggacttcaccggccacttccggaagaagtgcaacttcgccaccacccccgtgtgcgagtacgacgggaacatggtcagcggctacaagaaggtgatggcgacgatcgactccttccaggccttcaacaccagctacatccactacaccgacgagcgcatcgagtggaaggaccccgacggcatgctgaaggaccacatcaacatcctcgtgaccaaggacatcgacttcgagaacctgggggagaacccctgcaaggtcggcctgcagacggcctccatcgagggggcctggggcagcggggtgggcttcaccctgacctgccagatctccctcaccgagtgcagccggttcctgacgtccatcaaggcctgcgacatggcgatctgctacggcgcccagagcgtgaccctcgtccgcgggcagaacaccgtgaaggtgtccggcaagggcgggcacagcgggtccagcttcaagtgctgccacggcaccgactgctcccagcagggcctgcaggccagcgccccgcacctggacaaggtcaacgggatcgtggagcaggagtccacccaggtgtacgacgacggcgcgccccagtgcgggatcagctgctggttcatcaagtccggcgagtggatcaagggcatcttcaacgggaactggatcgtcatcgtggtgctcatcttcttcttcatcctgagcctgatcctcctgagcttcctgtgccccatccggaagcacaagcgctcctga

SEQ ID NO: 11662 - RNA, 3408 nt, synthetic construct
  misc_feature 1..3408: note = derived and/or modified CDS sequence (opt1) from DOBV(A6)__GU904033.1__GP
  source 1..3408: mol_type = other RNA
atgatcatgtggggcctgctcctgaccatgatcctgatcgacttcggggccagcctccgcaacgtgtacgacatgaagatcgagtgcccccactccatcaacttcggcgagagctccgtcaccgggaaggtggagctgccgcccctgctcctgacggacgccgaggccctggtgcccgagagctcctgcaacatggacaaccaccagagcatgtccatcatccagaaggtcaccaaggtgagctggcggaagaaggccgacaaggcccaggccgccaaggactccttcgagaccaccagctccgaggtgaacctcaagggcacgtgcaccctgagccaccgcatggtcgaggagtcctaccggaaccgccggagcgtgatctgctacgacctgtcctgcaacagcacccactgcaagcccaccatgcacatgatcgtgccggtccactcctgcaacatgatgaagtcctgcctcgtggggctgggcccctaccgcatccaggtggcgtacgagcggacgtactgcaccaccggcatcctgaccgaggggaagtgcttcgtccccgaccagagcatcgtgagcgtgatcaagaacggcgtcttcgacatcgccagcgtgtccatcgtgtgcttcttcatccgcgtcaaggggacgaactacaagatcatggccagcatcaagaccgccaccgcgaacaactgcaacgacaccgacaacaaggtgcagggctactacctctgcatcgtcgggggcaactccagccccgtgtacgccccgtccacgaccgacttccggagcatggaggccctggcctccctgctccgcgcgccccacggcgaggaccacgacctgagcggggaggaggtggccacctactccatcgccggccagatcgaggggaagatcccccacaccgccaacgccgccaacatgctgttcacggcgttcagcggcatcccctcctacagctccctcagcgtgttcatcggctcccaggacgggccgatcatctacagccccggcctgttccccaagctgaaccagtccagctgcgacaaggtcgccctccccctgatctgggaggggtacatcgacctgccgggctactacgagaccgtgcacccctgcaacgtcttctgcgtgctctccgggcccggcgccagctgcgaggccttcagcgagggcgggatcttcaacatcacctccccgacctgcctggtgagcaagcagaaccggttccgcgccgcggagcagcaggtcaacttcgtgtgccagcgggtggaccaggacatcatcatctactgcaacggccagaagaagacgatcctgaccaagaccctcgtcatcgggcagtgcatctactccgtgaccagcctgttctccatcatgcccggcgtggcccacagcatcgccatcgagctgtgcgtccccgggttccacggctgggccacggccgcgctcctgaccaccttctgcttcggctggatcctgatcccctccatcaccctcgccgtgctggtggtcctgaagttcttcgccgccatcctccacaacagctcccaggagaaccgcttcaagatcatcctgcggaagatcaaggaggagttcgagaagacgaaggggagcatggtgtgcgaggtgtgcaagtacgagtgcgagaccggcaaggagctgaaggcgcacaacctctcctgcccccagagccagtgcccgtactgcttcacccactgcgagcccaccgagtccgccttccaggcccactacaaggtctgccaggccacgcaccgcttccgggacgacctgaagaagaccatcacgccccagagcacctcccccgggtgctaccgcaccctgaacctcttccggtacaagagccgctgctacatcttcaccgtgtgggtgaccctgctgatcatcgagtccatcatgtgggccgcgagcgccagcgagaacgtcctcgagccgtcctggaacgacaacgcccacggcgtgggggtggtccccatgcacaccgacctggagctggacttcagcctgccctccagctccaagtacacctacaagcggaagctcacgagcccgctgaaccaggagcagtccgtggacctgcacatcgagatcgagagccagggcatctccaccagcgtgcacgccctcggccactggttcgacgggcgcctgaacctgaagacctccttccactgctacggcgcctgcaccaagtacgagtacccctggcacacggcgaagtgccacttcgagcgcgacttcgagtacgagaacagctgggggtgcaaccccgccgactgccccggcatcggcaccgggtgcaccgcctgcggcctctacatcgaccagctgaagccggtcgggtccgcctacaagctgatcaccgtgcggtacagccgcaaggtgtgcgtccagttcggcgaggagaacctctgcaagacgatcgacatgaacgactgcttcgtgacccggcacgtgaaggtctgcatcatcgggaccgtgtccaagttcagccagggcgacaccctggtgttcctgggccccatggtcgggggcgggctcatcttcaaggactggtgcacgtccacgtgccagttcggcgaccccggggacatcatgagccccaaggacaagggcttctcctgcccggacttcaccggccacttccgcaagaagtgcaacttcgccaccacccccgtgtgcgagtacgacgggaacatggtgagcggctacaagaaggtcatggcgaccatcgacagcttccagtccttcaacaccagctccatccactacaccgacgagcggatcgagtggaaggaccccgacgggatgctgaaggaccacctgaacatcctcgtgacgaaggacatcgacttcgagaacctgggcgagaacccctgcaaggtggggctgcagaccagctccatcgagggcgcctggggcagcggggtcggcttcaccctgacctgccagatctccctcacggagtgcagccgcttcctgacctccatcaaggcctgcgacatggccatctgctacggggcgcagagcgtgaccctcatccggggccagaacaccgtgaaggtctccgggaagggcggccacagcgggtccagcttcaagtgctgccacggcacggactgctcccagcaggggctgcaggccagcgccccgcacctggacaaggtgaacggcatcgtggagcaggactccgagaaggtctacgacgacggcgcgccccagtgcgggatcagctgctggttcgtgaagtccggcgagtggatcaccgggatcttcaacggcaactggatcgtgatcgtcgtgctcgtgttcttcttcatcctgagcctgatcctcctgagcctgctctgccccatccgcaagcacaagcggtcctga

SEQ ID NO: 11663 - RNA, 3408 nt, synthetic construct
  misc_feature 1..3408: note = derived and/or modified CDS sequence (opt1) from DOBV(B13)__GU904034.1__GP
  source 1..3408: mol_type = other RNA
atgatcatgtggggcctgctcctgaccatgatcctgatcgacttcggggccagcctccgcaacgtgtacgacatgaagatcgagtgcccccactccatcaacttcggcgagagctccgtcaccgggaaggtggagctgccgcccctgctcctgacggacgccgaggccctggtgcccgagagctcctgcaacatggacaaccaccagagcatgtccatcatccagaaggtcaccaaggtgagctggcggaagaaggccgacaaggcccaggccgccaaggactccttcgagaccaccagctccgaggtgaacctcaagggcacgtgcaccctgagccaccgcatggtcgaggagtcctaccggaaccgccggagcgtgatctgctacgacctgtcctgcaacagcacccactgcaagcccaccatgcacatgatcgtgccggtccactcctgcaacatgatgaagtcctgcctcgtggggctgggcccctaccgcatccaggtggtctacgagcggacgtactgcaccaccggcatcctgaccgaggggaagtgcttcgtgcccgaccagagcatcgtgagcgtcatcaagaacggcgtgttcgacatcgcgagcgtgtccatcgtctgcttcttcatccgcgtgaaggggacgaactacaagatcatggccagcatcaagaccgccaccgccaacaactgcaacgacaccgacaacaaggtgcagggctactacctctgcatcgtcgggggcaactccagccccgtgtacgcgccgtccacgaccgacttccggagcatggaggccctggcctccctgctccgcgcgccccacggcgaggaccacgacctgagcggggaggaggtggccacctactccatcgccggccagatcgaggggaagatcccccacaccgccaacgccgccaacatgctgttcacggccttcagcggcatcccctcctacagctccctcagcgtcttcatcggctcccaggacgggccgatcatctacagccccggcctgttccccaagctgaaccagtccagctgcgacaaggtggcgctccccctgatctgggaggggtacatcgacctgccgggctactacgagaccgtccacccctgcaacgtgttctgcgtgctctccgggcccggcgccagctgcgaggccttcagcgagggcgggatcttcaacatcacctccccgacctgcctggtcagcaagcagaaccggttccgcgccgccgagcagcaggtcaacttcgtgtgccagcgggtggaccaggacatcatcatctactgcaacggccagaagaagacgatcctgaccaagaccctcgtgatcgggcagtgcatctactccgtgaccagcctgttctccatcatgcccggcgtcgcgcacagcatcgccatcgagctgtgcgtgcccgggttccacggctgggccacggccgccctcctgaccaccttctgcttcggctggatcctgatcccctccatcaccctcgcggtgctggtcgtgctgaagttcttcgccgccatcctccacaacagctcccaggagaaccgcttcaagatcatcctgcggaagatcaaggaggagttcgagaagacgaaggggagcatggtgtgcgaggtctgcaagtacgagtgcgagaccggcaaggagctgaaggcccacaacctctcctgcccccagagccagtgcccgtactgcttcacccactgcgagcccaccgagtccgcgttccaggcccactacaaggtgtgccaggccacgcaccgcttccgggacgacctgaagaagaccatcacgccccagagcacctcccccgggtgctaccgcaccctgaacctcttccggtacaagagccgctgctacatcttcaccgtgtgggtcaccctgctgatcatcgagtccatcatgtgggccgccagcgcgagcgagaacgtgctcgagccgtcctggaacgacaacgcccacggcgtgggggtcgtgcccatgcacaccgacctggagctggacttcagcctgccctccagctccaagtacacctacaagcggaagctcacgagcccgctgaaccaggagcagtccgtggacctgcacatcgagatcgagagccagggcatctccaccagcgtccacgccctcggccactggttcgacgggcgcctgaacctgaagacctccttccactgctacggcgcctgcaccaagtacgagtacccctggcacacggccaagtgccacttcgagcgcgacttcgagtacgagaacagctgggggtgcaaccccgcggactgccccggcatcggcaccgggtgcaccgcctgcggcctctacatcgaccagctgaagccggtggggtccgcctacaagctgatcaccgtgcggtacagccgcaaggtctgcgtgcagttcggcgaggagaacctctgcaagacgatcgacatgaacgactgcttcgtgacccggcacgtcaaggtgtgcatcatcgggaccgtgtccaagttcagccagggcgacaccctggtcttcctgggccccatggtcgggggcgggctcatcttcaaggactggtgcacgtccacgtgccagttcggcgaccccggggacatcatgagccccaaggacaagggcttctcctgcccggacttcaccggccacttccgcaagaagtgcaacttcgccaccacccccgtgtgcgagtacgacgggaacatggtgagcggctacaagaaggtgatggccaccatcgacagcttccagtccttcaacaccagctccatccactacaccgacgagcggatcgagtggaaggaccccgacgggatgctgaaggaccacctgaacatcctcgtgacgaaggacatcgacttcgagaacctgggcgagaacccctgcaaggtcgggctgcagaccagctccatcgagggcgcgtggggcagcggggtgggcttcaccctgacctgccagatctccctcacggagtgcagccgcttcctgacctccatcaaggcctgcgacatggccatctgctacggggcccagagcgtgaccctcatccggggccagaacaccgtcaaggtgtccgggaagggcggccacagcgggtccagcttcaagtgctgccacggcacggactgctcccagcaggggctgcaggcgagcgccccgcacctggacaaggtgaacggcatcgtcgagcaggactccgagaaggtgtacgacgacggcgcgccccagtgcgggatcagctgctggttcgtgaagtccggcgagtggatcaccgggatcttcaacggcaactggatcgtcatcgtggtgctcgtcttcttcttcatcctgagcctgatcctcctgagcctgctctgccccatccgcaagcacaagcggtcctga

SEQ ID NO: 11664 - RNA, 3408 nt, synthetic construct
  misc_feature 1..3408: note = derived and/or modified CDS sequence (opt1) from DOBV(Aa1854/Lipetsk-02)__EU188453.1__GP
  source 1..3408: mol_type = other RNA
atgatcatgtggggcctgctcctgaccatggccctgatcaaccccggggccaccctccgcaacgtgtacgacatgcggatcgagtgcccgcacagcatcaacttcggcgagtccagcgtcacggggaaggtggagctgccgcccatccccctggccgacgccgagaccctcgtgcccgagtccagctgcaacatggacaaccaccagtccctgagcatcacccagaaggtcaccaaggtgtcctggcgcaagaaggccgacaaggtgcaggccgccaaggacagcttcgagacgacctccagcgagatcaacctgaaggggacctgcaccctcacgcaccggatggtcgaggagtcctaccgcaaccgcaagagcgtgatctgctacgacctgtcctgcaacagcacccactgcaagcccaccatgcacatgatcgtgcccgtccactcctgcaacatgatgaagtcctgcctggtgggcctcggcccctaccggatccaggtggtctacgagcggacctactgcacgaccggcatcctgaccgaggggaagtgcttcgtgccggaccagagcatcgtgagcgtcatcaagaacggcgtgttcgacatcgcctccgtgagcatcgtctgcttcttcatccgcatcaaggggaacagctacaagatcatggcctccatcaaggaggccaaccccaacaactgcaacgacaccgacaacaaggtgcagggctactacctgtgcatcgtgggggccaacagctcccccgtctacgcgcccagcacgaccgacttccggtccgtggaggccctcgccagcctgctgcgctccccgcacggcgaggaccacgacctcagcggcgaggaggtggccacctactccatcgccgggcaggtcgagggcaaggtgccccacaccgcgaacgccgccaacatgctgttcacggccttcagcgggatcccctcccacagctccttcagcgtcttcaccggcaaccaggacggcaccgtgatctactcccccgggctgttcccgaagctcaaccagagcgcctgcgacaaggtggcgctgcccctgatctgggagggctacatcgacctccccgggtactacgagaccatccacccctgcaacgtcttctgcgtgctgtccggcccgggggccagctgcgaggccttctccgagggcggcatcttcaacatcacgagcccgacctgcctggtgagcaagcagaaccggttccgcgccgccgagcagcagatcaacttcgtctgccagcgggtggaccaggacatcgtgatctactgcaacgggcagaagaagaccatcctcaccaagacgctggtcatcggccagtgcatctactccgtgaccagcctgttctccatcatgcccggggtggcgcacagcatcgccatcgagctctgcgtccccggcttccacgggtgggccaccgccgccctgctgaccacgttctgcttcggctggatcctcatcccctccatcaccctggcgatcctgatcgtgctcaagttcttcgccgccatcctgcacaacagctcccaggagaaccgcttcaagatcatcctgcggaagatcaaggaggagttcgagcgcaccaagggcagcatggtgtgcgaggtctgcaagtacgagtgcgagaccgggaaggagctcaaggcccacaacctgtcctgcccccagagccagtgcccctactgcttcacgcactgcgagctgaccgagtccgcgttccaggcccactaccgggtgtgccaggccacccaccgcttccgggacgacctcaagaagaccatcacgccccagagcacctccccgggctgctaccgcaccctgaacctgttccggtacaagagccgctgctacatcttcaccgtgtgggtcgtgctcctgatcatcgagtccatcctgtgggccgccagcgcgtccgagaccgtgctcgagcccaactggaacgacaacgcccacggggtcggcgtggtgcccatgcacacggacctggagctggacttcagcctgccgagctccagcaagtacacctacaagcgcaagctcacctcccccatcaaccaggagcagagcgtcgacctgcacatcgaggtggagtcccaggggatcagcacctccgtgcacgccctgggccactggttcgacggccggctcaacctgaagacgagcttccactgctacggggcctgcaccaagtacgagtacccctggcacaccgcccgctgccacttcgagcgggacttcgagtacgagaactcctggagctgcaaccccgcggactgcccgggcatcgggaccggctgcacggcctgcggcctgtacctcgaccagctgaagcccgtcgggtccgcctacaagctgatcaccgtgcgctacagccggcgcgtgtgcgtccagttcggcgaggagaacctctgcaagaccatcgacatgaacgactgcttcgtgacccggcacgtgaaggtctgcatcatcgggacggtgtccaagttcagccagggcgacaccctggtgttcctggggcccatggagggcggcgggctcatcttcaaggactggtgcaccaccacgtgccagttcggcgaccccggggacatcatgtccccgaaggacaagggcttcagctgccccgacttcaccgggcacttccgcaagaagtgcaacttcgccaccacccccgtctgcgagtacgacggcaacatggtgtccggctacaagaaggtgatggccacgatcgacagcttccaggcgttcaacacctccaacatccactacaccgacgagcggatcgagtggaaggaccccgacgggatgctgaaggaccacctgaacatcctcgtcaccaaggacatcgacttcgagaacctgggcgagaacccgtgcaaggtggggctgcagacggccagcatcgagggcgcctgggggagcggcgtgggcttcaccctgacctgccagatctccctcaccgagtgcagccgcttcctgacgtccatcaaggcctgcgacatggcgatctgctacggggcccagagcgtcaccctcgtgcggggccagaacaccgtgaaggtctccgggaagggcgggcacagcggctccagcttcaagtgctgccacggcaccgactgctcccagcaggggctgcaggccagcgcgccccacctggacaaggtgaacggcatcgtggagcaggagtccacgcaggtctacgacgacggggcgccccagtgcggcatcagctgctggttcatcaagtccggcgagtggatcaaggggatcttcaacggcaactggatcgtgatcgtggtcctcatcttcttcttcatcctgagcctgatcctcctgtccttcctgtgccccatccgcaagcacaagcggagctga

SEQ ID NO: 11665 - RNA, 3402 nt, synthetic construct
  misc_feature 1..3402: note = derived and/or modified CDS sequence (opt1) from DOBV(Ap/Sochi/hu)__JF920149.1__GP
  source 1..3402: mol_type = other RNA
atgtggggcctgctcctgaccatgatcctgatcgacttcggggccaccctccgcaacgtgtacgacatgcggatcgagtgcccccacagcgtcaacttcggcgagtccagcgtgtccgggaaggtggagctgccgcccgtcctgctcagcgaggtggagacgctggtgcccgagtccagctgcaacatggacaaccaccagtccatgagcatcatccagaaggtcacccagctgacctggcgcaagaaggccgacaaggcccaggccgccaaggactccttcgagatcaccagcggcgaggtgtccctcaaggggacgtgcaccctgacccaccggatggtggaggacagccaccgcaaccggaagtccatcatctgctacgacctgagctgcaactccacccactgcaagcccacgatgcacatgatcgtcccgatccacagctgcaacatgatgaagtcctgcctcgtgggcctgggcccctaccgcatccaggtggtctacgagcggacctactgcaccaccgggatcctgacggagggcaagtgcttcgtgcccgaccagagcatcgtgaacgtcatcaagaacggggtgttcgacatcgcctccgtgagcatcgtctgcttcttcgtgcgcgtgaagggcaccaactacaagatcatggccagcatcaagaccgcgacctccaacaactgcaacgacacggggaacaaggtccagggctactacctctgcatcgtgggcgggaacagctcccccgtgtacgtcccgagcaccaccgacttccggtccatggaggccctggccagcatgctgcgcgcgccccacggcgaggaccacgacctcgccggggaggaggtggccacctactccatcgccggccaggtcgagggcaaggtgccccacacggccagcaccgccaacatgctgctgaccgcgttctccgggatccccagctactccagcctctccgtgttcaccggcagccaggacgggccgatcgtctactcccccggcctgttccccaagctgaaccagagctcctgcgacaaggtggggctccccctgatctgggagggctacatcgacctgccgggctactacgagacggtgcaccagtgcaacgtcttctgcgtgctcagcgggcccggcgcctcctgcgaggccttcagcgagggcgggatcttcaacatcaccagccccaactgcatggtgtccaagcagaaccggttccgcgccgccgagcagcaggtcaacttcgcgtgccagcgggtggaccaggacatcctgatcttctgcaacgggcagaagaagaccatcctgaccaagacgctcgtgatcggccagtgcatctacagcatcacctccctgttcagcatcatgcccggcgtcgcccactccatcgccatcgagctgtgcgtgccggggttccacggctgggccaccgccgcgctcctgaccacgttctgcttcgggtgggtgctgatccccagcatcaccctcgccgtcctggtggtgctgaagttcttcgccgccatcctccacaactccagccaggagaaccgcttcaagctgatcctgaagaagatcaaggaggagttcgagaagaccaagggctccatggtctgcgaggtgtgcaagtacgagtgcgagaccgggaaggagctcaaggcccacaacctgagctgcccccagtcccagtgcccctactgcttcacgcactgcgagccgaccgagagcgcgttccaggcccactacaaggtgtgccaggccacccaccggttccgcgacgacctgaagaagaccatcacgccccagtccaccagccccggctgctaccggaccctcaacctgttccgctacaagtcccggtgctacatcttcaccgtctgggtggtgctgctcgtcgtggagagcgtgatgtgggccgcgtccgccagcgagaccgtcctggagcccagctggaacgacaacgcccacggcgtgggggtggtcccgatgcacacggacctggagctggacttctccctccccagctccagcaagtacacctacaagcgcaagctgacctcccccatcaaccaggagcagagcgtggacctgcacatcgagatcgagtcccagggcatcagcacctccgtgcacgccctcgggcactggttcgacggccggctgaacctgaagacgagcttccactgctacggcgcctgcaccaagtacgagtacccgtggcacaccgcgcgctgccacttcgagcgcgacttcgagtacgagaactcctgggggtgcaaccccgccgactgccccggcatcgggaccggctgcacggcctgcgggatctacatcgaccagctcaagcccgtcggcagcgcctacaagctgatcaccgtgcggtactcccgcaaggtgtgcgtccagttcggcgaggagaacctgtgcaagaccatcgacatgaacgactgcttcgtgacccggcacgtgaaggtctgcatcatcgggacggtgagcaagttctcccagggcgacaccctcgtgttcctggggccgatggagggcgggggcctgatcttcaaggactggtgcaccagcacgtgccagttcggcgaccccggggacatcatgtcccccaaggacaagggcttcagctgccccgagttcaccgggcacttccgcaagaagtgcaacttcgccaccaccccggtctgcgagtacgacggcaacatggtgtccgggtacaagaaggtgatggcgaccatcgacagcttccaggccttcaacacgagctccatccactacaccgacgagcggatcgagtggaaggaccccgacggcatgctcaaggaccacctgaacatcctggtcaccaaggacatcgacttcgagaacctcggcgacaacccctgcaaggtggggctgcagaccgtgagcatcgagggcgcctgggggtccggcgtcgggttcacgctgacctgccaggtgagcctcaccgagtgctcccgcttcctgaccagcatcaaggcctgcgacaaggccatctgctacggcgcgcagtccagcacgctgatccggggccagaacaccgtgaaggtctccgggaagggcgggcacagcggctccagcttcaagtgctgccacggcaccgactgctcccagcaggggctccaggccagcgcgccccacctggacaagatcaacggcatcgtggagcaggagaacgagaaggtctacgacgacggggccccgcagtgcggcatctcctgctggttcgtcaagagcggggagtggatccagggcatcttcaacggcaactggatcgtgatcgtggtgctgatcttcttcttcatcctctccctgatcctgctcagcatcttctgccccatccgcaagcacaagcggtcctga

SEQ ID NO: 11666 - RNA, 3402 nt, synthetic construct
  misc_feature 1..3402: note = derived and/or modified CDS sequence (opt1) from DOBV(Ap1584/Sochi-01)__EU188450.1__GP
  source 1..3402: mol_type = other RNA
atgtggggcctgctcctgaccatgatcctgatcgacttcggggccaccctccgcaacgtgtacgacatgcggatcgagtgcccccacagcgtcaacttcggcgagtccagcgtgtccgggaaggtggagctgccgcccgtcctgctcagcgaggtggagacgctggtgcccgagtccagctgcaacatggacaaccaccagtccatgagcatcatccagaaggtcacccagctgacctggcgcaagaaggccgacaaggcgcaggccgccaaggactccttcgagatcaccagcggcgaggtgtccctcaaggggacgtgcaccctgacccaccggatggtggaggacagccaccgcaaccggaagtccatcatctgctacgacctgagctgcaactccacccactgcaagcccacgatgcacatgatcgtcccgatccacagctgcaacatgatgaagtcctgcctcgtgggcctgggcccctaccgcatccaggtggtctacgagcggacctactgcaccaccgggatcctgacggagggcaagtgcttcgtgcccgaccagagcatcgtgaacgtcatcaagaacggggtgttcgacatcgcctccgtgagcatcgtctgcttcttcgtgcgcgtgaagggcaccaactacaagatcatggccagcatcaagaccgcgacctccaacaactgcaacgacacggggaacaaggtccagggctactacctctgcatcgtgggcgggaacagctcccccgtgtacgtcccgagcaccaccgacttccggtccatggaggccctggccagcatgctgcgcgcgccccacggcgaggaccacgacctcgccggggaggaggtggccacctactccatcgccggccaggtcgagggcaaggtgccccacacggccaacgccgcgaacatgctgctgaccgccttcagcggggtgccctcctacagctccctcagcgtcttcaccggctcccaggacgggccgatcgtgtacagccccggcctgttccccaagctgaaccagtccagctgcgacaaggtggggctccccctgatctgggagggctacatcgacctgccgggctactacgagaccgtccaccagtgcaacgtgttctgcgtgctctccgggcccggcgccagctgcgaggccttctccgagggcgggatcttcaacatcacgagccccaactgcatggtcagcaagcagaaccggttccgcgccgcggagcagcaggtcaacttcgcctgccagtccgtggaccaggacatcctgatcttctgcaacgggcagaagaagaccatcctgaccaagaccctcgtgatcggccagtgcatctaccccatcacgagcctgttctccatcatgccgggcgtggcccacagcatcgccatcgagctgtgcgtgcccgggttccacggctgggccaccgcggccctcctgaccaccttctgcttcgggtgggtcctgatcccctccatcacgctcgccgtgctggtggtcctgaagttcttcgccgccatcctccacaacagctcccaggagaaccggttcaagctgatcctgaagaagatcaaggaggagttcgagaagaccaagggcagcatggtgtgcgaggtgtgcaagtacgagtgcgagaccgggaaggagctcaaggcgcacaacctgtcctgcccccagagccagtgcccgtactgcttcacccactgcgagcccacggagtccgccttccaggcccactacaaggtctgccaggccacccaccgcttccgggacgacctgaagaagaccatcacgccccagagcacctcccccggctgctaccgcaccctcaacctgttccggtacaagagccgctgctacatcttcaccgtgtgggtggtcctgctcgtggtggagtccgtcatgtgggcggccagcgcctccgagaccgtgctggagccgagctggaacgacaacgcccacggcgtgggggtcgtgcccatgcacaccgacctggagctggacttcagcctcccctccagctccaagtacacgtacaagcggaagctgaccagcccgatcaaccaggagcagtccgtggacctgcacatcgagatcgagagccagggcatctccaccagcgtccacgccctcgggcactggttcgacggccgcctgaacctgaagacctccttccactgctacggcgcgtgcacgaagtacgagtacccctggcacaccgcccggtgccacttcgagcgcgacttcgagtacgagaacagctgggggtgcaaccccgccgactgccccggcatcgggaccggctgcaccgcctgcgggatctacatcgaccagctcaagccggtgggctccgcctacaagctgatcacggtgcgctacagccggaaggtctgcgtgcagttcggcgaggagaacctgtgcaagaccatcgacatgaacgactgcttcgtgacccgccacgtcaaggtgtgcatcatcgggaccgtgtccaagttcagccagggcgacacgctcgtcttcctggggcccatggagggcgggggcctgatcttcaaggactggtgcacctccacgtgccagttcggcgaccccggggacatcatgagccccaaggacaagggcttctcctgcccggagttcaccgggcacttccggaagaagtgcaacttcgcgaccacccccgtgtgcgagtacgacggcaacatggtgagcgggtacaagaaggtcatggccaccatcgactccttccaggccttcaacaccagcagcatccactacacggacgagcgcatcgagtggaaggaccccgacggcatgctcaaggaccacctgaacatcctggtgaccaaggacatcgacttcgagaacctcggcgactccccctgcaaggtggggctgcagaccgtcagcatcgagggcgcctgggggtccggcgtggggttcaccctgacgtgccaggtgagcctcaccgagtgctcccggttcctgaccagcatcaaggcctgcgacaaggcgatctgctacggcgcccagtccagcaccctgatccgcggccagaacacggtcaaggtgtccgggaagggcgggcacagcggctccagcttcaagtgctgccacggcaccgactgctcccagcaggggctccaggccagcgccccgcacctggacaagatcaacggcatcgtcgagcaggagaacgagaaggtgtacgacgacggggcgccccagtgcggcatctcctgctggttcgtcaagagcggggagtggatccagggcatcttcaacggcaactggatcgtgatcgtggtgctgatcttcttcttcatcctctccctgatcctgctcagcatcttctgccccatccggaagcacaagcgctcctga

SEQ ID NO: 11667 - RNA, 3408 nt, synthetic construct
  misc_feature 1..3408: note = derived and/or modified CDS sequence (opt1) from DOBV(GER/05/477/Af)__GQ205411.1__GP
  source 1..3408: mol_type = other RNA
atgatcatgtggggcctgctcctgaccctgagcctcatcaacctgggggcctccctgcgcaacgtgtacgacatgaagatcgagtgcccccacagcatcaacttcggcgagtccagcgtcaccgggaaggtggagctcccgcccctgctgctcacggacgccgaggccctggtgcccgagtccagctgcaacatggacaaccaccagtccctgagcatcacccagaaggtcaccaaggtgtcctggcggaagaaggccgacaaggtgcaggccgccaaggacagcttcgagaccacgtccagcgaggtcaacttcaaggggacctgcaccctcacccaccgcatggtggaggagtcctaccggaaccgcaagagcgtgatctgctacgacctgtcctgcaacagcacgcactgcaagcccaccatgcacatgatcgtcccggtgcactcctgcaacatgatgaagtcctgcctggtggggctcggcccctaccggatccaggtcgtgtacgagcgcacctactgcaccacgggcatcctgaccgaggggaagtgcttcgtgcccgaccagtccatcatcagcgtcctgaagaacggcgtgttcgacatcgccagcgtgtccatcgtctgcttcttcatccggatcaaggggaccagctacaagatcatgacctccatcaaggaggcgaaccccaacaactgcaacgacacggacaacaaggtgcagggctactacctctgcatcgtgggggccaacagctccccggtctacgcccccagcaccaccgacttccgctccgtggaggccctggcgagcctgctccggagcccccacggcgaggaccacgacctggccggcgaggaggtggccacctacagcatcgccgggcaggtcgagggcaaggtgccccacacggccaacgcggccaacatgctgttcaccgccttctccgggatcccgagctactccagcttctccgtcttcaccggcaaccaggagggcaacgtgatctacagccccggcctcttccccaagctgaaccagtccagctgcgagaaggtggccctgcccctcatctgggagggctacatcgacctgccggggtactacgagaccgtccacccctgcaacgtgttctgcgtgctgtccggccccggggccagctgcgaggcgttcagcgagggcggcatcttcaacatcacgtccccgacctgcctcgtcagcaagcagaaccgcttccgggccgccgagcagcagatcaacttcgtgtgccagcgcgtggaccaggacatcgtcatctactgcaacgggcagaagaagaccatcctgaccaagacgctggtgatcggccagtgcatctactccgtgaccagcctcttctccatcatgcccggggtcgcccacagcatcgccatcgagctgtgcgtgcccggcttccacgggtgggcgaccgccgccctgctcaccacgttctgcttcggctggatcctgatcccctccatcaccctggccatcctcatcatcctgaagttcttcgccgcgctgttccacaacagctcccaggagaaccggttcaagatcatcctcaagaagatcaaggaggagttcgagaagaccaagggcagcatggtgtgcgaggtctgcaagtacgagtgcgagaccgggaaggagctgaaggcccacaacctgtcctgcccccagagccagtgcccgtactgcttcacgcactgcgagctcaccgagtccgccttccaggcccactaccgcgtgtgccaggcgacccaccggttccgcgacgacctgaagaagaccatcacgccccagagcacgtcccccggctgctaccggaccctgaacctcttccgctacaagagccggtgctacatcttcaccgtgtgggtcatcctgctgatcatcgagtccatcctgtgggccgccagcgccagcgagaccgtgctcgagccctcctggaacgacaacgcccacggggtgggcgtcgtgccgatgcacacggacctggagctggacttcagcctcccctccagctccaagtacacctacaagcgcaagctgaccagccccatcaaccaggagcagtccgtggacctgcacatcgagatcgagagccaggggatctccaccagcgtccacgcgctcggccactggttcgacggccggctgaacctgaagacgtccttccactgctacggggcctgcaccaagtacgagtacccgtggcacaccgccaagtgccacttcgagcgcgacttcgagtacgagaacagctggtcctgcaaccccgccgactgccccggcatcgggaccggctgcacggcctgcggcctctacctggaccagctgaagcccgtggggagcgcgtacaagctcatcaccgtgcgctactcccggaaggtctgcgtgcagttcggcgaggagaacctgtgcaagaccatcgacatgaacgactgcttcgtgacccgccacgtcaaggtgtgcatcatcgggacggtgagcaagttctcccagggcgacaccctggtcttcctcgggccgatggagggcggcgggctgatcttcaaggactggtgcaccaccacgtgccagttcggcgaccccggggacatcatgagccccaaggacaagggcttctcctgccccgacttcaccgggcacttccggaagaagtgcaacttcgccaccaccccggtgtgcgagtacgacggcaacatggtgagcggctacaagaaggtcatggccacgatcgacagcttccaggccttcaacacctccaacatccactacaccgacgagcgcatcgagtggaaggaccccgacgggatgctgaaggaccacctcaacatcctggtgaccaaggacatcgacttcgagaacctgggcgagaacccctgcaaggtggggctccagacggccagcatcgacggcgcgtgggggtccggcgtcggcttcaccctgacctgccagatcagcctgaccgagtgctcccggttcctcacgagcatcaaggcctgcgacatggccatctgctacggggcccagtccgtgaccctggtgcgcggccagaacaccgtccgggtgagcgggaagggcgggcactccggcagctccttcaagtgctgccacggcaccgactgcagccagcaggggctgcaggcgtccgcgccccacctcgacaaggtgaacggcatcgtcgagcaggagagcacccaggtgtacgacgacggggccccgcagtgcggcatctcctgctggttcgtcaagagcggcgagtggatcaaggggatcttcaacggcaactggatcgtgatcgtggtgctgatcttcctgttcctcctgtccctgatcctcctgagcttcctgtgccccatccgcaagcacaagcggtcctga

SEQ ID NO: 11668 - RNA, 3408 nt, synthetic construct
  misc_feature 1..3408: note = derived and/or modified CDS sequence (opt1) from DOBV(GER/07/607/Af)__GQ205410.1__GP
  source 1..3408: mol_type = other RNA
atgatcatgtggggcctgctcgtgaccctgagcctgatcaacctcggggcctccctgcgcaacgtctacgacatgaagatcgagtgcccccacagcatcaacttcggcgagtccagcgtgaccgggaaggtggagctgccgcccctccccctgacggacgccgagaccctggtccccgagtccagctgcaacatggacaaccaccagtccctcagcatcacccagaaggtgaccaaggtgtcctggcggaagaaggccgacaaggtccaggccgccaaggacagcttcgagacgacctccagcgagatgaacctgaaggggacctgcaccctgacgcaccgcatggtggaggagtcctaccggaaccgcaagagcgtgatctgctacgacctctcctgcaacagcacccactgcaagccgaccatgcacatgatcgtccccgtgcactcctgcaacatgatgaagtcctgcctggtgggcctgggcccctaccggatccaggtcgtgtacgagcgcacctactgcacgaccggcatcctcaccgaggggaagtgcttcgtgcccgaccagtccatcatcagcgtcatgaagaacggcgtgttcgacatcgccagcgtgtccatcgtctgcttcttcatccggatcaaggggaccagctacaagatcatgacgtccatcaaggaggccaacccgaacaactgcaacgacaccgacaccaaggtgcagggctactacctgtgcatcgtgggggcgaacagctcccccgtctacgcccccagcaccacggacttccgctccgtggaggccctggccagcctcctgcggagcccccacggcgaggaccacgacctggcgggcgaggaggtggccacctacagcatcgccgggcaggtcgagggcaaggtgccgcacaccgccaacgccgcgaacatgctgttcaccgccttctccgggatccccagctactccagcttctccgtcttcacgggcaaccaggacggcaccgtgatctacagccccggcctcttccccaagctgaaccagtccagctgcgacaaggtggccctcccgctgatctgggaggggtacatcgacctgcccgggtactacgagaccgtccacccctgcaacgtgttctgcgtgctctccggccccggggccagctgcgaggccttcagcgagggcggcatcttcaacatcacctccccgacgtgcctggtcagcaagcagaaccgcttccgggcggccgagcagcagatcaacttcgtgtgccagcgcgtggaccaggacatcgtcatctactgcaacgggcagaagaagaccatcctgaccaagaccctcgtgatcggccagtgcatctactccgtgacgagcctgttctccatcatgcccggggtcgcccacagcatcgccatcgagctgtgcgtgcccggcttccacgggtgggccaccgcggccctcctgaccaccttctgcttcggctggatcctgatcccctccatcacgctcgccatcctgatcgtgctgaagttcttcgccgccctcctgcacaacagctcccaggagaaccggttcaagatcatcctgaagaagatcaaggaggagttcgagaagaccaagggcagcatggtctgcgaggtgtgcaagtacgagtgcgagaccgggaaggagctcaaggcgcacaacctgtcctgcccgcagagccagtgcccctactgcttcacccactgcgagctgaccgagtccgccttccaggcccactaccgcgtgtgccaggccacgcaccggttccgcgacgacctcaagaagaccatcacgccccagagcacctcccccggctgctaccggaccctgaacctgttccgctacaagagccggtgctacatcttcaccgtctgggtgatcctcctgatcatcgagtccatcctgtgggcggccagcgccagcgagaccgtgctggagccgtcctggaacgacaacgcccacggggtcggcgtggtgcccatgcacgccgacctcgagctggacttcagcctgccctccagctccaagtacacctacaagcgcaagctcacgagcccgatcaaccaggagcagtccgtcgacctgcacatcgagatcgagagccaggggatctccaccagcgtgcacgcgctgggccactggttcgacggccggctcaacctgaagacctccttccactgctacggggcctgcaccaagtacgagtacccctggcacacggccaagtgccacttcgagcgcgacttcgagtacgagaacagctggtcctgcaaccccgccgactgccccggcatcgggaccggctgcaccgcctgcggcctgtacctcgaccagctgaagccggtggggagcgcgtacaagctgatcaccgtccgctactcccggaaggtgtgcgtgcagttcggcgaggagaacctctgcaagacgatcgacatgaacgactgcttcgtcacccgccacgtgaaggtgtgcatcatcgggaccgtcagcaagttctcccagggcgacaccctggtgttcctggggcccatggagggcggcgggctcatcttcaaggactggtgcacgacgacctgccagttcggcgaccccggggacatcatgagccccaaggacaagggcttctcctgcccggacttcaccgggcacttccggaagaagtgcaacttcgccaccacccccgtgtgcgagtacgacggcaacatggtcagcggctacaagaaggtgatggccaccatcgacagcttccaggccttcaacacctccaacatccactacacggacgagcgcatcgagtggaaggaccccgacgggatgctgaaggaccacctgaacatcctcgtgaccaaggacatcgacttcgagaacctgggcgagaacccctgcaaggtcgggctgcagaccgccagcatcgacggcgcgtgggggtccggcgtgggcttcaccctcacgtgccagatcagcctgaccgagtgctcccggttcctgaccagcatcaaggcctgcgacatggccatctgctacggggcccagtccgtgaccctcgtccgcggccagaacacggtgaaggtgagcgggaagggcgggcactccggcagctccttcaagtgctgccacggcaccgactgcagccagcaggggctgcaggcgtccgccccgcacctggacaaggtcaacggcatcgtggagcaggagagcacccaggtgtacgacgacggggcgccccagtgcggcatctcctgctggttcgtcaagagcggcgagtggatcaaggggatcttctccggcaactggatcgtgatcgtggtcctcatcttcctgttcctgctcagcctgatcctgctctccttcctgtgccccatccggaagcacaagcgcagctga

SEQ ID NO: 11669 - RNA, 3408 nt, synthetic construct
  misc_feature 1..3408: note = derived and/or modified CDS sequence (opt1) from DOBV(GER/08/118/Aa)__GQ205412.1__GP
  source 1..3408: mol_type = other RNA
atgatcatgtggggcctgctcgtgatcctgagcctgatcaacctcggggcctccctgcgcaacgtctacgacatgaagatcgagtgcccccacagcatcaacttcggcgagtccagcgtgaccgggaaggtggagctgccgcccctccccctgaccgacgccgagacgctggtccccgagtccagctgcaacatggacaaccaccagtccctcagcatcacccagaaggtgaccaaggtgtcctggcggaagaaggccgacaaggtccaggccgccaaggacagcttcgagaccacgtccagcgagatcaacctgaaggggacctgcaccctgacccaccgcatggtggaggagtcctaccggaaccgcaagagcgtgatctgctacgacctctcctgcaacagcacgcactgcaagccgaccatgcacatgatcgtccccgtgcactcctgcaacatgatgaagtcctgcctggtgggcctgggcccctaccggatccaggtcgtgtacgagcgcacctactgcaccacgggcatcctcaccgaggggaagtgcttcgtgcccgaccagtccatcatcagcgtcatgaagaacggcgtgttcgacatcgccagcgtgtccatcgtctgcttcttcatccggatcaaggggaccagctacaagatcatgacctccatcaaggaggccaacccgaacaactgcaacgacacggacaacaaggtgcagggctactacctgtgcatcgtgggggcgaacagctcccccgtctacgcccccagcaccaccgacttccgctccgtggaggccctggccagcctcctgcggagcccccacggcgaggaccacgacctggcgggcgaggaggtggccacctacagcatcgccgggcaggtcgacggcaaggtgccgcacacggccaacgccgcgaacatgctgttcaccgccttctccgggatccccagctactccagcttctccgtcttcaccggcaaccaggacggcaccgtgatctacagccccggcctcttccccaagctgaaccagtccagctgcgacaaggtggccctcccgctgatctgggaggggtacatcgacctgcccgggtactacgagacggtccacccctgcaacgtgttctgcgtgctctccggccccggggccagctgcgaggccttcagcgagggcggcatcttcaacatcacctccccgacctgcctggtcagcaagcagaaccgcttccgggcggccgagcagcagatcaacttcgtgtgccagcgcgtggaccaggacatcgtcatctactgcaacgggcagaagaagaccatcctgacgaagaccctcgtgatcggccagtgcatctactccgtgaccagcctgttctccatcatgcccggggtcgcccacagcatcgccatcgagctgtgcgtgcccggcttccacgggtgggccaccgcggccctcctgacgaccttctgcttcggctggatcctgatcccctccatcaccctcgccatcctgatcgtgctgaagttcttcgccgccctcctgcacaacagctcccaggagaaccggttcaagatcatcctgaagaagatcaaggaggagttcgagaagaccaagggcagcatggtctgcgaggtgtgcaagtacgagtgcgagacggggaaggagctcaaggcgcacaacctgtcctgcccgcagagccagtgcccctactgcttcacccactgcgagctgaccgagtccgccttccaggcccactaccgcgtgtgccaggccacccaccggttccgcgacgacctcaagaagaccatcacgccccagagcacctcccccggctgctaccggaccctgaacctgttccgctacaagagccggtgctacatcttcaccgtctgggtgatcctcctgatcatcgagtccatcctgtgggcggccagcgccagcgagacgatcctggagccgtcctggaacgacaacgcccacggggtgggcgtcgtgcccatgcacaccgacctcgagctggacttcagcctgccctccagctccaagtacacctacaagcgcaagctcaccagcccgatcaaccaggagcagtccgtggacctgcacatcgagatcgagagccaggggatctccacgagcgtccacgccctgggccactggttcgacggccggctcaacctgaagacctccttccactgctacggggcgtgcaccaagtacgagtacccctggcacaccgccaagtgccacttcgagcgcgacttcgagtacgagaacagctggtcctgcaaccccgccgactgccccggcatcgggacgggctgcaccgcctgcggcctgtacctcgaccagctgaagccggtggggagcgcctacaagctgatcaccgtgcgctactcccggaaggtctgcgtgcagttcggcgaggagaacctctgcaagaccatcgacatgaacgactgcttcgtgacgcgccacgtcaaggtgtgcatcatcgggaccgtgagcaagttctcccagggcgacaccctggtcttcctggggcccatggagggcggcgggctcatcttcaaggactggtgcaccacgacctgccagttcggcgaccccggggacatcatgagccccaaggacaagggcttctcctgcccggacttcaccgggcacttccggaagaagtgcaacttcgcgaccacgcccgtgtgcgagtacgacggcaacatggtgagcggctacaagaaggtcatggccaccatcgacagcttccaggccttcaacacctccaacatccactacaccgacgagcgcatcgagtgggaggaccccgacgggatgctgaaggaccacctgaacatcctcgtgacgaaggacatcgacttcgagaacctgggcgagaacccctgcaaggtggggctgcagaccgccagcatcgacggcgcctgggggtccggcgtcggcttcaccctgacctgccagatcagcctcacggagtgctcccggttcctgaccagcatcaaggcgtgcgacatggccatctgctacggggcccagtccgtgaccctcgtgcgcggccagaacaccgtcaaggtgagcgggaagggcgggcactccggcagctccttcaagtgctgccacggcacggactgcagccagcaggggctgcaggcctccgcgccgcacctggacaaggtgaacggcatcgtcgagcaggagagcacccaggtgtacgacgacggggcgccccagtgcggcatctcctgctggttcgtcaagagcggcgagtggatcaagggggtgttctccggcaactggatcgtgatcgtggtcctcatcttcctgttcctgctcagcctgatcctgctctccttcctgtgccccatccggaagcacaagcgcagctga

SEQ ID NO: 11670 - RNA, 3408 nt, synthetic construct
  misc_feature 1..3408: note = derived and/or modified CDS sequence (opt1) from DOBV(GER/08/131/Af)__GQ205413.1__GP
  source 1..3408: mol_type = other RNA
atgatcatgtggggcctgctcctgaccctgagcctcatcaacctgggggcctccctgcgcaacgtgtacgacatgaagatcgagtgcccccacagcatcaacttcggcgagtccagcgtcaccgggaaggtggagctcccgcccctgctgctcacggacgccgagaccctggtgcccgagtccagctgcaacatggacaaccaccagtccctgagcatcacccagaaggtcaccaaggtgtcctggcggaagaaggcggacaaggtgcaggccgccaaggacagcttcgagacgacctccagcgaggtcaacctcaaggggacctgcaccctgacgcaccgcatggtggaggagtcctaccggagccgcaagtccgtgatctgctacgacctgagctgcaactccacccactgcaagcccaccatgcacatgatcgtcccggtgcacagctgcaacatgatgaagtcctgcctcgtggggctgggcccctaccggatccaggtcgtgtacgagcgcacctactgcacgaccggcatcctgaccgaggggaagtgcttcgtgcccgaccagagcatcatcagcgtcatcaagaacggcgtgttcgacatcgcctccgtgagcatcgtctgcttcttcatccggatcaaggggacctcctacaagatcatgacgagcatcaaggagtccaaccccaacaactgcaacgacaccgacaacaaggtgcagggctactacctctgcatcgtgggggccaacagctccccggtctacgcgcccagcaccaccgacttccgctccgtggaggccctggccagcctgctccggtccccctacggcgaggaccacgacctggccggcgaggaggtggcgacgtacagcatcgccgggcaggtcgagggcaaggtgccccacaccgccaacgccgccaacatgctgttcaccgcgttctccgggatcccgagctactccagcttctccgtcttcaccggcaaccaggacggcaacgtgatctacagccccggcctcttccccaagctgaaccagtccagctgcgagaaggtggccctgcccctcatctgggagggctacatcgacctgccggggtactacgagacggtccacccctgcaacgtgttctgcgtgctgagcggccccggggcctcctgcgaggccttcagcgagggcggcatcttcaacatcacctccccgacctgcctcgtcagcaagcagaaccgcttccgggccgcggagcagcagatcaacttcgtgtgccagcgcgtggaccaggacatcgtcatctactgcaacgggcagaagaagaccatcctgacgaagaccctggtgatcggccagtgcatctactccgtgaccagcctcttctccatcatgcccggggtcgcccacagcatcgccatcgagctgtgcgtgcccggcttccacgggtgggccaccgccgcgctgctcacgaccttctgcttcggctggatcctgatcccctccatcaccctggccatcctcatcgtgctgaagttcttcgccgccctgctccacaacagctcccaggagaaccggttcaagatcatcctgaagaagatcaaggaggagttcgagaagaccaagggcagcatggtctgcgaggtgtgcaagtacgagtgcgagacggggaaggagctgaaggcccacaacctctcctgcccccagagccagtgcccgtactgcttcacccactgcgagctgaccgagtccgcgttccaggcccactaccgcgtgtgccaggccacccaccggttccgcgacgacctgaagaagaccatcacgccccagagcacctcccccggctgctaccggaccctcaacctgttccgctacaagagccggtgctacatcttcaccgtctgggtgatcctgctgatcatcgagagcatcctctgggccgcgtccgccagcgagatcgtgctggagccctcctggaacgacaacgcccacggggtcggcgtggtgccgatgcacacggacctggagctcgacttcagcctgccctccagctccaagtacacctacaagcgcaagctgaccagccccatcaaccaggagcagtccgtcgacctccacatcgagatcgagagccaggggatctccaccagcgtgcacgccctgggccactggttcgacggccggctgaacctcaagacgtccttccactgctacggggcctgcaccaagtacgagtacccgtggcacaccgcgaagtgccacttcgagcgcgacttcgagtacgagaacagctggtcctgcaaccccgccgactgccccggcatcgggaccggctgcacggcctgcggcctgtacctggaccagctcaagcccgtggggagcgcctacaagctgatcaccgtccgctactcccggaaggtgtgcgtgcagttcggcgaggagaacctgtgcaagaccatcgacatgaacgactgcttcgtcacccgccacgtgaaggtgtgcatcatcgggacggtcagcaagttctcccagggcgacaccctcgtgttcctggggccgatggagggcggcgggctgatcttcaaggactggtgcaccaccacgtgccagttcggcgaccccggggacatcatgagccccaaggacaagggcttcagctgccccgacttcaccgggcacttccggaagaagtgcaacttcgccaccaccccggtgtgcgagtacgacggcaacatggtctccggctacaagaaggtgatggcgacgatcgacagcttccaggccttcaacacctccaacatccactacaccgacgagcgcatcgagtggaaggacaccgacgggatgctcaaggaccacctgaacatcctggtgacgaaggacatcgacttcgagaacctcggcgagaacccctgcaaggtcgggctgcagaccgccagcatcgacggcgcctgggggtccggcgtgggcttcaccctgacctgccagatcagcctcacggagtgctcccggttcctgaccagcatcaaggcctgcgacatggcgatctgctacggggcccagtccgtgaccctggtccgcggccagaacaccgtgcgggtgagcgggaagggcgggcactccggcagctccttcaagtgctgccacggcacggactgcagccaccaggggctccaggcctccgccccgcacctggacaaggtcaacggcatcgtggagcaggagagcacccaggtgtacgacgacggggcgccccagtgcggcatctcctgctggttcgtcaagagcggcgagtggatcaaggggatcttctccggcaactggatcgtgatcgtggtcctgatcttcctcttcctgctgagcctcatcctgctgagcttcctctgccccatccgcaagcacaagcggtcctga

SEQ ID NO: 11671 - RNA, 3408 nt, synthetic construct
  misc_feature 1..3408: note = derived and/or modified CDS sequence (opt1) from DOBV(GRW/Aa)__JQ026205.1__GP
  source 1..3408: mol_type = other RNA
atgatcatgtggggcctgctcctgaccctgagcctcatcaacctgggggcctccctgcgcaacgtgtacgacatgaagatcgagtgcccccacagcatcaacttcggcgagtccagcgtcaccgggaagggcgagctcccgcccctgctgctcacggacgccgagaccctggtgcccgagtccagctgcaacatggacaaccaccagtccctgagcatcacccagaaggtgaccaaggtctcctggcggaagaaggcggacaaggtgcaggccgccaaggacagcttcgagacgacctccagcgaggtgaacctcaaggggacctgcaccctgacgcaccgcatggtcgaggagtcctaccggagccgcaagtccgtgatctgctacgacctgagctgcaactccacccactgcaagcccaccatgcacatgatcgtgccggtccacagctgcaacatgatgaagtcctgcctcgtgggcctgggcccctaccggatccaggtggtctacgagcgcacctactgcacgaccgggatcctgaccgagggcaagtgcttcgtgcccgaccagagcatcatcagcgtgatcaagaacggggtcttcgacatcgcctccgtgagcatcgtgtgcttcttcatccggatcaagggcacctcctacaagatcatgacgagcatcaaggagtccaaccccaacaactgcaacgacaccgacaacaaggtccaggggtactacctctgcatcgtgggcgccaacagctccccggtgtacgcgcccagcaccaccgacttccgctccgtcgaggccctggccagcctgctccggtccccctacggcgaggaccacgacctggccggggaggaggtggcgacgtacagcatcgccggccaggtggaggggaaggtcccccacaccgccaacgccgccaacatgctgttcaccgcgttctccggcatcccgagctactccagcttctccgtgttcaccggcaaccaggacgggaacgtcatctacagccccggcctcttccccaagctgaaccagtccagctgcgagaaggtggccctgcccctcatctgggaggggtacatcgacctgccgggctactacgagacggtgcacccctgcaacgtcttctgcgtgagctccgggcccggcgccagctgcgaggccttctccgagggcgggatcttcaacatcaccagccccacgtgcctggtgtccaagcagaaccgcttccgggccgcggagcagcagatcaacttcgtctgccagcgcgtggaccaggacatcgtgatctactgcaacggccagaagaagaccatcctcacgaagaccctggtcatcgggcagtgcatctacagcgtgacctccctgttcagcatcatgccgggcgtggcccactccatcgccatcgagctctgcgtccccgggttccacggctgggccaccgccgcgctgctgacgaccttctgcttcggctggatcctcatccccagcatcaccctggccatcctgatcgtgctcaagttcttcgccgccctgctgcacaactccagccaggagaaccggttcaagatcatcctcaagaagatcaaggaggagttcgagaagaccaaggggtccatggtgtgcgaggtctgcaagtacgagtgcgagacgggcaaggagctgaaggcccacaacctgagctgcccccagtcccagtgcccgtactgcttcacccactgcgagctcaccgagagcgcgttccaggcccactaccgcgtgtgccaggccacccaccggttccgcgacgacctgaagaagaccatcacgccccagtccaccagccccgggtgctaccggaccctgaacctcttccgctacaagagccggtgctacatcttcaccgtgtgggtcatcctgctgatcatcgagtccatcctgtgggccgcgagcgcctccgagatcgtgctcgagcccagctggaacgacaacgcccacggcgtgggggtcgtgccgatgcacacggacctggagctggacttctccctccccagctccagcaagtacacctacaagcgcaagctgacctcccccatcaaccaggagcagagcgtggacctgcacatcgagatcgagtcccagggcatcagcacctccgtccacgccctcggccactggttcgacgggcggctgaacctgaagacgagcttccactgctacggcgcctgcaccaagtacgagtacccgtggcacaccgcgaagtgccacttcgagcgcgacttcgagtacgagaactcctggagctgcaaccccgccgactgccccgggatcggcaccggctgcacggcctgcgggctctacctggaccagctgaagcccgtgggctccgcctacaagctcatcaccgtgcgctacagccggaaggtctgcgtgcagttcggggaggagaacctgtgcaagaccatcgacatgaacgactgcttcgtgacccgccacgtcaaggtgtgcatcatcggcacggtgtccaagttcagccagggggacaccctggtcttcctcggcccgatggagggcgggggcctgatcttcaaggactggtgcaccaccacgtgccagttcggggaccccggcgacatcatgagccccaaggacaaggggttctcctgccccgacttcaccggccacttccggaagaagtgcaacttcgccaccaccccggtgtgcgagtacgacggcaacatggtgagcgggtacaagaaggtcatggcgacgatcgactccttccaggccttcaacaccagcaacatccactacaccgacgagcgcatcgagtggaaggaccccgacggcatgctgaaggaccacctcaacatcctggtgaccaaggacatcgacttcgagaacctgggggagaacccctgcaaggtgggcctccagacggcctccatcgacggggcctggggcagcggcgtcgggttcaccctgacctgccagatctccctgaccgagtgcagccggttcctcacgtccatcaaggcctgcgacatggcgatctgctacggcgcccagagcgtgaccctggtgcgcgggcagaacaccgtccgggtgtccggcaagggcgggcacagcggctccagcttcaagtgctgccacgggaccgactgctcccaccagggcctgcaggccagcgcgccccacctcgacaaggtgaacgggatcgtcgagcaggagtccacccaggtgtacgacgacggcgccccgcagtgcggcatcagctgctggttcatcaagtccggggagtggatcaagggcatcttcagcgggaactggatcgtgatcgtcgtgctgatcttcctgttcctcctgagcctgatcctcctgtccttcctgtgccccatccgcaagcacaagcggagctga

SEQ ID NO: 11672 - RNA, 3408 nt, synthetic construct
  misc_feature 1..3408: note = derived and/or modified CDS sequence (opt1) from DOBV(Slo/Af-BER)__GU904035.1__GP
  source 1..3408: mol_type = other RNA
atgatcatgtggggcctgctcctgaccatgatcctgatcgacttcggggccagcctccgcaacgtgtacgacatgaagatcgagtgcccccactccatcaacttcggcgagagctccgtcaccgggaaggtggagctgccgcccctgctcctgacggacgccgaggccctggtgcccgagagctcctgcaacatggacaaccaccagagcatgtccatcatccagaaggtcaccaaggtgagctggcggaagaaggccgacaaggcccaggccgccaaggactccttcgagaccaccagctccgaggtgaacctcaagggcacgtgcaccctgagccaccgcatggtcgaggagtcctaccggaaccgccggagcgtgatctgctacgacctgtcctgcaacagcacccactgcaagcccaccatgcacatgatcgtgccggtccactcctgcaacatgatgaagtcctgcctcgtggggctgggcccctaccgcatccaggtggtctacgagcggacgtactgcaccaccggcatcctgaccgaggggaagtgcttcgtgcccgaccagagcatcgtgagcgtcatcaagaacggcgtgttcgacatcgcgagcgtgtccatcgtctgcttcttcatccgcgtgaaggggacgaactacaagatcatggccagcatcaagaccgccaccgccaacaactgcaacgacaccgacaacaaggtgcagggctactacctctgcatcgtcgggggcaactccagccccgtgtacgcgccgtccacgaccgacttccggagcatggaggccctggcctccctgctccgcgcgccccacggcgaggaccacgacctgagcggggaggaggtggccacctactccatcgccggccagatcgaggggaagatcccccacaccgccaacgccgccaacatgctgttcacggccttcagcggcatcccctcctacagctccctcagcgtcttcatcggctcccaggacgggccgatcatctacagccccggcctgttccccaagctgaaccagtccagctgcgacaaggtggcgctccccctgatctgggaggggtacatcgacctgccgggctactacgagaccgtccacccctgcaacgtgttctgcgtgctctccgggcccggcgccagctgcgaggccttcagcgagggcgggatcttcaacatcacctccccgacctgcctggtcagcaagcagaaccggttccgcgccgccgagcagcaggtcaacttcgtgtgccagcgggtggaccaggacatcatcatctactgcaacggccagaagaagacgatcctgaccaagaccctcgtgatcgggcagtgcatctactccgtgaccagcctgttctccatcatgcccggcgtcgcgcacagcatcgccatcgagctgtgcgtgcccgggttccacggctgggccacggccgccctcctgaccaccttctgcttcggctggatcctgatcccctccatcaccctcgcggtgctggtcgtgctgaagttcttcgccgccatcctccacaacagctcccaggagaaccgcttcaagatcatcctgcggaagatcaaggaggagttcgagaagacgaaggggagcatggtgtgcgaggtctgcaagtacgagtgcgagaccggcaaggagctgaaggcccacaacctctcctgcccccagagccagtgcccgtactgcttcacccactgcgagcccaccgagtccgcgttccaggcccactacaaggtgtgccaggccacgcaccgcttccgggacgacctgaagaagaccatcacgccccagagcacctcccccgggtgctaccgcaccctgaacctcttccggtacaagagccgctgctacatcttcaccgtgtgggtcaccctgctgatcatcgagtccatcatgtgggccgccagcgcgagcgagaacgtgctcgagccgtcctggaacgacaacgcccacggcgtgggggtcgtgcccatgcacaccgacctggagctggacttcagcctgccctccagctccaagtacacctacaagcggaagctcacgagcccgctgaaccaggagcagtccgtggacctgcacatcgagatcgagagccagggcatctccaccagcgtccacgccctcggccactggttcgacgggcgcctgaacctgaagacctccttccactgctacggcgcctgcaccaagtacgagtacccctggcacacggccaagtgccacttcgagcgcgacttcgagtacgagaacagctgggggtgcaaccccgcggactgccccggcatcggcaccgggtgcaccgcctgcggcctctacatcgaccagctgaagccggtggggtccgcctacaagctgatcaccgtgcggtacagccgcaaggtctgcgtgcagttcggcgaggagaacctctgcaagacgatcgacatgaacgactgcttcgtgacccggcacgtcaaggtgtgcatcatcgggaccgtgtccaagttcagccagggcgacaccctggtcttcctgggccccatggagggcggcgggctcatcttcaaggactggtgcacgtccacgtgccagttcggggaccccggggacatcatgagccccaaggacaagggcttctcctgcccggacttcaccggccacttccgcaagaagtgcaacttcgccaccacccccgtgtgcgagtacgacgggaacatggtgagcggctacaagaaggtcatggccaccatcgacagcttccagtccttcaacaccagctccatccactacaccgacgagcggatcgagtggaaggaccccgacgggatgctgaaggaccacctgaacatcctcgtgacgaaggacatcgacttcgagaacctgggcgagaacccctgcaaggtggggctgcagaccagctccatcgagggcgcgtggggcagcggggtcggcttcaccctgacctgccagatctccctcacggagtgcagccgcttcctgacctccatcaaggcctgcgacatggccatctgctacggggcccagagcgtgaccctcatccggggccagaacaccgtgaaggtctccgggaagggcggccacagcgggtccagcttcaagtgctgccacggcacggactgctcccagcaggggctgcaggcgagcgccccgcacctggacaaggtgaacggcatcgtggagcaggactccgagaaggtctacgacgacggcgcgccccagtgcgggatcagctgctggttcgtgaagtccggcgagtggatcaccgggatcttcaacggcaactggatcgtgatcgtcgtgctcgtgttcttcttcatcctgagcctgatcctcctgagcctgctctgccccatccgcaagcacaagcggtcctga

SEQ ID NO: 11673 - RNA, 3408 nt, synthetic construct
  misc_feature 1..3408: note = derived and/or modified CDS sequence (opt1) from HTNV(76-118/POR)__KT885048.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcgggggcaacagcgtgatcgggtacgtggagctcccgcccgtccccctggccgacacggcgcagatggtgcccgagtccagctgctccatggacaaccaccagagcctgaacaccatcaccaagtacacccaggtgtcctggcggggcaaggccgaccagagccagtccagccagaactccttcgagacggtcagcaccgaggtggacctcaaggggacctgcgtgctgaagcacaagatggtcgaggagtcctaccgcagccggaagtccgtgacctgctacgacctgagctgcaactccacgtactgcaagcccaccctctacatgatcgtgcccatccacgcctgcaacatgatgaagtcctgcctgatcgccctgggcccctaccgcgtccaggtggtgtacgagcggacctactgcatgaccggcgtcctcatcgaggggaagtgcttcgtgccggaccagtccgtggtcagcatcatcaagcacggcatcttcgacatcgccagcgtgcacatcgtgtgcttcttcgtcgcggtgaaggggaacacgtacaagatcttcgagcaggtcaagaagtccttcgagagcacgtgcaacgacaccgagaacaaggtgcagggctactacatctgcatcgtcgggggcaactccgcccccatctacgtgcccaccctggacgacttccgcagcatggaggccttcaccggcatcttccggagcccccacggggaggaccacgacctggccggcgaggagatcgcgagctactccatcgtggggccggccaacgccaaggtgccccacagcgcctccagcgacaccctccgcctgatcgcctactccggcatccccagctactccagcctgtccatcctcaccagctccaccgaggcgaagcacgtcttcagccccggcctgttcccgaagctgaaccacacgaactgcgacaagtccgccatccccctcatctggaccgggatgatcgacctgcccggctactacgaggccgtgcacccctgcaccgtgttctgcgtcctgagcgggccgggcgccagctgcgaggccttctccgagggcgggatcttcaacatcaccagctccatgtgcctcgtgagcaagcagaaccggttccgcctgacggagcagcaggtcaacttcgtgtgccagcgggtggacatggacatcgtggtctactgcaacggccagcgcaaggtgatcctgaccaagaccctcgtgatcgggcagtgcatctacaccatcacgtccctgttcagcctgctccccggcgtcgcgcactccatcgccgtggagctgtgcgtgcccgggttccacggctgggccaccgccgccctgctcgtcaccttctgcttcgggtgggtgctgatccccgcgatcaccttcatcatcctgacggtgctcaagttcatcgccaacatcttccacaccagcaaccaggagaaccggctgaagtccgtcctgcgcaagatcaaggaggagttcgagaagaccaagggcagcatggtgtgcgacgtgtgcaagtacgagtgcgagacctacaaggagctcaaggcccacggcgtctcctgcccgcagagccagtgcccctactgcttcacgcactgcgagcccaccgaggccgccttccaggcgcactacaaggtgtgccaggtgacccaccggttccgcgacgacctgaagaagaccgtcacgccccagaacttcaccccggggtgctaccggaccctgaacctcttccgctacaagtcccggtgctacatcttcaccatgtggatcttcctgctggtgctcgagagcatcctgtgggccgcctccgccagcgagacgcccctgacccccgtgtggaacgacaacgcgcacggcgtcgggtccgtgccgatgcacaccgacctcgagctggacttcagcctgaccagctccagcaagtacacctaccgccggaagctgacgaaccccctcgaggaggcccagtccatcgacctgcacatcgagatcgaggagcagaccatcggcgtggacgtccacgccctggggcactggttcgacggccgcctcaacctgaagaccagcttccactgctacggcgcctgcaccaagtacgagtacccctggcacacggccaagtgccactacgagcgcgactaccagtacgagacctcctgggggtgcaaccccagcgactgcccgggcgtggggaccggctgcaccgcgtgcggcctgtacctcgaccagctgaagcccgtggggtccgcctacaagatcatcacgatccggtacagccgccgggtctgcgtgcagttcggcgaggagaacctgtgcaagatcatcgacatgaacgactgcttcgtgtcccgccacgtcaaggtgtgcatcatcgggaccgtgagcaagttctcccagggcgacaccctcctgttcttcgggcccctggagggcggcgggctcatcttcaagcactggtgcaccagcacgtgccagttcggcgaccccggggacatcatgtccccgcgggacaagggcttcctgtgccccgagttccccgggagcttccgcaagaagtgcaacttcgccaccacccccatctgcgagtacgacggcaacatggtctccggctacaagaaggtgatggccaccatcgacagcttccagtccttcaacacgagcaccatgcacttcaccgacgagcggatcgagtggaaggacccggacgggatgctgcgcgaccacatcaacatcctcgtgaccaaggacatcgacttcgacaacctgggcgagaacccctgcaagatcgggctgcagacgtccagcatcgagggcgcctgggggagcggcgtcggcttcaccctgacctgcctcgtgtccctgaccgagtgccccacgttcctcaccagcatcaaggcgtgcgacaaggccatctgctacggggccgagtccgtgaccctgacccggggccagaacacggtcaaggtgagcgggaagggcgggcactccggcagcaccttcaagtgctgccacggcgaggactgctcccagatcgggctgcacgccgccgcgccccacctcgacaaggtcaacggcatcagcgagatcgagaactccaaggtgtacgacgacggggccccgcagtgcggcatcaagtgctggttcgtcaagagcggcgagtggatctccgggatcttcagcggcaactggatcgtgctgatcgtgctgtgcgtgttcctcctgttctccctggtcctcctgagcatcctgtgccccgtgcgcaagcacaagaagtcctga

SEQ ID NO: 11674 - RNA, 3408 nt, synthetic construct
  misc_feature 1..3408: note = derived and/or modified CDS sequence (opt1) from HTNV(76-118)__Y00386.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcgggggcaacagcgtgatcgggtacgtggagctcccgcccgtccccctggccgacacggcccagatggtgcccgagtccagctgctccatggacaaccaccagagcctgaacaccatcaccaagtacacccaggtgtcctggcggggcaaggccgaccagagccagtccagccagaactccttcgagacggtcagcaccgaggtggacctcaaggggacctgcgtgctgaagcacaagatggtcgaggagtcctaccgcagccggaagtccgtgacctgctacgacctgagctgcaactccacgtactgcaagcccaccctctacatgatcgtgcccatccacgcctgcaacatgatgaagtcctgcctgatcgccctgggcccctaccgcgtccaggtggtgtacgagcggacctactgcatgaccggcgtcctcatcgaggggaagtgcttcgtgccggaccagtccgtggtcagcatcatcaagcacggcatcttcgacatcgccagcgtgcacatcgtgtgcttcttcgtcgcggtgaaggggaacacgtacaagatcttcgagcaggtcaagaagtccttcgagagcacgtgcaacgacaccgagaacaaggtgcagggctactacatctgcatcgtcgggggcaactccgcccccatctacgtgcccaccctggacgacttccgcagcatggaggccttcaccggcatcttccggagcccccacggggaggaccacgacctggccggcgaggagatcgcgagctactccatcgtggggccggccaacgccaaggtgccccacagcgcctccagcgacaccctctccctgatcgcctacagcggcatcccctcctacagctccctgagcatcctcacctccagcaccgaggcgaagcacgtcttctcccccggcctgttcccgaagctgaaccacacgaactgcgacaagagcgccatccccctcatctggaccgggatgatcgacctgcccggctactacgaggccgtgcacccctgcaccgtgttctgcgtcctgagcgggccgggcgcctcctgcgaggccttcagcgagggcgggatcttcaacatcacctcccccatgtgcctcgtgagcaagcagaaccgcttccggctgacggagcagcaggtcaacttcgtgtgccagcgcgtggacatggacatcgtggtctactgcaacggccagcggaaggtgatcctgaccaagaccctcgtgatcgggcagtgcatctacaccatcacgtccctgttcagcctgctccccggcgtcgcgcactccatcgccgtggagctgtgcgtgcccgggttccacggctgggccaccgccgccctgctcgtcaccttctgcttcgggtgggtgctgatcccggcgatcaccttcatcatcctgacggtgctcaagttcatcgccaacatcttccacaccagcaaccaggagaaccgcctgaagtccgtcctgcggaagatcaaggaggagttcgagaagaccaagggcagcatggtgtgcgacgtgtgcaagtacgagtgcgagacctacaaggagctcaaggcccacggcgtctcctgcccccagagccagtgcccctactgcttcacgcactgcgagcccaccgaggccgccttccaggcgcactacaaggtgtgccaggtgacccaccgcttccgggacgacctgaagaagaccgtcaccccgcagaacttcacgcccgggtgctaccgcaccctgaacctcttccggtacaagtcccgctgctacatcttcaccatgtggatcttcctgctggtgctcgagagcatcctgtgggccgcctccgccagcgagacgcccctgaccccggtgtggaacgacaacgcgcacggcgtcgggtccgtgcccatgcacaccgacctcgagctggacttcagcctgaccagctccagcaagtacacctaccggcgcaagctgacgaaccccctcgaggaggcccagtccatcgacctgcacatcgagatcgaggagcagaccatcggcgtggacgtccacgccctggggcactggttcgacggccggctcaacctgaagaccagcttccactgctacggcgcctgcaccaagtacgagtacccctggcacacggccaagtgccactacgagcgcgactaccagtacgagacctcctgggggtgcaacccgagcgactgccccggcgtggggaccggctgcaccgcgtgcggcctgtacctcgaccagctgaagcccgtggggtccgcctacaagatcatcacgatccgctacagccggcgcgtctgcgtgcagttcggcgaggagaacctgtgcaagatcatcgacatgaacgactgcttcgtgtcccggcacgtcaaggtgtgcatcatcgggaccgtgagcaagttctcccagggcgacaccctcctgttcttcgggcccctggagggcggcgggctcatcttcaagcactggtgcaccagcacgtgccagttcggcgacccgggggacatcatgagcccccgcgacaagggcttcctgtgccccgagttccccgggagcttccggaagaagtgcaacttcgccaccaccccgatctgcgagtacgacggcaacatggtctccggctacaagaaggtgatggccaccatcgacagcttccagtccttcaacacgagcaccatgcacttcaccgacgagcgcatcgagtggaaggaccccgacgggatgctgcgggaccacatcaacatcctcgtgaccaaggacatcgacttcgacaacctgggcgagaacccctgcaagatcgggctgcagacgtccagcatcgagggcgcctgggggagcggcgtcggcttcaccctgacctgcctcgtgtccctgaccgagtgccccacgttcctcaccagcatcaaggcgtgcgacaaggccatctgctacggggccgagtccgtgaccctgacccgcggccagaacacggtcaaggtgagcgggaagggcgggcactccggcagcaccttccggtgctgccacggcgaggactgctcccagatcgggctgcacgccgccgcgccgcacctcgacaaggtcaacggcatcagcgagatcgagaactccaaggtgtacgacgacggggcgccccagtgcggcatcaagtgctggttcgtgaagtccggcgagtggatctccgggatcttcagcggcaactggatcgtcctgatcgtgctgtgcgtgttcctcctgttctccctggtcctcctgagcatcctgtgccccgtgcgcaagcacaagaagtcctga

SEQ ID NO: 11675 - RNA, 3408 nt, synthetic construct
  misc_feature 1..3408: note = derived and/or modified CDS sequence (opt1) from HTNV(A16)__AF288645.1__GP
  source 1..3408: mol_type = other RNA
atgggcctgtggaagtggctcatcatggccgtgctggtctggccctgcttcgccctgcgcaacgtgtacgacatgaagatcgagtgcccgcacaccgtgaacttcggggagaacagcgtcgtgggctacgtggagctcccgcccatgcccatcgccgacatcacccagatgatgcccgagtccagctgctccatggacaaccaccagagcctgaacacgatcaccaagtacacccaggtctcctggcggaagaaggccgaccaggcccagagctcccagaccagcttcgagacggtgtccagcgaggtggacttcaaggggacctgcgtcctgaagcacaagatgatcgaggactcctaccgcagccggcgctccatcatctgctacgacctcagctgcaactccaccttctgcaagcccaccctgtacctgatcgtgcccgtgcacgcctgcaacatgatgaagtcctgcctcatcgccctgggcccctaccgggtccaggtggtgtacgagcgcacgtactgcatgtccggggtcctgctcgagggcaagtgcttcgtgccggaccagagcgtggtctccatcatcaagcacggcatcttcgacatcgcgagcgtgcacatcgtgtgcttcttcgtcgccatcaaggggagcacctacaagatcctggagcaggtcaagaagtccttcgagctgacctgcaacgacaccgacaacaagatccagggctactacatctgcctcgtcgggggcaacagcgcccccatctacgtgcccacgctggacgacttccggtccatggaggccttcgcggggatcttcaagagcccccacggcgaggaccacgacctggccggcgaggaggtggcctcctacagcatcgtggggccggccaacgccaaggtgccccactccgcgagcgccgacaccctcggcctggtggccttctccgggatccccagctactccagcttctccgtcctgaccggcagcaccgacgcccgccacgtgttctcccccggcttcttcccgcagctcaaccagacgcggtgcgacaagaccgccatccccctgacctggaccgggatgatcgacctgcccggctactacgaggcggtgcacccctgcacggtcttctgcgtgctcagcgggccgggcgcctcctgcgaggccttcagcgagggcgggatcttcaacatcacctcccccatgtgcctggtgagcaagcagaaccgcttccggagctccaagcagcaggtcaacttcgtgtgccagcgcgtggacatggacatcgtcgtgtactgcaacggccagaagaaggtgatcctgaccaagaccctcgtcatcgggcagtgcatctacacgatcaccagcctgttctccctgctccccggcgtggcccacagcatcgccgtggagctgtgcgtccccgggttccacggctgggcgaccgccgccctgctcgtgaccttctgcttcgggtgggtgctgatcccggccgtcacgctggtgatcctcaccatcctgaagttcatcgccaacatcttccacacctccaaccaggagaaccggctcaagagcgtgctcaagaagatcaaggaggagttcgagaagaccaagggctccatggtctgcgacgtgtgcaagtacgagtgcgagacgtacaaggagctgaaggcgcacggcgtgagctgcccccagtcccagtgcccctactgcttcacccactgcgagcccaccgaggccgccttccaggcccactacaaggtctgccaggtgacccaccgcttccgggacgacctgaagaagacggtgaccccgcagaacttcacccccgggtgctaccgcaccctcaacctgttccggtacaagagccgctgctacatcttcaccatgtgggtcttcctgctcatcctggagtccatcctgtgggcggccagcgcctccgagacgcccctcaccccgatctggaacgacaacgcccacggcgtggggagcatccccatgcacaccgacctggagctggacttctccctgaccagctccagcaagtacacgtaccggcgcaagctcaccaaccccctggaggagacccaggccgtggacctgcacatcgagctcgcggagcagaccatcggcgtcgacgtgcacgccctggggcactggttcgacggccggctgaacctcaagacgagcttccactgctacggcgcctgcaccaagtacgagtacccctggcacaccgccaagtgccactacgagcgcgactaccagtacgagacctcctgggggtgcaacccgagcgactgccccggcgtggggacgggctgcaccgcctgcggcctgtacctggaccagctcaagcccgtcgggtccgcgtacaagatcatcaccatccgctacagccggcgcgtgtgcgtgcagttcggcgaggagaacctgtgcaaggtcatcgacatgaacgactgcttcgtgtcccggcacgtgaaggtctgcatcatcgggaccgtgagcaagttctcccagggcgacacgctgctgttcttcgggcccctggagggcggcgggctgatcttcaagcactggtgcaccagcacgtgccagttcggcgacccgggggacatcatgagcccccgcgacaagggcttcctctgccccgagttccccgggagcttccggaagaagtgcaacttcgccaccaccccgctgtgcgagtacgacggcaacatgatctccggctacaagaaggtgatggccaccatcgacagcttccagtccttcaacaccagcaccatgcacttcacggacgagcgcatcgagtggaaggaccccgacgggatgctgcgggaccacatcaacatcctcgtcaccaaggacatcgacttcgacaacctgggcgagaacccctgcaagatcgggctgcagacctccagcatcgagggcgcctgggggtccggcgtgggcttcaccctcacgtgcctggtgagcctgaccgagtgccccaccttcctcacctccatcaaggcctgcgacaaggcgatctgctacggggccgagagcgtcacgctgacccgcggccagaacaccgtgaaggtgagcgggaagggcgggcactccggcagcaccttcaagtgctgccacggcgaggactgctcccagacggggctgcacgccgccgcgccgcacctcgacaaggtcaacggcatcagcgagatcgagaactccaaggtgtacgacgacggggcgccccagtgcggcatcaagtgctggttcgtcaagagcggcgagtggatctccgggatcttcagcggcaactggatcgtgctgatcgtgctgtgcgtcttcctcctgttctccctggtgctcctgagcgtgctgtgccccgtccggaagcacaagaagtcctga

SEQ ID NO: 11676 - RNA, 3408 nt, synthetic construct
  misc_feature 1..3408: note = derived and/or modified CDS sequence (opt1) from HTNV(A9)__AF035831.1__GP
  source 1..3408: mol_type = other RNA
atgggcatctggaagtggctggtgatggccagcctcgtctggcccgcctacaccctgcgcaacgcgtacgacatgaagatcgagtgcccgcacaccgtgtccttcggggagaacagcgtgatcggctacgtcgagctgccccccatccccctcgccgacacgacccagatggtgccggagtccagctgctccatggacaaccaccagagcctgaacaccatcaccaagtacacgcaggtgtcctggcgggggaaggccgaccacgcccaggccagccagaactccttcgaggcggtcagcgccgaggtggacctgaagggcacctgcgtgctcaagcacaagatgctggaggagtcctaccgcagccggaagtccatcgcctgctacgacctgagctgcaactccacctactgcaagcccaccctctacatgatcgtccccatccacgcctgcaacatgatgaagagctgcctgatcgcgctggggccccaccgcgtgcaggtggtctacgagcggacgtactgcatgaccggcgtgctcatcgagggcaagtgcttcgtgccggaccagtccgtcgtgagcatcatcaagcacgggatcttcgacatcgcctccgtgcacatcgtctgcttcttcgtggccgtgaagggcaacacctacaagatcttcgagcagatcaagaagagcttcgagagcacctgcaacgacacgaagaacaaggtccaggggtactacatctgcatcgtgggcgggaactccgcccccatctacgtgcccaccctggacgacttccgcagcatggaggccttctccggcatcttccggagcccccacggcgaggaccacgacctggcgggggaggagatcgcctcctacagcatcgtcggcccggccaacgccaaggtgccccactccgccagctccgacaccctcagcctgaccgcgtactccgggatccccagctactccagcctgtccatcctcgccggcagcgccgaggccaagcacgtcttctcccccggcttcttcccgcagctgaaccacacgaagtgcgacaagaccgccatccccctgatgtggaccgggatgatcgacctccccggctactacgaggcgatccacccctgcaccgtgttctgcgtgctgagcgggccgggcgcctcctgcgaggccttcagcgaggggggcatcttcaacatcacgagccccatgtgcctggtctccaagcagaaccgcttccggctcaccgagcagcaggtgaacttcgtgtgccagcgcgtcgacatggacatcatcgtgtactgcaacggccagcggaaggtgatcctgaccaagaccctggtcatcgggcagtgcatctacacgatcaccagcctcttctccctgctgcccggcgtggcccacagcatcgccgtggagctctgcgtccccgggttccacggctgggcgaccgccgccctgctggtgaccttctgcttcgggtgggtgctcatcccggccatgacgttcatcgtcctgaccatcctgaagttcatcgcgaacatcttccacacctccaaccaggagaacaagctcaagagcgtgctgcgcaagatcaaggaggagttcgagaagaccaagggctccatggtgtgcgacgtctgcaagtacgagtgcgagacgtacaaggagctgaaggcccacggcgtgagctgcccccagtcccagtgcccctactgcttcacccactgcgagcccaccgaggccgccttccaggcccactaccgggtgtgccaggtcacccaccgcttccgggacgacctcaagaagacggtgaccccgcagaacttcacccccgggtgctaccgcaccctgaacctgttccggtacaagagccgctgctacatcttcaccatgtgggtgttcctcctggtcctggagtccatcctctgggcggccagcgcctccgagatccccctgaacccggtgtggaacgacaacgcccacggcgtggggagcgtccccatgcccacggacctggagctcgacttctccctgaccagctccagcaagtacacctaccggcgcaagctgaccaaccccctggaggagagccaggccatcaacctccacatcgagatcgaggagcagacgatcggcgtggacgtgcacgcgctggggcactggttcgacggccggctgaacctcaagacctccttccactgctacggcgcctgcaccaagtacgagtacccgtggcacaccgccaagtgccactacgagcgcgactaccagtacgagacgagctgggggtgcaacccctccgactgccccggcgtcgggaccggctgcaccgcctgcggcctgtacctggaccagctccgcgccgtggggagcgcgtacaagatcatcaccatccggtactcccgccgggtgtgcgtccagttcggcgaggagaacctgtgcaagatcatcgacatgaacgactgcttcgtgagccgccacgtgaaggtctgcatcatcgggacggtgtccaagttcagccagggcgacaccctgctcttcttcgggcccctggagggcggcgggctgatcttcaagcactggtgcacctccacctgccagttcggcgacccgggggacatcatgagcccccgggacaagggcttcctctgccccgagttccccgggtccagccgcaagaagtgcaacttcgccacgaccccgctgtgcgagtacgacggcaacatggtgtccggctacaagaaggtcatggccaccatcgacagcttccagtccttcaacaccagcacgatgcacttcaccgacgagcggatcgagtggaaggaccccgacgggatgctgcgcgaccacatcaacatcctcgtgaccaaggacatcgacttcgagaacctgggcgggaacccctgcaagatcggcctgcagacctccagcatcgagggggcctggggctccggcgtggggttcacgctcacctgcctggtcagcctgaccgagtgccccaccttcctcacgagcatcaaggcgtgcgacaaggccatctgctacggcgccgagtccgtgaccctgacccgggggcagaacaccgtgaaggtcagcggcaaggggggccactccggcagcacgttcaagtgctgccacggggaggagtgctcccagatcggcctgcacgccgccgcgccgcacctcgacaaggtgaacgggatcagcgagatcgagaacaacaaggtgtacgacgacggcgccccccagtgcggcatcaagtgctggttcgtcaagtccggggagtggatcagcggcatcttctccgggaactggatcgtgctgatcgtgctgtgcgtcttcctcctgttcagcctgatcctcctgtccatcctgtgccccgtgcgcaagcacaagaagagctga

SEQ ID NO: 11677 - RNA, 3408 nt, synthetic construct
  misc_feature 1..3408: note = derived and/or modified CDS sequence (opt1) from HTNV(84FLi)__AF345636.2__GP
  source 1..3408: mol_type = other RNA
atgggcgtgtggaagtggctggtcatggccagcctcgtgtggcccgcctgcaccctgcgcaacgtgtacgacatgaagatcgagtgcccgcacaccgtctccttcggggagaacagcgtgatcggctacgtggagctgccgcccatgcccctcgccgacacgacccagctggtccccgagtccagctgctccatggacaaccaccagagcctgaacaccatcaccaagtacacccaggtgtcctggcggaagaaggccgaccaggcccagagctcccagaacagcttcgagaccgtgtccgtcgaggtggacctcaaggggacctgcgtgctgaagcacaagatgatcgaggagagctaccgctcccgcaagagcatcacgtgctacgacctgtcctgcaacagcacgtactgcaagcccaccctctacatgatcgtccccatccacgcctgcaacatgatgaagtcctgcctgatcgccctgggcccctaccgggtccaggtggtgtacgagcggacctactgcatgaccggggtgctcatcgagggcaagtgcttcgtgccggaccagagcgtcgtgtccatcatcaagcacggcatcttcgacatcgcgagcgtgaagatcgtctgcttcttcgtggccgtgaaggggaacacgtacaagctgttcgagcaggtcaagaagtccttcgactccacgtgcaacgacaccgagaacaaggtgcagggctactacatctgcatcgtcgggggcaacagcgcccccatctacgtgcccaccctggacgacttccgctccatggaggccttcagcgggatcttccggagcccccacggcgaggaccacgacctcgcgggcgaggaggtggccagctactccatcgtcgggccggccaacgccaaggtgccccacagcgcctccagcgacaccctgtccctgatcgcgtacagcggcatcccctcctacagctccctcagcatcctgacctccagcaccgaggccaagcacgtgttctcccccgggttcttcccgcagctgaaccacaccaagtgcgacaagacggccatccccctcacctggaccggcatgatcgacctgcccggctactacgaggccatccacctgtgcaccgtcttctgcgtgctcagcgggcccggcgccagctgcgaggcgttctccgagggcgggatcttcaacatcacgagcccgatgtgcctggtgtccaagcagaaccagttccgcctgaccaagcagcaggtcaacttcgtgtgccagcgggtggacatggacatcgtcgtgtactgcaacgggcagcgcaaggtgatcctcaccaagaccatggtcatcggccagtgcatctacacgatcaccagcctgttctccctgctccccggcgtggcccacagcatcgccgtggagctgtgcgtccccgggttccacggctgggccaccgccgcgctgctcgtgaccttctgcttcgggtgggtgctgatccccgccgtcacgttcatcatcctgaccgtgctcaagttcgtggccaacatcttccacacctccaaccaggagaaccggctcaagagcgtcctgcgcaagatcaaggaggagttcgagaagaccaagggctccatggtgtgcgacgtgtgcaagtacgagtgcgagacgtaccgggagctgaaggcccacggggtcagctgcccgcagtcccagtgcccctactgcttcacccactgcgagcccaccgaggccgcgttccaggcccactaccgcgtgtgccaggtgacccaccggttccgcgacgacctgaagaagaccgtcacgccccagaacttcaccccgggctgctaccggaccctgaacctcttccgctacaagagccggtgctacatcttcaccatgtgggtgttcctgctggtgctcgagtccatcctgtgggccgccagcgcgtccgaggtccccctgaaccccatctggaacgacaacgcccacggcgtggggagcgtgccgatgcacacggacctcgagctggacttctccctgaccagcagctccaagtacacctaccgccggaagctgaccaaccccctcgaggagacgcaggccatcgacctgcacatcgagatcgaggagcagaccatcggcgtcgacgtgcacgccctggggcactggttcgacggccgcctcaacctgaagaccagcttccactgctacggggcctgcaccaagtacgagtacccctggcacacggcgaagtgccactacgagcgcgactaccagtacgagacctcctggggctgcaaccccagcgactgcccgggcgtggggaccggctgcaccgcctgcgggctgtacctcgaccagctgaagcccgtcggctccgcctacaagatcatcacgatccggtacagccgccgggtgtgcgtgcagttcggcgaggagaacctgtgcaaggtcatcgacatgaacgactgcttcgtgtcccgccacgtgaaggtctgcatcatcgggaccgtgagcaagttctcccagggcgacaccctcctgttcttcgggcccctggagggcgggggcctcatcttcaagcactggtgcaccagcacgtgccagttcggcgaccccggggacatcatgtccccgcgggacaagggcttcctgtgccccgagttccccgggagcttccgcaagaagtgcaacttcgccaccacgcccctgtgcgagtacgacggcaacatgatctccgggtacaagaaggtgatggccaccatcgacagcttccagtccttcaacaccagcaccatgcacttcaccgacgagcggatcgagtggaaggacccggacggcatgctccgcgaccacatcaacatcctggtcaccaaggacatcgacttcgacaacctgggcgagaacccctgcaagatcgggctccagacgtccagcatcgagggcgcgtgggggtccggcgtggggttcaccctgacctgcctggtgagcctcaccgagtgccccacgttcctgaccagcatcaaggcctgcgacaaggccatctgctacggcgccgagtccgtcaccctgacccggggccagaacacggtgaaggtcagcgggaagggcgggcactccggcagcaccttcaagtgctgccacggggaggactgctcccagaccggcctccacgccgcggcgccccacctggacaaggtgaacggcatcagcgagatcgagaactccaaggtgtacgacgacggggccccgcagtgcggcatcaagtgctggttcgtcaccagcggggagtggatctccggcatcttcagcggcaactggatcgtgctgatcgtgctctgcgtcttcctgctgttctccctcgtgctgctgagcgtgctctgccccgtccgcaagcacaagaagtcctga

SEQ ID NO: 11678 - RNA, 3408 nt, synthetic construct
  misc_feature 1..3408: note = derived and/or modified CDS sequence (opt1) from HTNV(Aa03-161)__KT934990.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcggggagaacagcgtgatcggctacgtggagctcccccccatgcccctggccgacacggcgcagctggtcccggagtccagctgctccatggacaaccaccagagcctcaacaccatcaccaagtacacccaggtgtcctggcgggggaaggccgaccagagccagtccagccagaactccttcgagacggtgagcaccgaggtcgacctgaagggcacctgcgtgctgaagcacaagatggtggaggagtcctaccgcagccggaagtccatcacctgctacgacctcagctgcaactccacgtactgcaagcccaccctgtacatgatcgtccccatccacgcctgcaacatgatgaagagctgcctgatcgccctcgggccctaccgcgtgcaggtggtctacgagcggacctactgcatgaccggcgtgctgatcgagggcaagtgcttcgtgccggaccagtccgtcgtgagcatcatcaagcacgggatcttcgacatcgccagcgtgcacatcgtctgcttcttcgtggcggtgaagggcaacacgtacaagatcttcgagcaggtcaagaagtccttcgagagcacctgcaacgacaccgagaacaaggtgcaggggtactacatctgcatcgtcggcgggaactccgcccccatctacgtgcccaccctggacgacttccgcagcatggaggccttcacgggcatcttccggtccccccacggcgaggaccacgacctcgccggggaggagaccgcgacctacagcatcgtgggcccggccaacgccaaggtcccccactccgccagctccgacaccctgagcctgatcgccttctccgggatccccagctactccagcctctccatcctgacgagctccaccgaggcgaagcacgtgttcagccccggcctgttcccgaagctcaaccacaccaactgcgacaagggcgccatccccctgatgtggaccgggatgatcgacctgcccggctactacgaggccatccacccctgcacggtgttctgcgtcctctccgggccgggcgccagctgcgaggccttcagcgaggggggcatcttcaacatcacctcccccatgtgcctggtgagcaagcagaaccgcttccggctgaccgagcagcaggtgaacttcgtctgccagcgcgtggacgtggacatcgtcgtgtactgcaacggccagcggaaggtgatcctcaccaagacgctggtcatcgggcagtgcatctacaccatcacctccctgttcagcctcctgcccggcgtggcgcactccatcgccgtggagctgtgcgtccccgggttccacggctgggccaccgccgccctcctggtgacgttctgcttcgggtgggtgctgatcccggcgatcaccttcatcatcctcaccatcctgaagttcatcgccaacatcttccacaccagcaaccaggagaaccgcctgaagtccgtcctccggaagatcaaggaggagttcgagaagacgaagggcagcatggtgtgcgacgtgtgcaagtacgagtgcgagacctacaaggagctgaaggcccacggcgtctcctgcccccagagccagtgcccctactgcttcacccactgcgagcccaccgaggccgccttccaggcgcactacaaggtgtgccaggtgacccaccgcttccgggacgacctgaagaagacggtcaccccgcagaacttcacccccgggtgctaccgcaccctcaacctgttccggtacaagtcccgctgctacatcttcacgatgtggatcttcctgctcgtgctggagagcatcctgtgggccgcctccgccagcgagacccccctcaccccggtgtggaacgacaacgcgcacggcgtcgggtccgtgcccatgcacaccgacctggagctggacttcagcctgacgtccagcagcaagtacacctaccggcgcaagctcaccaaccccctggaggaggcccagtccatcgacctgcacatcgagatcgaggagcagaccatcggcgtggacgtccacgccctcgggcactggttcgacggccggctgaacctgaagacgagcttccactgctacggcgcctgcaccaagtacgagtacccctggcacaccgccaagtgccactacgagcgcgactaccagtacgagacctcctgggggtgcaacccgagcgactgccccggcgtggggacgggctgcaccgcgtgcggcctctacctggaccgcctgaagcccgtggggtccgcctacaagatcatcaccatccggtacagccgccgggtctgcgtgcagttcggcgaggagaacctctgcaagatcatcgacatgaacgactgcttcgtgtcccgccacgtcaaggtgtgcatcatcgggaccgtgagcaagttctcccagggcgacacgctgctgttcttcgggcccctcgagggcggcgggctgatcttcaagcactggtgcaccagcacctgccagttcggcgacccgggggacatcatgtccccccgggacaagggcttcctgtgccccgagttccccgggagcttccgcaagaagtgcaacttcgccaccacgccgatctgcgagtacgacggcaacatggtctccggctaccggaaggtgatggccaccatcgacagcttccagtccttcaacaccagcaccatgcacttcacggacgagcgcatcgagtggaaggaccccgacgggatgctccgggaccacatcaacatcctggtgaccaaggacatcgacttcgacaacctgggcgagaacccctgcaagatcgggctccagacctccagcatcgagggcgcctgggggtccggcgtcggcttcaccctgacgtgcctggtgagcctcaccgagtgccccaccttcctgaccagcatcaaggcgtgcgacaaggccatctgctacggggccgagtccgtgacgctgacccgcggccagaacaccgtcaaggtgagcgggaagggcgggcactccggcagcaccttcaagtgctgccacggcgaggactgctcccagatcgggctccacgccgccgcgccgcacctggacaaggtgaacggcatcagcgagatggagaactccaaggtctacgacgacggggccccccagtgcggcatcaagtgctggttcgtgaagagcggcgagtggatctccgggatcttcagcggcaactggatcgtcctgatcgtgctctgcgtgttcctgctgttctccctcgtcctgctgagcatcctctgccccgtgcggaagcacaagaagtcctga

SEQ ID NO: 11679 - RNA, 3408 nt, synthetic construct
  misc_feature 1..3408: note = derived and/or modified CDS sequence (opt1) from HTNV(Aa03-386)__KT934991.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccatctccttcggggagaacagcgtcatcggctacgtggagctcccccccatgcccctggccgacacggcgcagctggtgccggagtccagctgctccatggacaaccaccagagcctcaacaccatcaccaagtacacccaggtctcctggcgggggaaggccgaccagagccagtccagccagaactccttcgagacggtgagcaccgaggtggacctgaagggcacctgcgtcctgaagcacaagatggtggaggagtcctaccgcagccggaagtccatcacctgctacgacctcagctgcaactccacgtactgcaagcccaccctgtacatgatcgtgcccatccacgcctgcaacatgatgaagagctgcctgatcgccctcgggccctaccgcgtccaggtggtgtacgagcggacctactgcatgaccggcgtcctgatcgagggcaagtgcttcgtgccggaccagtccgtggtcagcatcatcaagcacgggatcttcgacatcgccagcgtgcacatcgtgtgcttcttcgtcgcggtgaagggcaacacgtacaagatcttcgagcaggtgaagaagtccttcgagagcacctgcaacgacaccgagaacaaggtccaggggtactacatctgcatcgtgggcgggaactccgcccccatctacgtccccaccctggacgacttccgcagcatggaggccttcacgggcatcttccggtccccccacggcgaggaccacgacctcgccggggaggagaccgcgacctacagcatcgtgggcccggccaacgccaaggtgccccactccgccagctccgacaccctgagcctgatcgccttctccgggatccccagctactccagcctctccatcctgacgagctccaccgaggcgaagcacgtcttcagccccggcctgttcccgaagctcaaccacaccaactgcgacaagggcgccatccccctgatgtggaccgggatgatcgacctgcccggctactacgaggccatccacccctgcacggtgttctgcgtgctctccgggccgggcgccagctgcgaggccttcagcgaggggggcatcttcaacatcacctcccccatgtgcctggtcagcaagcagaaccgcttccggctgaccgagcagcaggtgaacttcgtgtgccagcgcgtcgacgtggacatcgtggtctactgcaacggccagcggaaggtgatcctcaccaagacgctggtgatcgggcagtgcatctacaccatcacctccctgttcagcctcctgcccggcgtcgcgcactccatcgccgtggagctgtgcgtgcccgggttccacggctgggccaccgccgccctcctggtcacgttctgcttcgggtgggtgctgatcccggcgatcaccttcatcatcctcaccatcctgaagttcatcgccaacatcttccacaccagcaaccaggagaaccgcctgaagtccgtgctccggaagatcaaggaggagttcgagaagacgaagggcagcatggtctgcgacgtgtgcaagtacgagtgcgagacctacaaggagctgaaggcccacggcgtgtcctgcccccagagccagtgcccctactgcttcacccactgcgagcccaccgaggccgccttccaggcgcactacaaggtctgccaggtgacccaccgcttccgggacgacctgaagaagacggtgaccccgcagaacttcacccccgggtgctaccgcaccctcaacctgttccggtacaagtcccgctgctacatcttcacgatgtggatcttcctgctcgtcctggagagcatcctgtgggccgcctccgccagcgagacccccctcaccccggtgtggaacgacaacgcgcacggcgtggggtccgtccccatgcacaccgacctggagctggacttcagcctgacgtccagcagcaagtacacctaccggcgcaagctcaccaaccccctggaggaggcccagtccatcgacctgcacatcgagatcgaggagcagaccatcggcgtggacgtgcacgccctcgggcactggttcgacggccggctgaacctgaagacgagcttccactgctacggcgcctgcaccaagtacgagtacccctggcacaccgccaagtgccactacgagcgcgactaccagtacgagacctcctgggggtgcaacccgagcgactgccccggcgtcgggacgggctgcaccgcgtgcggcctctacctggaccgcctgaagcccgtggggtccgcctacaagatcatcaccatccggtacagccgccgggtgtgcgtccagttcggcgaggagaacctctgcaagatcatcgacatgaacgactgcttcgtgtcccgccacgtgaaggtctgcatcatcgggaccgtgagcaagttctcccagggcgacacgctgctgttcttcgggcccctcgagggcggcgggctgatcttcaagcactggtgcaccagcacctgccagttcggcgacccgggggacatcatgtccccccgggacaagggcttcctgtgccccgagttccccgggagcttccgcaagaagtgcaacttcgccaccacgccgatctgcgagtacgacggcaacatggtgtccggctacaagaaggtcatggccaccatcgacagcttccagtccttcaacaccagcaccatgcacttcacggacgagcggatcgagtggaaggaccccgacgggatgctccgcgaccacatcaacatcctggtgaccaaggacatcgacttcgacaacctgggcgagaacccctgcaagatcgggctccagacctccagcatcgagggcgcctgggggtccggcgtgggcttcaccctgacgtgcctggtcagcctcaccgagtgccccaccttcctgaccagcatcaaggcgtgcgacaaggccatctgctacggggccgagtccgtgacgctgacccggggccagaacaccgtgaaggtcagcgggaagggcgggcactccggcagcaccttcaagtgctgccacggcgaggactgctcccagatcgggctccacgccgccgcgccgcacctggacaaggtgaacggcatcagcgagatggagaactccaaggtgtacgacgacggggccccccagtgcggcatcaagtgctggttcgtcaagagcggcgagtggatctccgggatcttcagcggcaactggatcgtgctgatcgtcctctgcatcttcctgctgttctccctcgtgctgctgagcatcctctgccccgtgcgcaagcacaagaagtcctga

SEQ ID NO: 11680 - RNA, 3408 nt, synthetic construct
  misc_feature 1..3408: note = derived and/or modified CDS sequence (opt1) from HTNV(Aa04-722)__KU207182.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcggggagaacagcgtgatcggctacgtggagctcccccccatgcccctggccgacacggcgcagctggtcccggagtccagctgctccatggacaaccaccagagcctcaacaccatcaccaagtacacccaggtgtcctggcgggggaaggccgaccagagccagtccagccagaactccttcgagacggtgagcaccgaggtcgacctgaagggcacctgcgtgctgaagcacaagatggtggaggagtcctaccgcagccggaagtccatcacctgctacgacctcagctgcaactccacgtactgcaagcccaccctgtacatgatcgtccccatccacgcctgcaacatgatgaagagctgcctgatcgccctcgggccctaccgcgtgcaggtggtctacgagcggacctactgcatgaccggcgtgctgatcgagggcaagtgcttcgtgccggaccagtccgtcgtgagcatcatcaagcacgggatcttcgacatcgccagcgtgcacatcgtctgcttcttcgtggcggtgaagggcaacacgtacaagatcttcgagcaggtcaagaagtccttcgagagcacctgcaacgacaccgagaacaaggtgcaggggtactacatctgcatcgtcggcgggaactccgcccccatctacgtgcccaccctggacgacttccgcagcatggaggccttcacgggcatcttccggtccccccacggcgaggaccacgacctcgccggggaggagaccgcgacctacagcatcgtgggcccggccaacgccaaggtcccccactccgccagctccgacaccctgagcctgatcgccttctccgggatccccagctactccagcctctccatcctgacgagctccaccgaggcgaagcacgtgttcagccccggcctgttcccgaagctcaaccacaccaactgcgacaagggcgccatccccctgatgtggaccgggatcatcgacctgcccggctactacgaggccatccacccctgcacggtgttctgcgtcctctccgggccgggcgccagctgcgaggccttcagcgaggggggcatcttcaacatcacctcccccatgtgcctggtgagcaagcagaaccgcttccggctgaccgagcagcaggtgaacttcgtctgccagcgcgtggacgtggacatcgtcgtgtactgcaacggccagcggaaggtgatcctcaccaagacgctggtcatcgggcagtgcatctacaccatcacctccctgttcagcctcctgcccggcgtggcgcactccatcgccgtggagctgtgcgtccccgggttccacggctgggccaccgccgccctcctggtgacgttctgcttcgggtgggtgctgatcccggcgatcaccttcatcatcctcaccatcctgaagttcatcgccaacatcttccacaccagcaaccaggagaaccgcctgaagtccgtcctccggaagatcaaggaggagttcgagaagacgaagggcagcatggtgtgcgacgtgtgcaagtacgagtgcgagacctacaaggagctgaaggcccacggcgtctcctgcccccagagccagtgcccctactgcttcacccactgcgagcccaccgaggccgccttccaggcgcactacaaggtgtgccaggtgacccaccgcttccgggacgacctgaagaagacggtcaccccgcagaacttcacccccgggtgctaccgcaccctcaacctgttccggtacaagtcccgctgctacatcttcacgatgtggatcttcctgctcgtgctggagagcatcctgtgggccgcctccgccagcgagacccccctcaccccggtgtggaacgacaacgcgcacggcgtcgggtccgtgcccatgcacaccgacctggagctggacttcagcctgacgtccagcagcaagtacacctaccggcgcaagctcaccaaccccctggaggaggcccagtccatcgacctgcacatcgagatcgaggagcagaccatcggcgtggacgtccacgccctcgggcactggttcgacggccggctgaacctgaagacgagcttccactgctacggcgcctgcaccaagtacgagtacccctggcacaccgccaagtgccactacgagcgcgactaccagtacgagacctcctgggggtgcaacccgagcgactgccccggcgtggggacgggctgcaccgcgtgcggcctctacctggaccgcctgaagcccgtggggtccgcctacaagatcatcaccatccggtacagccgccgggtctgcgtgcagttcggcgaggagaacctctgcaagatcatcgacatgaacgactgcttcgtgtcccgccacgtcaaggtgtgcatcatcgggaccgtgagcaagttctcccagggcgacacgctgctgttcttcgggcccctcgagggcggcgggctgatcttcaagcactggtgcaccagcacctgccagttcggcgacccgggggacatcatgtccccccgggacaagggcttcctgtgccccgagttccccgggagcttccgcaagaagtgcaacttcgccaccacgccgatctgcgagtacgacggcaacatggtctccggctacaagaaggtgatggccaccatcgacagcttccagtccttcaacaccagcaccatgcacttcacggacgagcggatcgagtggaaggaccccgacgggatgctccgcgaccacatcaacatcctggtgaccaaggacatcgacttcgacaacctgggcgagaacccctgcaagatcgggctccagacctccagcatcgagggcgcctgggggtccggcgtcggcttcaccctgacgtgcctggtgagcctcaccgagtgccccaccttcctgaccagcatcaaggcgtgcgacaaggccatctgctacggggccgagtccgtgacgctgacccggggccagaacaccgtcaaggtgagcgggaagggcgggcactccggcagcaccttcaagtgctgccacggcgaggactgctcccagatcgggctccacgccgccgcgccgcacctggacaaggtgaacggcatcagcgagatggagaactccaaggtctacgacgacggggccccccagtgcggcatcaagtgctggttcgtgaagagcggcgagtggatctccgggatcttcagcggcaactggatcgtcctgatcgtgctctgcgtgttcctgctgttctccctcgtcctgctgagcatcctctgccccgtgcgcaagcacaagaagtcctga

SEQ ID NO: 11681 - RNA, 3408 nt, synthetic construct
  misc_feature 1..3408: note = derived and/or modified CDS sequence (opt1) from HTNV(Aa05-190)__KT934993.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcggggagaacagcgtgatcggctacgtggagctcccgcccatgcccctgacggacaccgcccagctggtccccgagtccagctgctccatggacaaccaccagagcctcaacaccatcaccaagtacacccaggtgtcctggcgggggaaggcggaccagagccagtccagccagaactccttcgagaccgtgagcaccgaggtcgacctgaaggggacctgcgtgctgaagcacaagatgatcgaggagtcctaccgcagccggaagtccatcacgtgctacgacctcagctgcaactccacctactgcaagcccaccctgtacatgatcgtgcccatccacgcctgcaacatgatgaagtcctgcctgatcgccctcgggccctaccgcgtccaggtggtgtacgagcggacctactgcatgacgggcgtcctgatcgagggcaagtgcttcgtgccggaccagtccgtggtcagcatcatcaagcacgggatcttcgacatcgccagcgtgcacatcgtgtgcttcttcgtcgccgtgaagggcaacacctacaagatcttcgagcaggtcaagaagtccttcgagagcacgtgcaacgacaccgagaacaaggtgcaggggtactacatctgcatcgtgggcgggaactccgcgcccatctacgtccccacgctggacgacttccgcagcatggaggccttcaccggcatcttccggagcccccacggcgaggaccacgacctcgccggggaggagaccgccacctacagcatcgtgggcccggcgaacgccaaggtgccccactccgccagctccgacacgctgagcctgatcgccttctccgggatccccagctactccagcctctccatcctgaccagctccaccgaggccaagcacgtcttcagccccggcctgttcccgaagctcaaccacaccaactgcgacaagggcgcgatccccctgatgtggacggggatgatcgacctgcccggctactacgaggccatccacccctgcaccgtgttctgcgtgctctccgggccgggcgccagctgcgaggccttcagcgagggcggcatcttcaacatcacctcccccatgtgcctggtcagcaagcagaaccgcttccggctgaccgagcagcaggtcaacttcgtgtgccagcgcgtggacgtggacatcgtggtctactgcaacggccagcggaaggtgatcctcacgaagaccctggtgatcgggcagtgcatctacaccatcacctccctgttcagcctcctgcccggcgtcgcccactccatcgcggtggagctgtgcgtgcccgggttccacggctgggccacggccgccctcctggtcaccttctgcttcgggtgggtgctgatcccggccatcaccttcatcatcctcaccatcctgaagttcatcgcgaacatcttccacacgagcaaccaggagaaccgcctgaagtccgtgctccggaagatcaaggaggagttcgagaagaccaagggcagcatggtctgcgacgtgtgcaagtacgagtgcgagacctacaaggagctgaaggcccacggcgtgtcctgcccccagagccagtgcccctactgcttcacccactgcgagcccaccgaggccgccttccaggcccactacaaggtctgccaggtgacgcaccgcttccgggacgacctgaagaagaccgtgaccccgcagaacttcacccccgggtgctaccgcacgctcaacctgttccggtacaagtcccgctgctacatcttcaccatgtggatcttcctgctcgtcctggagagcatcctgtgggcggcctccgccagcgagacgcccctcaccccggtgtggaacgacaacgcccacggcgtggggtccgtccccatgcacaccgacctggagctggacttcagcctgacctccagcagcaagtacacctaccggcgcaagctcaccaaccccctggaggaggcgcagtccatcgacctgcacatcgagatcgaggagcagacgatcggcgtggacgtgcacgccctcgggcactggttcgacggccggctgaacctgaagaccagcttccactgctacggcgcctgcaccaagtacgagtacccctggcacaccgccaagtgccactacgagcgcgactaccagtacgagacgtcctgggggtgcaacccgagcgactgccccggcgtcgggaccggctgcaccgcctgcggcctctacctggaccgcctgaagcccgtggggtccgcgtacaagatcatcaccatccggtacagccgccgggtgtgcgtccagttcggcgaggagaacctctgcaagatcatcgacatgaacgactgcttcgtgtcccgccacgtgaaggtctgcatcatcgggacggtgagcaagttctcccagggcgacaccctgctgttcttcgggcccctcgagggcggcgggctgatcttcaagcactggtgcaccagcacgtgccagttcggcgacccgggggacatcatgagcccccgggacaagggcttcctgtgccccgagttccccgggtccttccgcaagaagtgcaacttcgccaccaccccgatctgcgagtacgacggcaacatggtgtccggctacaagaaggtcatggccaccatcgacagcttccagtccttcaacaccagcacgatgcacttcaccgacgagcggatcgagtggaaggaccccgacgggatgctccgcgaccacatcaacatcctggtgaccaaggacatcgacttcgacaacctgggcgagaacccctgcaagatcgggctccagacctccagcatcgagggcgcctgggggtccggcgtgggcttcacgctgacctgcctggtcagcctcaccgagtgccccaccttcctgacgagcatcaaggcctgcgacaaggcgatctgctacggggccgagtccgtgaccctgacccggggccagaacaccgtgaaggtcagcgggaagggcgggcactccggcagcaccttcaagtgctgccacggcgaggactgctcccagatcgggctccacgccgccgccccgcacctggacaaggtgaacggcatcagcgagatggagaactccaaggtgtacgacgacggggcgccccagtgcggcatcaagtgctggttcgtcaagagcggcgagtggatctccgggatcttcagcggcaactggatcgtgctgatcgtcctctgcgtgttcctgctgttctccctcgtgctgctgagcatcctctgccccgtccgcaagcacaagaagtcctga

SEQ ID NO: 11682 - RNA, 3408 nt, synthetic construct
  misc_feature 1..3408: note = derived and/or modified CDS sequence (opt1) from HTNV(Aa09-1000)__KT935001.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcggggagaacagcgtgatcggctacgtggagctcccccccatgcccctggccgacacggcgcagctggtcccggagtccagctgctccatggacaaccaccagagcctcaacaccatcaccaagtacacccaggtgtcctggcgggggaaggccgaccagagccagtccagccagaactccttcgagacggtgagcaccgaggtcgacctgaagggcacctgcgtgctgaagcacaagatggtggaggagtcctaccgcagccggaagtccatcacctgctacgacctcagctgcaactccacgtactgcaagcccaccctgtacatgatcgtccccatccacgcctgcaacatgatgaagagctgcctgatcgccctcgggccctaccgcgtgcaggtggtctacgagcggacctactgcatgaccggcgtgctgatcgagggcaagtgcttcgtgccggaccagtccgtcgtgagcatcatcaagcacgggatcttcgacatcgccagcgtgcacatcgtctgcttcttcgtggcggtgaagggcaacacgtacaagatcttcgagcaggtcaagaagtccttcgagagcacctgcaacgacaccgagaacaaggtgcaggggtactacatctgcatcgtcggcgggaactccgcccccatctacgtgcccaccctggacgacttccgcagcatggaggccttcacgggcatcttccggtccccccacggcgaggaccacgacctcgccggggaggagaccgcgacctacagcatcgtgggcccggccaacgccaaggtcccccactccgccagctccgacaccctgagcctgatcgccttctccgggatccccagctactccagcctctccatcctgacgagctccaccgaggcgaagcacgtgttcagccccggcctgttcccgaagctcaaccacaccaactgcgacaagggcgccatccccctgatgtggaccgggatgatcgacctgcccggctactacgaggccatccacccctgcacggtgttctgcgtcctctccgggccgggcgccagctgcgaggccttcagcgaggggggcatcttcaacatcacctcccccatgtgcctggtgagcaagcagaaccgcttccggctgaccgagcagcaggtgaacttcgtctgccagcgcgtggacgtggacatcgtcgtgtactgcaacggccagcggaaggtgatcctcaccaagacgctggtcatcgggcagtgcatctacaccatcacctccctgttcagcctcctgcccggcgtggcgcactccatcgccgtggagctgtgcgtccccgggttccacggctgggccaccgccgccctcctggtgacgttctgcttcgggtgggtgctgatcccggcgatcaccttcatcatcctcaccatcctgaagttcatcgccaacatcttccacaccagcaaccaggagaaccgcctgaagtccgtcctccggaagatcaaggaggagttcgagaagacgaagggcagcatggtgtgcgacgtgtgcaagtacgagtgcgagacctacaaggagctgaaggcccacggcgtctcctgcccccagagccagtgcccctactgcttcacccactgcgagcccaccgaggccgccttccaggcgcactacaaggtgtgccaggtgacccaccgcttccgggacgacctgaagaagacggtcaccccgcagaacttcacccccgggtgctaccgcaccctcaacctgttccggtacaagtcccgctgctacatcttcacgatgtggatcttcctgctcgtgctggagagcatcctgtgggccgcctccgccagcgagacccccctcaccccggtgtggaacgacaacgcgcacggcgtcgggtccgtgcccatgcacaccgacctggagctggacttcagcctgacgtccagcagcaagtacacctaccggcgcaagctcaccaaccccctggaggaggcccagtccatcgacctgcacatcgagatcgaggagcagaccatcggcgtggacgtccacgccctcgggcactggttcgacggccggctgaacctgaagacgagcttccactgctacggcgcctgcaccaagtacgagtacccctggcacaccgccaagtgccactacgagcgcgactaccagtacgagacctcctgggggtgcaacccgagcgactgccccggcgtggggacgggctgcaccgcgtgcggcctctacctggaccgcctgaagcccgtggggtccgcctacaagatcatcaccatccggtacagccgccgggtctgcgtgcagttcggcgaggagaacctctgcaagatcatcgacatgaacgactgcttcgtgtcccgccacgtcaaggtgtgcatcatcgggaccgtgagcaagttctcccagggcgacacgctgctgttcttcgggcccctcgagggcggcgggctgatcttcaagcactggtgcaccagcacctgccagttcggcgacccgggggacatcatgtccccccgggacaagggcttcctgtgccccgagttccccgggagcttccgcaagaagtgcaacttcgccaccacgccgatctgcgagtacgacggcaacatggtctccggctacaagaaggtgatggccaccatcgacagcttccagtccttcaacaccagcaccatgcacttcacggacgagcggatcgagtggaaggaccccgacgggatgctccgcgaccacatcaacatcctggtgaccaaggacatcgacttcgacaacctgggcgagaacccctgcaagatcgggctccagacctccagcatcgagggcgcctgggggtccggcgtcggcttcaccctgacgtgcctggtgagcctcaccgagtgccccaccttcctgaccagcatcaaggcgtgcgacaaggccatctgctacggggccgagtccgtgacgctgacccggggccagaacaccgtcaaggtgagcgggaagggcgggcactccggcagcaccttcaagtgctgccacggcgaggactgctcccagatcgggctccacgccgccgcgccgcacctggacaaggtgaacggcatcagcgagatggagaactccaaggtctacgacgacggggccccccagtgcggcatcaagtgctggttcgtgaagagcggcgagtggatctccgggatcttcagcggcaactggatcgtcctgatcgtgctctgcgtgttcctgctgttctccctcgtcctgctgagcatcctctgccccgtgcgcaagcacaagaagtcctga

SEQ ID NO: 11683 - RNA, 3408 nt, synthetic construct
  misc_feature 1..3408: note = derived and/or modified CDS sequence (opt1) from HTNV(Aa09-948)__KT935000.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcggggagaacagcgtgatcggctacgtggagctcccccccatgcccctggccgacacggcgcagctggtcccggagtccagctgctccatggacaaccaccagagcctcaacaccatcaccaagtacacccaggtgtcctggcgggggaaggccgaccagagccagtccagccagaactccttcgagacggtgagcaccgaggtcgacctgaagggcacctgcgtgctgaagcacaagatggtggaggagtcctaccgcagccggaagtccatcacctgctacgacctcagctgcaactccacgtactgcaagcccaccctgtacatgatcgtccccatccacgcctgcaacatgatgaagagctgcctgatcgccctcgggccctaccgcgtgcaggtggtctacgagcggacctactgcatgaccggcgtgctgatcgagggcaagtgcttcgtgccggaccagtccgtcgtgagcatcatcaagcacgggatcttcgacatcgccagcgtgcacatcgtctgcttcttcgtggcggtgaagggcaacacgtacaagatcttcgagcaggtcaagaagtccttcgagagcacctgcaacgacaccgagaacaaggtgcaggggtactacatctgcatcgtcggcgggaactccgcccccatctacgtgcccaccctggacgacttccgcagcatggaggccttcacgggcatcttccggtccccccacggcgaggaccacgacctcgccggggaggagaccgcgacctacagcatcgtgggcccggccaacgccaaggtcccccactccgccagctccgacaccctgagcctgatcgccttctccgggatccccagctactccagcctctccatcctgacgagctccaccgaggcgaagcacgtgttcagccccggcctgttcccgaagctcaaccacaccaactgcgacaagggcgccatccccctgatgtggaccgggatgatcgacctgcccggctactacgaggccatccacccctgcacggtgttctgcgtcctctccgggccgggcgccagctgcgaggccttcagcgaggggggcatcttcaacatcacctcccccatgtgcctgatcagcaagcagaaccgcttccggctgaccgagcagcaggtgaacttcgtgtgccagcgcgtcgacgtggacatcgtggtctactgcaacggccagcggaaggtgatcctcaccaagacgctggtgatcgggcagtgcatctacaccatcacctccctgttcagcctcctgcccggcgtcgcgcactccatcgccgtggagctgtgcgtgcccgggttccacggctgggccaccgccgccctcctggtcacgttctgcttcgggtgggtgctgatcccggcgatcaccttcatcatcctcaccatcctgaagttcatcgccaacatcttccacaccagcaaccaggagaaccgcctgaagtccgtgctccggaagatcaaggaggagttcgagaagacgaagggcagcatggtctgcgacgtgtgcaagtacgagtgcgagacctacaaggagctgaaggcccacggcgtgtcctgcccccagagccagtgcccctactgcttcacccactgcgagcccaccgaggccgccttccaggcgcactacaaggtctgccaggtgacccaccgcttccgggacgacctgaagaagacggtgaccccgcagaacttcacccccgggtgctaccgcaccctcaacctgttccggtacaagtcccgctgctacatcttcacgatgtggatcttcctgctcgtcctggagagcatcctgtgggccgcctccgccagcgagacccccctcaccccggtgtggaacgacaacgcgcacggcgtggggtccgtccccatgcacaccgacctggagctggacttcagcctgacgtccagcagcaagtacacctaccggcgcaagctcaccaaccccctggaggaggcccagtccatcgacctgcacatcgagatcgaggagcagaccatcggcgtggacgtgcacgccctcgggcactggttcgacggccggctgaacctgaagacgagcttccactgctacggcgcctgcaccaagtacgagtacccctggcacaccgccaagtgccactacgagcgcgactaccagtacgagacctcctgggggtgcaacccgagcgactgccccggcgtcgggacgggctgcaccgcgtgcggcctctacctggaccgcctgaagcccgtggggtccgcctacaagatcatcaccatccggtacagccgccgggtgtgcgtccagttcggcgaggagaacctctgcaagatcatcgacatgaacgactgcttcgtgtcccgccacgtgaaggtctgcatcatcgggaccgtgagcaagttctcccagggcgacacgctgctgttcttcgggcccctcgagggcggcgggctgatcttcaagcactggtgcaccagcacctgccagttcggcgacccgggggacatcatgtccccccgggacaagggcttcctgtgccccgagttccccgggagcttccgcaagaagtgcaacttcgccaccacgccgatctgcgagtacgacggcaacatggtgtccggctacaagaaggtcatggccaccatcgacagcttccagtccttcaacaccagcaccatgcacttcacggacgagcggatcgagtggaaggaccccgacgggatgctccgcgaccacatcaacatcctggtgaccaaggacatcgacttcgacaacctgggcgagaacccctgcaagatcgggctccagacctccagcatcgagggcgcctgggggtccggcgtgggcttcaccctgacgtgcctggtcagcctcaccgagtgccccaccttcctgaccagcatcaaggcgtgcgacaaggccatctgctacggggccgagtccgtgacgctgacccggggccagaacaccgtgaaggtcagcgggaagggcgggcactccggcagcaccttcaagtgctgccacggcgaggactgctcccagatcgggctccacgccgccgcgccgcacctggacaaggtgaacggcatcagcgagatggagaactccaaggtgtacgacgacggggccccccagtgcggcatcaagtgctggttcgtcaagagcggcgagtggatctccgggatcttcagcggcaactggatcgtgctgatcgtcctctgcgtgttcctgctgttctccctcgtgctgctgagcatcctctgccccgtccgcaagcacaagaagtcctga

SEQ ID NO: 11684 - RNA, 3408 nt, synthetic construct
  misc_feature 1..3408: note = derived and/or modified CDS sequence (opt1) from HTNV(Aa10-434)__KT935004.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcgggggcaacagcgtgatcgggtacgtggagctcccgcccatgcccctggccgacacggcccagctggtccccgagtccagctgctccatggacaaccaccagagcctcaacaccatcaccaagtacacccaggtgtcctggcggggcaaggccgaccagagccagtccagccagatctccttcgagacggtgagcaccgaggtcgacctgaaggggacctgcgtgctgaagcacaagatggtggaggagtcctaccgcagccggaagtccatcacgtgctacgacctcagctgcaactccacctactgcaagcccaccctgtacatgatcgtccccatccacgcctgcaacatgatgaagtcctgcctgatcgccctcggcccctaccgcgtccaggtggtgtacgagcggacctactgcatgaccggcgtgctgatcgaggggaagtgcttcgtgccggaccagtccgtcgtgagcatcatcaagcacggcatcttcgacatcgccagcgtgcacatcgtctgcttcttcgtggcggtgaaggggaacacgtacaagatcttcgagcaggtcaagaagtccttcgagagcacgtgcaacgacaccgagaacaaggtgcagggctactacatctgcatcgtcgggggcaactccgcccccatctacgtgcccaccctggacgacttccgcagcatggaggccttcaccggcatcttccggagcccccacggggaggaccacgacctcgccggcgaggagaccgcgacctacagcatcgtggggccggccaacgccaaggtcccccactccgccagctccgacaccctgagcctgatcgccttctccggcatccccagctactccagcctctccatcctgacgagctccaccgaggcgaagcacgtgttcagccccggcctgttcccgaagctcaaccacaccaactgcgacaagggggccatccccctgatgtggaccggcatgatcgacctgcccgggtactacgaggccatccacccctgcacggtgttctgcgtcctctccggcccgggggccagctgcgaggccttcagcgagggcggcatcttcaacatcacctcccccatgtgcctggtgagcaagcagaaccgcttccggctgaccgagcagcaggtcaacttcgtgtgccagcgcgtggacgtggacatcgtcgtgtactgcaacgggcagcggaaggtgatcctcaccaagacgctggtcatcggccagtgcatctacaccatcacctccctgttcagcctcctgcccggggtggcgcactccatcgccgtggagctgtgcgtccccggcttccacgggtgggccaccgccgccctcctggtgacgttctgcttcggctgggtgctgatcccggcgatcaccttcatcatcctcaccatcctgaagttcatcgccaacatcttccacaccagcaaccaggagaaccgcctgaagtccgtcctccggaagatcaaggaggagttcgagaagacgaagggcagcatggtgtgcgacgtgtgcaagtacgagtgcgagacctacaaggagctgaaggcccacggggtctcctgcccccagagccagtgcccctactgcttcacccactgcgagcccaccgaggccgccttccaggcgcactacaaggtgtgccaggtgacccaccgcttccgggacgacctgaagaagacggtcaccccgcagaacttcacccccggctgctaccgcaccctcaacctgttccggtacaagtcccgctgctacatcttcacgatgtggatcttcctgctcgtgctggagagcatcctgtgggccgcctccgccagcgagacgcccctcaccccggtgtggaacgacaacgcgcacggggtcggctccgtgcccatgcacaccgacctggagctggacttcagcctgacctccagcagcaagtacacctaccggcgcaagctcaccaaccccctggaggaggcccagtccatcgacctgcacatcgagatcgaggagcagaccatcggggtggacgtccacgccctcggccactggttcgacggccggctgaacctgaagacgagcttccactgctacggggcctgcaccaagtacgagtacccctggcacaccgccaagtgccactacgagcgcgactaccagtacgagacctcctggggctgcaacccgagcgactgccccggggtgggcacgggctgcaccgcgtgcgggctctacctggaccgcctgaagcccgtgggctccgcctacaagatcatcaccatccggtacagccgccgggtctgcgtgcagttcggggaggagaacctctgcaagatcatcgacatgaacgactgcttcgtgtcccgccacgtcaaggtgtgcatcatcggcaccatcagcaagttctcccagggggacacgctgctgttcttcggccccctcgagggcgggggcctgatcttcaagcactggtgcaccagcacgtgccagttcggggacccgggcgacatcatgagcccccgggacaaggggttcctgtgccccgagttccccggctccttccgcaagaagtgcaacttcgccaccaccccgatctgcgagtacgacggcaacatggtgtccgggtacaagaaggtcatggccaccatcgacagcttccagtccttcaacaccagcaccatgcacttcacggacgagcggatcgagtggaaggaccccgacggcatgctccgcgaccacatcaacatcctggtgaccaaggacatcgacttcgacaacctgggggagaacccctgcaagatcggcctccaggcctccagcatcgagggggcgtggggctccggcgtggggttcaccctgacctgcctggtcagcctcacggagtgccccaccttcctgaccagcatcaaggcctgcgacaaggccatctgctacggcgccgagtccgtgaccctgacgcgggggcagaacaccgtgaaggtcagcggcaagggcgggcactccggcagcaccttcaagtgctgccacggggaggactgctcccagatcggcctccacgccgcggccccgcacctggacaaggtgaacgggatcagcgagatggagaactccaaggtgtacgacgacggcgcgccccagtgcggcatcaagtgctggttcgtcaagagcggggagtggatctccggcatcttcagcgggaactggatcgtgctgatcgtcctctgcgtgttcctgctgttctccctcgtgctgctgagcatcctctgccccgtccgcaagcacaagaagtcctga

SEQ ID NO: 11685 - RNA, 3408 nt, synthetic construct
  misc_feature 1..3408: note = derived and/or modified CDS sequence (opt1) from HTNV(Aa10-518)__KT935005.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcggggagaacagcgtgatcggctacgtggagctcccccccatgcccctggccgacacggcgcagctggtcccggagtccagctgctccatggacaaccaccagagcctcaacaccatcaccaagtacacccaggtgtcctggcgggggaaggccgaccagagccagtccagccagaactccttcgagacggtgagcaccgaggtcgacctgaagggcacctgcgtgctgaagcacaagatggtggaggagtcctaccgcagccggaagtccatcacctgctacgacctcagctgcaactccacgtactgcaagcccaccctgtacatgatcgtccccatccacgcctgcaacatgatgaagagctgcctgatcgccctcgggccctaccgcgtgcaggtggtctacgagcggacctactgcatgaccggcgtgctgatcgagggcaagtgcttcgtgccggaccagtccgtcgtgagcatcatcaagcacgggatcttcgacatcgccagcgtgcacatcgtctgcttcttcgtggcggtgaagggcaacacgtacaagatcttcgagcaggtcaagaagtccttcgagagcacctgcaacgacaccaagaacaaggtgcaggggtactacatctgcatcgtcggcgggaactccgcccccatctacgtgcccaccctggacgacttccgcagcatggaggccttcacgggcatcttccggtccccccacggcgaggaccacgacctcgccggggaggagaccgcgacctacagcatcgtgggcccggccaacgccaaggtcccccactccgccagctccgacaccctgagcctgatcgccttctccgggatccccagctactccagcctctccatcctgacgagctccaccgaggcgaagcacgtgttcagccccggcctgttcccgaagctcaaccacaccaactgcgacaagggcgccatccccctgatgtggaccgggatgatcgacctgcccggctactacgaggccatccacccctgcacggtgttctgcgtcctctccgggccgggcgccagctgcgaggccttcagcgaggggggcatcttcaacatcacctcccccatgtgcctggtgagcaagcagaaccgcttccggctgaccgagcagcaggtgaacttcgtctgccagcgcgtggacgtggacatcgtcgtgtactgcaacggccagcggaaggtgatcctcaccaagacgctggtcatcgggcagtgcatctacaccatcacctccctgttcagcctcctgcccggcgtggcgcactccatcgccgtggagctgtgcgtccccgggttccacggctgggccaccgccgccctcctggtgacgttctgcttcgggtgggtgctgatcccggcgatcaccttcatcatcctcaccatcctgaagttcatcgccaacatcttccacaccagcaaccaggagaaccgcctgaagtccgtcctccggaagatcaaggaggagttcgagaagacgaagggcagcatggtgtgcgacgtgtgcaagtacgagtgcgagacctacaaggagctgaaggcccacggcgtctcctgcccccagagccagtgcccctactgcttcacccactgcgagcccaccgaggccgccttccaggcgcactacaaggtgtgccaggtgacccaccgcttccgggacgacctgaagaagacggtcaccccgcagaacttcacccccgggtgctaccgcaccctcaacctgttccggtacaagtcccgctgctacatcttcacgatgtggatcttcctgctcgtgctggagagcatcctgtgggccgcctccgccagcgagacccccctcaccccggtgtggaacgacaacgcgcacggcgtcgggtccgtgcccatgcacaccgacctggagctggacttcagcctgacgtccagcagcaagtacacctaccggcgcaagctcaccaaccccctggaggaggcccagtccatcgacctgcacatcgagatcgaggagcagaccatcggcgtggacgtccacgccctcgggcactggttcgacggccggctgaacctgaagacgagcttccactgctacggcgcctgcaccaagtacgagtacccctggcacaccgccaagtgccactacgagcgcgactaccagtacgagacctcctgggggtgcaacccgagcgactgccccggcgtggggacgggctgcaccgcgtgcggcctctacctggaccgcctgaagcccgtggggtccgcctacaagatcatcaccatccggtacagccgccgggtctgcgtgcagttcggcgaggagaacctctgcaagatcgtggacatgaacgactgcttcgtctcccgccacgtgaaggtgtgcatcatcgggaccgtcagcaagttctcccagggcgacacgctgctgttcttcgggcccctcgagggcggcgggctgatcttcaagcactggtgcaccagcacctgccagttcggcgacccgggggacatcatgtccccccgggacaagggcttcctgtgccccgagttccccgggagcttccgcaagaagtgcaacttcgccaccacgccgatctgcgagtacgacggcaacatggtgtccggctacaagaaggtgatggccaccatcgacagcttccagtccttcaacaccagcaccatgcacttcacggacgagcggatcgagtggaaggaccccgacgggatgctccgcgaccacatcaacatcctggtcaccaaggacatcgacttcgacaacctgggcgagaacccctgcaagatcgggctccagacctccagcatcgagggcgcctgggggtccggcgtgggcttcaccctgacgtgcctggtgagcctcaccgagtgccccaccttcctgaccagcatcaaggcgtgcgacaaggccatctgctacggggccgagtccgtcacgctgacccggggccagaacaccgtgaaggtgagcgggaagggcgggcactccggcagcaccttcaagtgctgccacggcgaggactgctcccagatcgggctccacgccgccgcgccgcacctggacaaggtcaacggcatcagcgagatggagaactccaaggtgtacgacgacggggccccccagtgcggcatcaagtgctggttcgtcaagagcggcgagtggatctccgggatcttcagcggcaactggatcgtgctgatcgtgctctgcgtcttcctgctgttctccctcgtgctgctgagcatcctctgccccgtgcgcaagcacaagaagtcctga

SEQ ID NO: 11686 - RNA, 3408 nt, synthetic construct
  misc_feature 1..3408: note = derived and/or modified CDS sequence (opt1) from HTNV(Aa10-561)__KT935006.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcggggagaacagcgtgatcggctacgtggagctcccccccatgcccctggccgacacggcgcagctggtcccggagtccagctgctccatggacaaccaccagagcctcaacaccatcaccaagtacacccaggtgtcctggcgggggaaggccgaccagagccagtccagccagatctccttcgagacggtgagcaccgaggtcgacctgaagggcacctgcgtgctgaagcacaagatggtggaggagtcctaccgcagccggaagtccatcacctgctacgacctcagctgcaactccacgtactgcaagcccaccctgtacatgatcgtccccatccacgcctgcaacatgatgaagagctgcctgatcgccctcgggccctaccgcgtgcaggtggtctacgagcggacctactgcatgaccggcgtgctgatcgagggcaagtgcttcgtgccggaccagtccgtcgtgagcatcatcaagcacgggatcttcgacatcgccagcgtgcacatcgtctgcttcttcgtggcggtgaagggcaacacgtacaagatcttcgagcaggtcaagaagtccttcgagagcacctgcaacgacaccgagaacaaggtgcaggggtactacatctgcatcgtcggcgggaactccgcccccatctacgtgcccaccctggacgacttccgcagcatggaggccttcacgggcatcttccggtccccccacggcgaggaccacgacctcgccggggaggagaccgcgacctacagcatcgtgggcccggccaacgccaaggtcccccactccgccagctccgacaccctgagcctgatcgccttctccgggatccccagctactccagcctctccatcctgacgagctccaccgaggcgaagcacgtgttcagccccggcctgttcccgaagctcaaccacaccaactgcgacaagggcgccatccccctgatgtggaccgggatgatcgacctgcccggctactacgaggccatccacccctgcacggtgttctgcgtcctctccgggccgggcgccagctgcgaggccttcagcgaggggggcatcttcaacatcacctcccccatgtgcctggtgagcaagcagaaccgcttccggctgaccgagcagcaggtgaacttcgtctgccagcgcgtggacgtggacatcgtcgtgtactgcaacggccagcggaaggtgatcctcaccaagacgctggtcatcgggcagtgcatctacaccatcacctccctgttcagcctcctgcccggcgtggcgcactccatcgccgtggagctgtgcgtccccgggttccacggctgggccaccgccgccctcctggtgacgttctgcttcgggtgggtgctgatcccggcgatcaccttcatcatcctcaccatcctgaagttcatcgccaacatcttccacaccagcaaccaggagaaccgcctgaagtccgtcctccggaagatcaaggaggagttcgagaagacgaagggcagcatggtgtgcgacgtgtgcaagtacgagtgcgagacctacaaggagctgaaggcccacggcgtctcctgcccccagagccagtgcccctactgcttcacccactgcgagcccaccgaggccgccttccaggcgcactacaaggtgtgccaggtgacccaccgcttccgggacgacctgaagaagacggtcaccccgcagaacttcacccccgggtgctaccgcaccctcaacctgttccggtacaagtcccgctgctacatcttcacgatgtggatcttcctgctcgtgctggagagcatcctgtgggccgcctccgccagcgagacccccctcaccccggtgtggaacgacaacgcgcacggcgtcgggtccgtgcccatgcacaccgacctggagctggacttcagcctgacgtccagcagcaagtacacctaccggcgcaagctcaccaaccccctggaggaggcccagtccatcgacctgcacatcgagatcgaggagcagaccatcggcgtggacgtccacgccctcgggcactggttcgacggccggctgaacctgaagacgagcttccactgctacggcgcctgcaccaagtacgagtacccctggcacaccgccaagtgccactacgagcgcgactaccagtacgagacctcctgggggtgcaacccgagcgactgccccggcgtggggacgggctgcaccgcgtgcggcctctacctggaccgcctgaagcccgtggggtccgcctacaagatcatcaccatccggtacagccgccgggtctgcgtgcagttcggcgaggagaacctctgcaagatcatcgacatgaacgactgcttcgtgtcccgccacgtcaaggtgtgcatcatcgggaccatcagcaagttctcccagggcgacacgctgctgttcttcgggcccctcgagggcggcgggctgatcttcaagcactggtgcaccagcacctgccagttcggcgacccgggggacatcatgtccccccgggacaagggcttcctgtgccccgagttccccgggagcttccgcaagaagtgcaacttcgccaccacgccgatctgcgagtacgacggcaacatggtgtccggctacaagaaggtcatggccaccatcgacagcttccagtccttcaacaccagcaccatgcacttcacggacgagcggatcgagtggaaggaccccgacgggatgctccgcgaccacatcaacatcctggtgaccaaggacatcgacttcgacaacctgggcgagaacccctgcaagatcgggctccaggcctccagcatcgagggcgcgtgggggtccggcgtgggcttcaccctgacctgcctggtcagcctcacggagtgccccaccttcctgaccagcatcaaggcctgcgacaaggccatctgctacggggccgagtccgtgaccctgacgcggggccagaacaccgtgaaggtcagcgggaagggcgggcactccggcagcaccttcaagtgctgccacggcgaggactgctcccagatcgggctccacgccgcggccccgcacctggacaaggtgaacggcatcagcgagatggagaactccaaggtgtacgacgacggggccccccagtgcggcatcaagtgctggttcgtcaagagcggcgagtggatctccgggatcttcagcggcaactggatcgtgctgatcgtcctctgcgtgttcctgctgttctccctcgtgctgctgagcatcctctgccccgtccgcaagcacaagaagtcctga

SEQ ID NO: 11687 - RNA, 3408 nt, synthetic construct
  misc_feature 1..3408: note = derived and/or modified CDS sequence (opt1) from HTNV(Aa14-172)__KT935008.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtcagcttcggggagaacagcgtgatcggctacgtggagctcccgcccatgcccctgacggacaccgcccagctggtccccgagtccagctgctccatggacaaccaccagagcctcaacaccatcaccaagtacacccaggtgtcctggcgggggaaggcggaccagagccagtccagccagaactccttcgagaccgtgagcaccgaggtcgacctgaaggggacctgcgtgctgaagcacaagatgatcgaggagtcctaccgcagccggaagtccatcacgtgctacgacctcagctgcaacaacacctactgcaagcccaccctgtacatgatcgtgcccatccacgcctgcaacatgatgaagtcctgcctgatcgccctcgggccctaccgcgtccaggtggtgtacgagcggacctactgcatgacgggcgtcctgatcgagggcaagtgcttcgtgccggaccagagcgtggtctccatcatcaagcacgggatcttcgacatcgccagcgtgcacatcgtgtgcttcttcgtcgccgtgaagggcaacacctacaagatcttcgagcaggtcaagaagtccttcgagagcacgtgcaacgacaccgagaacaaggtgcaggggtactacatctgcatcgtgggcgggaacagcgcgcccatctacgtccccacgctggacgacttccgctccatggaggccttcaccggcatcttccggagcccccacggcgaggaccacgacctcgccggggaggagaccgccacctactccatcgtgggcccggcgaacgccaaggtgccccacagcgcctccagcgacacgctgtccctgatcgccttcagcgggatcccctcctacagctccctcagcatcctgacctccagcaccgaggccaagcacgtcttctcccccggcctgttcccgaagctcaaccacaccaactgcgacaagggcgcgatccccctgatgtggacggggatgatcgacctgcccggctactacgaggccatccacccctgcaccgtgttctgcgtgctcagcgggccgggcgcctcctgcgaggccttcagcgagggcggcatcttcaacatcaccagccccatgtgcctggtctccaagcagaaccgcttccggctgaccgagcagcaggtcaacttcgtgtgccagcgcgtggacgtggacatcgtggtctactgcaacggccagcggaaggtgatcctcacgaagaccctggtgatcgggcagtgcatctacaccatcaccagcctgttctccctcctgcccggcgtcgcccacagcatcgcggtggagctgtgcgtgcccgggttccacggctgggccacggccgccctcctggtcaccttctgcttcgggtgggtgctgatcccggccatcaccttcatcatcctcaccatcctgaagttcatcgcgaacatcttccacacgtccaaccaggagaaccgcctcaagagcgtgctgcggaagatcaaggaggagttcgagaagaccaagggctccatggtctgcgacgtgtgcaagtacgagtgcgagacctacaaggagctgaaggcccacggcgtgagctgcccccagtcccagtgcccctactgcttcacccactgcgagcccaccgaggccgccttccaggcccactacaaggtctgccaggtgacgcaccgcttccgggacgacctgaagaagaccgtgaccccgcagaacttcacccccgggtgctaccgcacgctcaacctgttccggtacaagagccgctgctacatcttcaccatgtggatcttcctgctcgtcctggagtccatcctgtgggcggccagcgcctccgagacgcccctcaccccggtgtggaacgacaacgcccacggcgtggggagcgtccccatgcacaccgacctggagctggacttctccctgaccagctccagcaagtacacctaccggcgcaagctcaccaaccccctggaggaggcgcagagcatcgacctgcacatcgagatcgaggagcagacgatcggcgtggacgtgcacgccctcgggcactggttcgacggccggctgaacctgaagacctccttccactgctacggcgcctgcaccaagtacgagtacccctggcacaccgccaagtgccactacgagcgcgactaccagtacgagacgagctgggggtgcaacccgtccgactgccccggcgtcgggaccggctgcaccgcctgcggcctctacctggaccgcctgaagcccgtggggagcgcgtacaagatcatcaccatccggtactcccgccgggtgtgcgtccagttcggcgaggagaacctctgcaagatcatcgacatgaacgactgcttcgtgagccgccacgtgaaggtctgcatcatcgggacggtgtccaagttcagccagggcgacaccctgctgttcttcgggcccctcgagggcggcgggctgatcttcaagcactggtgcacctccacgtgccagttcggcgacccgggggacatcatgagcccccgggacaagggcttcctgtgccccgagttccccgggtccttccgcaagaagtgcaacttcgccaccaccccgatctgcgagtacgacggcaacatggtgagcggctacaagaaggtcatggccaccatcgactccttccagagcttcaacacctccacgatgcacttcaccgacgagcggatcgagtggaaggaccccgacgggatgctccgcgaccacatcaacatcctggtgaccaaggacatcgacttcgacaacctgggcgagaacccctgcaagatcgggctccagaccagctccatcgagggcgcctgggggagcggcgtgggcttcacgctgacctgcctggtctccctcaccgagtgccccaccttcctgacgagcatcaaggcctgcgacaaggcgatctgctacggggccgagagcgtgaccctgacccggggccagaacaccgtgaaggtctccgggaagggcgggcacagcggctccaccttcaagtgctgccacggcgaggactgcagccagatcgggctccacgccgccgccccgcacctggacaaggtgaacggcatctccgaggtggagaacagcaaggtctacgacgacggggcgccccagtgcggcatcaagtgctggttcgtgaagtccggcgagtggatcagcgggatcttctccggcaactggatcgtcctgatcgtgctctgcgtgttcctgctgttcagcctcgtcctgctgtccatcctctgccccgtgcgcaagcacaagaagtcctga

SEQ ID NO: 11688 - RNA, 3408 nt, synthetic construct
  misc_feature 1..3408: note = derived and/or modified CDS sequence (opt1) from HTNV(Aa14-266)__KT935013.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcggggagaacagcgtgatcggctacgtggagctcccgcccatgcccctggccgacacggcccagatggtccccgagtccagctgctccatggacaaccaccagagcctgaacaccatcaccaagtacacccaggtgtcctggcgggggaaggccgaccagagccagtccaaccagaacagcttcgagacggtgtccaccgaggtcgacctcaaggggacctgcgtgctgaagcacaagatggtggaggagagctaccgctcccgcaagagcatcacgtgctacgacctgtcctgcaacagcacctactgcaagcccaccctctacatgatcgtccccatccacgcctgcaacatgatgaagtcctgcctgatcgccctggggccctaccgggtccaggtggtgtacgagcggacctactgcatgaccggcgtgctcatcgagggcaagtgcttcgtgccggaccagagcgtcgtgtccatcatcaagcacgggatcttcgacatcgccagcgtgcacatcgtctgcttcttcgtggcggtgaagggcaacacgtacaagatcttcgagcaggtcaagaagtccttcgagtccacgtgcaacgacaccgagaacaaggtgcaggggtactacatctgcatcgtcggcgggaacagcgcccccatctacgtgcccaccctggacgacttccgctccatggaggccttcaccggcatcttccggagcccccacggcgaggaccacgacctggccggggaggagatcgcgacctactccatcgtgggcccggccaacgccaaggtcccccacagcgcctccagcgacaccctctccctgatcgcctacagcgggatcccctcctacagctccctgagcatcctcacctccagcacggaggcgaagcacgtgttctcccccggcctgttcccgaagctgaaccacaccaactgcgacaagagcgccatccccctcatgtggaccggcatgatcgacctgcccgggtactacgaggccgtgcacccctgcaccgtcttctgcgtgctgtccggcccgggggccagctgcgaggccttcagcgagggcgggatcttcaacatcacgtcccccatgtgcctcgtgagcaagcagaaccgcttccggctgaccgagcagcaggtcaacttcgtgtgccagcgcgtggacgtcgacatcgtggtgtactgcaacggccagcggaaggtcatcctgaccaagaccctcgtgatcggccagtgcatctacacgatcacctccctgttcagcctgctccccggggtggcgcactccatcgccgtcgagctgtgcgtgcccggcttccacgggtgggccaccgccgccctgctcgtgaccttctgcttcggctgggtcctgatcccggcgatcacgttcatcatcctgaccatcctcaagttcatcgccaacatcttccacaccagcaaccaggagaaccgcctgaagtccgtgctgcggaagatcaaggaggagttcgagaagaccaaggggagcatggtgtgcgacgtctgcaagtacgagtgcgagacgtacaaggagctcaaggcccacggcgtgtcctgcccccagagccagtgcccctactgcttcacccactgcgagcccaccgaggccgccttccaggcgcactacaaggtgtgccaggtcacccaccgcttccgggacgacctgaagaagaccgtgacgccgcagaacttcacccccggctgctaccgcaccctgaacctcttccggtacaagtcccgctgctacatcttcaccatgtggatcttcctgctggtgctcgagagcatcctgtgggccgcctccgccagcgagacgcccctgaccccggtctggaacgacaacgcgcacggggtgggctccgtgcccatgcacaccgacctcgagctggacttcagcctgacctccagcagcaagtacacgtaccggcgcaagctgaccaaccccctcgaggaggcccagtccatcgacctgcacatcgagatcgaggagcagaccatcggggtcgacgtgcacgccctgggccactggttcgacgggcggctcaacctgaagaccagcttccactgctacggcgcctgcacgaagtacgagtacccctggcacaccgccaagtgccactacgagcgcgactaccagtacgagacctcctggggctgcaacccgagcgactgccccggggtgggcaccgggtgcacggcgtgcggcctgtacctcgaccagctgaagcccgtcggctccgcctacaagatcatcaccatccgctacagccggcgcgtgtgcgtgcagttcggggaggagaacctgtgcaagaccatcgacatgaacgactgcttcgtctcccggcacgtgaaggtgtgcatcatcggcaccgtcagcaagttctcccagggggacacgctcctgttcttcggccccctggagggcggcggcctcatcttcaagcactggtgcaccagcacgtgccagttcggggacccgggcgacatcatgagcccccgcgacaaggggttcctgtgccccgagttccccggcagcttccggaagaagtgcaacttcgccaccaccccgatctgcgagtacgacgggaacatggtgtccggctacaagaaggtgatggccaccatcgacagcttccagtccttcaacaccagcaccatgcacttcacggacgagcgcatcgagtggaaggaccccgacggcatgctgcgggaccacatcaacatcctcgtcaccaaggacatcgacttcgacaacctgggggagaacccctgcaagatcggcctgcagacctccagcatcgagggggcctggggctccggggtgggcttcaccctcacgtgcctggtgagcctgaccgagtgccccaccttcctcaccagcatcaaggcgtgcgacaaggccatctgctacggcgccgagtccgtcacgctgacccgcgggcagaacaccgtgaaggtgagcggcaagggcgggcactccgggagcaccttcaagtgctgccacggcgaggactgctcccagatcggcctgcacgccgccgcgccgcacctcgacaaggtcaacgggatcagcgagatggagaactccaaggtgtacgacgacggcgcgccccagtgcgggatcaagtgctggttcgtcaagagcggcgagtggatctccggcatcttcagcgggaactggatcgtgctgatcgtgctgtgcgtcttcctcctgttctccctggtgctcctgagcatcctgtgccccgtgcggaagcacaagaagtcctga

SEQ ID NO: 11689 - RNA, 3408 nt, synthetic construct
  misc_feature 1..3408: note = derived and/or modified CDS sequence (opt1) from HTNV(Aa14-272)__KT935014.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcggggagaacagcgtgatcggctacgtggagctcccgcccatgcccctggccgacacggcccagatggtccccgagtccagctgctccatggacaaccaccagagcctgaacaccatcaccaagtacacccaggtgtcctggcgggggaaggccgaccagagccagtccaaccagaacagcttcgagacggtgtccaccgaggtcgacctcaaggggacctgcgtgctgaagcacaagatggtggaggagagctaccgctcccgcaagagcatcacgtgctacgacctgtcctgcaacagcacctactgcaagcccaccctctacatgatcgtccccatccacgcctgcaacatgatgaagtcctgcctgatcgccctggggccctaccgggtccaggtggtgtacgagcggacctactgcatgaccggcgtgctcatcgagggcaagtgcttcgtgccggaccagagcgtcgtgtccatcatcaagcacgggatcttcgacatcgccagcgtgcacatcgtctgcttcttcgtggcggtgaagggcaacacgtacaagatcttcgagcaggtcaagaagtccttcgagtccacgtgcaacgacaccgagaacaaggtgcaggggtactacatctgcatcgtcggcgggaacagcgcccccatctacgtgcccaccctggacgacttccgctccatggaggccttcaccggcatcttccggagcccccacggcgaggaccacgacctggccggggaggagatcgcgacctactccatcgtgggcccggccaacgccaaggtcccccacagcgcctccagcgacaccctctccctgatcgcctacagcgggatcccctcctacagctccctgagcatcctcacctccagcacggaggcgaagcacgtgttctcccccggcctgttcccgaagctgaaccacaccaactgcgacaagagcgccatccccctcatgtggaccggcatgatcgacctgcccgggtactacgaggccgtgcacccctgcaccgtcttctgcgtgctgtccggcccgggggccagctgcgaggccttcagcgagggcgggatcttcaacatcacgtcccccatgtgcctcgtgagcaagcagaaccgcttccggctgaccgagcagcaggtcaacttcgtgtgccagcgcgtggacgtcgacatcgtggtgtactgcaacggccagcggaaggtcatcctgaccaagaccctcgtgatcggccagtgcatctacacgatcacctccctgttcagcctgctccccggggtggcgcactccatcgccgtcgagctgtgcgtgcccggcttccacgggtgggccaccgccgccctgctcgtgaccttctgcttcggctgggtcctgatcccggcgatcacgttcatcatcctgaccatcctcaagttcatcgccaacatcttccacaccagcaaccaggagaaccgcctgaagtccgtgctgcggaagatcaaggaggagttcgagaagaccaaggggagcatggtgtgcgacgtctgcaagtacgagtgcgagacgtacaaggagctcaaggcccacggcgtgtcctgcccccagagccagtgcccctactgcttcacccactgcgagcccaccgaggccgccttccaggcgcactacaaggtgtgccaggtcacccaccgcttccgggacgacctgaagaagaccgtgacgccgcagaacttcacccccggctgctaccgcaccctgaacctcttccggtacaagtcccgctgctacatcttcaccatgtggatcttcctgctggtgctcgagagcatcctgtgggccgcctccgccagcgagacgcccctgaccccggtctggaacgacaacgcgcacggggtgggctccgtgcccatgcacaccgacctcgagctggacttcagcctgacctccagcagcaagtacacgtaccggcgcaagctgaccaaccccctcgaggaggcccagtccatcgacctgcacatcgagatcgaggagcagaccatcggggtcgacgtgcacgccctgggccactggttcgacgggcggctcaacctgaagaccagcttccactgctacggcgcctgcacgaagtacgagtacccctggcacaccgccaagtgccactacgagcgcgactaccagtacgagacctcctggggctgcaacccgagcgactgccccggggtgggcaccgggtgcacggcgtgcggcctgtacctcgaccagctgaagcccgtcggctccgcctacaagatcatcaccatccgctacagccggcgcgtgtgcgtgcagttcggggaggagaacctgtgcaagatcatcgacatgaacgactgcttcgtctcccggcacgtgaaggtgtgcatcatcggcaccgtcagcaagttctcccagggggacaccctcctgttcttcggccccctggagggcggcggcctcatcttcaagcactggtgcacgagcacgtgccagttcggggacccgggcgacatcatgagcccccgcgacaaggggttcctgtgccccgagttccccggcagcttccggaagaagtgcaacttcgccaccaccccgatctgcgagtacgacgggaacatggtgtccggctacaagaaggtgatggccaccatcgacagcttccagtccttcaacaccagcaccatgcacttcaccgacgagcgcatcgagtggaaggaccccgacggcatgctgcgggaccacatcaacatcctcgtcacgaaggacatcgacttcgacaacctgggggagaacccctgcaagatcggcctgcagacctccagcatcgagggggcctggggctccggggtgggcttcaccctgacctgcctcgtgagcctgacggagtgccccaccttcctcaccagcatcaaggcgtgcgacaaggccatctgctacggcgccgagtccgtcaccctgacgcgcgggcagaacaccgtgaaggtgagcggcaagggcgggcactccgggagcaccttcaagtgctgccacggcgaggactgctcccagatcggcctgcacgccgccgcgccgcacctcgacaaggtcaacgggatcagcgagatggagaactccaaggtgtacgacgacggcgcgccccagtgcgggatcaagtgctggttcgtcaagagcggcgagtggatctccggcatcttcagcgggaactggatcgtgctgatcgtgctgtgcgtcttcctcctgttctccctggtgctcctgagcatcctgtgccccgtgcggaagcacaagaagtcctga

SEQ ID NO: 11690 - RNA, 3408 nt, synthetic construct
  misc_feature 1..3408: note = derived and/or modified CDS sequence (opt1) from HTNV(Aa14-362)__KT935015.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcggggagaacagcgtgatcggctacgtggagctcccgcccatgcccctggccgacacggcccagctggtccccgagtccagctgctccatggacaaccaccagagcctcaacaccatcaccaagtacacccaggtgtcctggcgggggaaggccgaccagagccagtccagccagaactccttcgaggccgtgagcacggaggtcgacctgaaggggacctgcgtgctgaagcacaagatggtggaggagtcctaccgcagccggaagtccatcacgtgctacgacctcagctgcaactccacctactgcaagcccaccctgtacatgatcgtccccatccacgcctgcaacatgatgaagtcctgcctgatcgccctcgggccctaccgcgtccaggtggtgtacgagcggacctactgcatgaccggcgtgctgatcgagggcaagtgcttcgtgccggaccagtccgtcgtgagcatcatcaagcacgggatcttcgacatcgcgagcgtgcacatcgtctgcttcttcgtggccgtgaagggcaacacctacaagatcttcgagcaggtcaagaagtccttcgagagcacgtgcaacgacaccgagaacaaggtgcaggggtactacatctgcatcgtcggcgggaactccgcccccatctacgtgcccaccctggacgacttccgcagcatggaggccttcaccggcatcttccggagcccccacggcgaggaccacgacctcgcgggggaggagacggccacctacagcatcgtgggcccggccaacgccaaggtcccccactccgccagctccgacaccctgagcctgatcgcgttctccgggatccccagctactccagcctctccatcctgaccagctccacggaggccaagcacgtgttcagccccggcctgttcccgaagctcaaccacaccaactgcgacaagggcgccatccccctgatgtggaccgggatgatcgacctgcccggctactacgaggccatccacccctgcaccgtgttctgcgtcctctccgggccgggcgccagctgcgaggcgttcagcgagggcggcatcttcaacatcacgtcccccatgtgcctggtgagcaagcagaaccgcttccggctgaccgagcagcaggtcaacttcgtgtgccagcgcgtggacgtggacatcatcgtctactgcaacggccagcggaaggtgatcctcaccaagaccctggtgatcgggcagtgcatctacacgatcacctccctgttcagcctcctgcccggcgtcgcccactccatcgccgtggagctgtgcgtgcccgggttccacggctgggccaccgccgcgctcctggtcaccttctgcttcgggtgggtgctgatcccggccatcacgttcatcatcctcaccatcctgaagttcatcgccaacatcttccacaccagcaaccaggagaaccgcctgaagtccgtgctccggaagatcaaggaggagttcgagaagaccaagggcagcatggtctgcgacgtgtgcaagtacgagtgcgagacgtacaaggagctgaaggcccacggcgtgtcctgcccccagagccagtgcccctactgcttcacccactgcgagcccaccgaggccgcgttccaggcccactacaaggtctgccaggtgacccaccgcttccgggacgacctgaagaagaccgtgacgccgcagaacttcacccccgggtgctaccgcaccctcaacctgttccggtacaagtcccgctgctacatcttcaccatgtggatcttcctgctcgtcctggagagcatcctgtgggccgcctccgcgagcgagacgcccctcaccccggtgtggaacgacaacgcccacggcgtggggtccgtccccatgcacaccgacctggagctggacttcagcctgacctccagcagcaagtacacgtaccggcgcaagctcaccaaccccctggaggaggcccagtccatcgacctgcacatcgagatcgaggagcagaccatcggcgtggacgtgcacgccctcgggcactggttcgacggccggctgaacctgaagaccagcttccactgctacggcgcctgcacgaagtacgagtacccctggcacaccgcgaagtgccactacgagcgcgactaccagtacgagacctcctgggggtgcaacccgagcgactgccccggcgtcgggaccggctgcacggcctgcggcctctacctggaccgcctgaagcccgtggggtccgcctacaagatcatcaccatccggtacagccgccgggtgtgcgtccagttcggcgaggagaacctctgcaagatcatcgacatgaacgactgcttcgtgtcccgccacgtgaaggtctgcatcatcgggaccgtgagcaagttctcccagggcgacaccctgctgttcttcgggcccctcgagggcggcgggctgatcttcaagcactggtgcacgagcacgtgccagttcggcgacccgggggacatcatgagcccccgggacaagggcttcctgtgccccgagttccccgggtccttccgcaagaagtgcaacttcgccaccaccccgatctgcgagtacgacggcaacatggtgtccggctacaagaaggtcatggccaccatcgacagcttccagtccttcaacaccagcaccatgcacttcaccgacgagcggatcgagtggaaggaccccgacgggatgctccgcgaccacatcaacatcctggtgacgaaggacatcgacttcgacaacctgggcgagaacccctgcaagatcgggctccagacctccagcatcgagggcgcgtgggggtccggcgtgggcttcaccctgacctgcctggtcagcctcacggagtgccccaccttcctgaccagcatcaaggcctgcgacaaggccatctgctacggggccgagtccgtgaccctgacgcggggccagaacaccgtgaaggtcagcgggaagggcgggcactccggcagcaccttcaagtgctgccacggcgaggactgctcccagatcgggctccacgccgcggccccgcacctggacaaggtgaacggcatcagcgagatggagaactccaaggtgtacgacgacggggcgccccagtgcggcatcaagtgctggttcgtcaagagcggcgagtggatctccgggatcttcagcggcaactggatcgtgctgatcgtcctctgcgtgttcctgctgttctccctcgtgctgctgagcatcctctgccccgtccgcaagcacaagaagtcctga

SEQ ID NO: 11691 - RNA, 3408 nt, synthetic construct
  misc_feature 1..3408: note = derived and/or modified CDS sequence (opt1) from HTNV(Aa14-404)__KT935018.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtcagcttcggggagaacagcgtgatcggctacgtggagctcccgcccatgcccctggccgacacggcgcagatggtccccgagtccagctgctccatggacaaccaccagagcctgaacaccatcaccaagtacacccaggtgtcctggcgggggaaggccgaccagagccagtccagccagaactccttcgagacggtgagcaccgaggtcgacctcaaggggacctgcgtgctgaagcacaagatggtggaggagtcctaccgcagccggaagtccatcacgtgctacgacctgagctgcaactccacctactgcaagcccaccctctacatgatcgtccccatccacgcctgcaacatgatgaagtcctgcctgatcgccctggggccctaccgcgtccaggtggtgtacgagcggacctactgcatgaccggcgtgctcatcgagggcaagtgcttcgtgccggaccagtccgtcgtgagcatcatcaagcacgggatcttcgacatcgccagcgtgcacatcgtctgcttcttcgtggcggtgaagggcaacacgtacaagatcttcgagcaggtcaagaagtccttcgagagcacgtgcaacgacaccgagaacaaggtgcaggggtactacatctgcatcgtcggcgggaactccgcccccatctacgtgcccaccctggacgacttccgcagcatggaggccttcaccggcatcttccggagcccccacggcgaggaccacgacctggccggggaggagatcgcgacctacagcatcgtgggcccggccaacgccaaggtcccccactccgccagctccgacaccctcagcctgatcgcctactccgggatccccagctactccagcctgtccatcctcaccagctccacggaggcgaagcacgtgttcagccccggcctgttcccgaagctgaaccacaccaactgcgacaagtccgccatccccctcatgtggaccggcatgatcgacctgcccgggtactacgaggccgtgcacccctgcaccgtcttctgcgtgctgagcggcccgggggccagctgcgaggccttctccgagggcgggatcttcaacatcacgagccccatgtgcctcgtgtccaagcagaaccgcttccggctgaccgagcagcaggtcaacttcgtgtgccagcgcgtggacgtcgacatcgtggtgtactgcaacggccagcggaaggtcatcctgaccaagaccctcgtgatcggccagtgcatctacacgatcaccagcctgttctccctgctccccggggtggcgcacagcatcgccgtcgagctgtgcgtgcccggcttccacgggtgggccaccgccgccctgctcgtgaccttctgcttcggctgggtcctgatcccggcgatcacgttcatcatcctgaccatcctcaagttcatcgccaacatcttccacacctccaaccaggagaaccgcctcaagagcgtgctgcggaagatcaaggaggagttcgagaagaccaaggggtccatggtgtgcgacgtctgcaagtacgagtgcgagacgtacaaggagctgaaggcccacggcgtgagctgcccccagtcccagtgcccctactgcttcacccactgcgagcccaccgaggccaccttccaggcccactacaaggtgtgccaggtcacccaccgcttccgggacgacctgaagaagacggtgaccccgcagaacttcacccccggctgctaccgcaccctgaacctcttccggtacaagagccgctgctacatcttcacgatgtggatcttcctgctggtgctcgagtccatcctgtgggcggccagcgcctccgagacgcccctgaccccggtctggaacgacaacgcccacggggtgggcagcgtgcccatgcacaccgacctcgagctggacttctccctgaccagcagctccaagtacacctaccggcgcaagctgaccaaccccctcgaggaggcgcagagcatcgacctgcacatcgagatcgaggagcagaccatcggggtcgacgtgcacgccctgggccactggttcgacgggcggctcaacctgaagacgtccttccactgctacggcgcctgcaccaagtacgagtacccctggcacaccgccaagtgccactacgagcgcgactaccagtacgagaccagctggggctgcaacccgtccgactgccccggggtgggcacggggtgcaccgcctgcggcctgtacctcgaccagctgaagcccgtcggcagcgcgtacaagatcatcaccatccgctactcccggcgcgtgtgcgtgcagttcggggaggagaacctgtgcaagatcatcgacatgaacgactgcttcgtcagccggcacgtgaaggtgtgcatcatcggcaccgtctccaagttcagccagggggacacgctcctgttcttcggccccctggagggcggcggcctcatcttcaagcactggtgcacctccacgtgccagttcggggacccgggcgacatcatgagcccccgcgacaaggggttcctgtgccccgagttccccggctccttccggaagaagtgcaacttcgccaccaccccgctgtgcgagtacgacgggaacatggtgagcggctacaagaaggtgatggccaccatcgactccttccagagcttcaacacctccaccatgcacttcacggacgagcgcatcgagtggaaggaccccgacggcatgctccgggaccacatcaacatcctggtcaccaaggacatcgacttcgacaacctgggggagaacccctgcaagatcggcctccagaccagctccatcgagggggcctggggcagcggggtgggcttcaccctgacgtgcctggtgagcctcaccgagtgccccaccttcctgacctccatcaaggcctgcgacaaggcgatctgctacggcgccgagagcgtcacgctgacccgcgggcagaacaccgtgaaggtgtccggcaagggcgggcacagcgggtccaccttcaagtgctgccacggcgaggactgcagccagatcggcctccacgccgccgccccgcacctggacaaggtcaacgggatctccgagatggagaacagcaaggtgtacgacgacggcgcgccccagtgcgggatcaagtgctggttcgtcaagtccggcgagtggatcagcggcatcttctccgggaactggatcgtgctgatcgtgctctgcgtcttcctgctgttcagcctcgtgctgctgtccatcctctgccccgtgcggaagcacaagaagtcctga

SEQ ID NO: 11692 - RNA, 3408 nt, synthetic construct
  misc_feature 1..3408: note = derived and/or modified CDS sequence (opt1) from HTNV(Aa14-423)__KT935022.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtcagcttcggggagaacagcgtgatcggctacgtggagctcccgcccatgcccctggccgacacggcgcagatggtccccgagtccagctgctccatggacaaccaccagagcctgaacaccatcaccaagtacacccaggtgtcctggcgggggaaggccgaccagagccagtccagccagaactccttcgagacggtgagcaccgaggtcgacctcaaggggacctgcgtgctgaagcacaagatggtggaggagtcctaccgcagccggaagtccatcacgtgctacgacctgagctgcaactccacctactgcaagcccaccctctacatgatcgtccccatccacgcctgcaacatgatgaagtcctgcctgatcgccctggggccctaccgcgtccaggtggtgtacgagcggacctactgcatgaccggcgtgctcatcgagggcaagtgcttcgtgccggaccagtccgtcgtgagcatcatcaagcacgggatcttcgacatcgccagcgtgcacatcgtctgcttcttcgtggcggtgaagggcaacacgtacaagatcttcgagcaggtcaagaagtccttcgagagcacgtgcaacgacaccgagaacaaggtgcaggggtactacatctgcatcgtcggcgggaactccgcccccatctacgtgcccaccctggacgacttccgcagcatggaggccttcaccggcatcttccggagcccccacggcgaggaccacgacctggccggggaggagatcgcgacctacagcatcgtgggcccggccaacgccaaggtcccccactccgccagctccgacaccctcagcctgatcgcctactccgggatccccagctactccagcctgtccatcctcaccagctccacggaggcgaagcacgtgttcagccccggcctgttcccgaagctgaaccacaccaactgcgacaagtccgccatccccctcatgtggaccggcatgatcgacctgcccgggtactacgaggccgtgcacccctgcaccgtcttctgcgtgctgagcggcccgggggccagctgcgaggccttctccgagggcgggatcttcaacatcacgagccccatgtgcctcgtgtccaagcagaaccgcttccggctgaccgagcagcaggtcaacttcgtgtgccagcgcgtggacgtcgacatcgtggtgtactgcaacggccagcggaaggtcatcctgaccaagaccctcgtgatcggccagtgcatctacacgatcaccagcctgttctccctgctccccggggtggcgcacagcatcgccgtcgagctgtgcgtgcccggcttccacgggtgggccaccgccgccctgctcgtgaccttctgcttcggctgggtcctgatcccggcgatcacgctgatcatcctcaccatcctgaagttcatcgccaacatcttccacacctccaaccaggagaaccgcctcaagagcgtgctccggaagatcaaggaggagttcgagaagaccaaggggtccatggtgtgcgacgtctgcaagtacgagtgcgagacgtacaaggagctgaaggcccacggcgtgagctgcccccagtcccagtgcccctactgcttcacccactgcgagcccaccgaggccaccttccaggcccactacaaggtgtgccaggtcacccaccgcttccgggacgacctgaagaagacggtgaccccgcagaacttcacccccggctgctaccgcaccctcaacctgttccggtacaagagccgctgctacatcttcacgatgtggatcttcctgctcgtgctggagtccatcctgtgggcggccagcgcctccgagacgcccctcaccccggtctggaacgacaacgcccacggggtgggcagcgtgcccatgcacaccgacctggagctggacttctccctgaccagcagctccaagtacacctaccggcgcaagctcaccaaccccctggaggaggcgcagagcatcgacctgcacatcgagatcgaggagcagaccatcggggtcgacgtgcacgccctcggccactggttcgacgggcggctgaacctgaagacgtccttccactgctacggcgcctgcaccaagtacgagtacccctggcacaccgccaagtgccactacgagcgcgactaccagtacgagaccagctggggctgcaacccgtccgactgccccggggtgggcacggggtgcaccgcctgcggcctctacctggaccagctgaagcccgtcggcagcgcgtacaagatcatcaccatccgctactcccggcgcgtgtgcgtgcagttcggggaggagaacctctgcaagatcatcgacatgaacgactgcttcgtcagccggcacgtgaaggtgtgcatcatcggcaccgtctccaagttcagccagggggacacgctgctgttcttcggccccctcgagggcggcggcctgatcttcaagcactggtgcacctccacgtgccagttcggggacccgggcgacatcatgagcccccgcgacaaggggttcctgtgccccgagttccccggctccttccggaagaagtgcaacttcgccaccaccccgctctgcgagtacgacgggaacatggtgagcggctacaagaaggtgatggccaccatcgactccttccagagcttcaacacctccaccatgcacttcacggacgagcgcatcgagtggaaggaccccgacggcatgctgcgggaccacatcaacatcctggtcaccaaggacatcgacttcgacaacctcggggagaacccctgcaagatcggcctgcagaccagctccatcgagggggcctggggcagcggggtgggcttcaccctgacgtgcctcgtgagcctgaccgagtgccccaccttcctgacctccatcaaggcctgcgacaaggcgatctgctacggcgccgagagcgtcacgctcacccgcgggcagaacaccgtgaaggtgtccggcaagggcgggcacagcgggtccaccttcaagtgctgccacggcgaggactgcagccagatcggcctgcacgccgccgccccgcacctggacaaggtcaacgggatctccgagatggagaacagcaaggtgtacgacgacggcgcgccccagtgcgggatcaagtgctggttcgtcaagtccggcgagtggatcagcggcatcttctccgggaactggatcgtgctcatcgtgctgtgcgtcttcctgctgttcagcctggtgctgctctccatcctgtgccccgtgcggaagcacaagaagtcctga

SEQ ID NO: 11693 - RNA, 3408 nt, synthetic construct
  misc_feature 1..3408: note = derived and/or modified CDS sequence (opt1) from HTNV(Aa15-56)__KU207187.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcggggagaacagcgtgatcggctacgtggagctcccccccatgcccctggccgacacggcgcagctggtcccggagtccagctgctccatggacaaccaccagagcctcaacaccatcaccaagtacacccaggtgtcctggcggcgcaaggccgaccagagccagtccagccagaactccttcgagacggtgagcaccgaggtcgacctgaaggggacctgcgtgctgaagcacaagatggtggaggagtcctaccggagccgcaagtccatcacctgctacgacctcagctgcaactccacgtactgcaagcccaccctgtacatgatcgtccccatccacgcctgcaacatgatgaagagctgcctgatcgccctcggcccctaccgggtgcaggtggtctacgagcgcacctactgcatgaccggggccctgatcgagggcaagtgcttcgtgccggaccagtccgtggtcagcatcatcaagcacggcatcttcgacatcgcgagcgtgcacatcgtgtgcttcttcgtcgccgtgaaggggaacacgtacaagatcttcgagcaggtgaagaagtccttcgagagcacctgcaacgacaccgagaacaaggtccagggctactacatctgcatcgtggggggcaactccgcccccatctacgtccccaccctggacgacttccggagcatggaggccttcacggggatcttccgctccccccacggcgaggaccacgacctcgcgggcgaggagaccgccacctacagcatcgtggggccggccaacgccaaggtgccccactccgccagctccgacaccctgagcctgatcgcgttctccggcatccccagctactccagcctctccatcctgacgagctccaccgaggccaagcacgtcttcagccccgggctgttcccgaagctcaaccacaccaactgcgacaagggcgccatccccctgatgtggaccggcatgatcgacctgcccgggtactacgaggccatccacccctgcacggtgttctgcgtgctctccggcccgggggccagctgcgaggcgttcagcgagggcgggatcttcaacatcacctcccccatgtgcctggtcagcaagcagaaccggttccgcctgaccgagcagcaggtgaacttcgtgtgccagcgggtcgacgtggacatcgtggtctactgcaacggccagcgcaaggtgatcctcaccaagacgctggtgatcggccagtgcatctacaccatcacctccctgttcagcctcctgcccggggtcgcccactccatcgccgtggagctgtgcgtgcccggcttccacgggtgggccaccgccgcgctcctggtcacgttctgcttcggctgggtgctgatcccggccatcaccttcatcatcctcaccatcctgaagttcatcgccaacatcttccacaccagcaaccaggagaaccggctgaagtccgtgctccgcaagatcaaggaggagttcgagaagacgaaggggagcatggtctgcgacgtgtgcaagtacgagtgcgagacctacaaggagctgaaggcccacggcgtgtcctgcccccagagccagtgcccctactgcttcacccactgcgagcccaccgaggccgcgttccaggcccactacaaggtctgccaggtgacccaccggttccgcgacgacctgaagaagacggtgaccccgcagaacttcacccccggctgctaccggaccctcaacctgttccgctacaagtcccggtgctacatcttcacgatgtggatcttcctgctcgtcctggagagcatcctgtgggccgcctccgcgagcgagacccccctcaccccggtgtggaacgacaacgcccacggggtgggctccgtccccatgcacaccgacctggagctggacttcagcctgacgtccagcagcaagtacacctaccgccggaagctcaccaaccccctggaggaggcccagtccatcgacctgcacatcgagatcgaggagcagaccatcggggtggacgtgcacgccctcggccactggttcgacgggcgcctgaacctgaagacgagcttccactgctacggcgcctgcaccaagtacgagtacccctggcacaccgcgaagtgccactacgagcgcgactaccagtacgagacctcctggggctgcaacccgagcgactgccccggggtcggcacggggtgcaccgcctgcggcctctacctggaccggctgaagcccgtgggctccgcctacaagatcatcaccatccgctacagccggcgcgtgtgcgtccagttcggggaggagaacctctgcaagatcatcgacatgaacgactgcttcgtgtcccggcacgtgaaggtctgcatcatcggcaccgtgagcaagttctcccagggggacacgctgctgttcttcggccccctcgaggggggcggcctgatcttcaagcactggtgcaccagcacctgccagttcggggacccgggcgacatcatgtccccccgcgacaaggggttcctgtgccccgagttccccggcagcttccggaagaagtgcaacttcgccaccacgccgatctgcgagtacgacgggaacatggtgtccggctacaagaaggtcatggccaccatcgacagcttccagtccttcaacaccagcaccatgcacttcacggacgagcgcatcgagtggaaggaccccgacggcatgctccgggaccacatcaacatcctggtgaccaaggacatcgacttcgacaacctgggggagaacccctgcaagatcggcctccagacctccagcatcgagggggcgtggggctccggggtgggcttcaccctgacgtgcctggtcagcctcaccgagtgccccaccttcctgaccagcatcaaggcctgcgacaaggccatctgctacggcgccgagtccgtgacgctgacccgcgggcagaacaccgtgaaggtcagcggcaaggggggccactccgggagcaccttcaagtgctgccacggcgaggactgctcccagatcggcctccacgccgcggccccgcacctggacaaggtgaacgggatcagcgagatggagaactccaaggtgtacgacgacggcgccccccagtgcgggatcaagtgctggttcgtcaagagcggcgagtggatctccggcatcttcagcgggaactggatcgtgctgatcgtcctctgcgtgttcctgctgttctccctcgtgctgctgagcatcctctgccccgtccggaagcacaagaagtcctga

SEQ ID NO: 11694 - RNA, 3408 nt, synthetic construct
  misc_feature 1..3408: note = derived and/or modified CDS sequence (opt1) from HTNV(CBAa11-106)__KC576787.1__GP
  source 1..3408: mol_type = other RNA
atgggcatgtggaagtggctggtgatcgccagcctcgtctggcccgccctgaccctgcgcaacgtgtacgacatgaagatcgagtgcccgcacaccgtgtccttcggggagaacagcgtcatcggctacgtggagctcccccccatgcccctggcggacacggcccagatggtgccggagtccagctgctccatggacaaccaccagagcatgaacaccatcaccaagtacacccaggtcatctggcgggggaaggccgaccccggccagtccagccagaactccttcgagacggtgagcaccgagatcgacctgaaggggacctgcgtgctcaagcacaagatggtcgaggagtcctaccgcagccggaagtccatcacctgctacgacctgagctgcaactccacgtactgcaagcccaccctgtacatgatcgtgcccatccacgcctgcaacatgatgaagagctgcctcatcgccctgggcccgtaccgcgtgcaggtcgtgtacgagcggacctactgcatgaccggcgtgctgatcgaggggaagtgcttcgtccccgaccagtccgtggtgagcatcatcaagcacggcatcttcgacatcgcgtccgtccacatcgtgtgcttcttcgtggccgtcaaggggaacacgtacaagctcttcgagcaggtgaagaagagcttcgagagcacctgcaacgacaccgagaacaaggtgcagggctactacatctgcatcgtcgggggcaacttcgcccccatctacgtgcccaccctggacgacttccgctccatggaggccttcacgggcatcttccggagcccgcacggggaggaccacgacctggcgggcgaggagatcgcctcctacagcatcgtcgggcccgccaacgccaaggtgccccactccgccagctccgacaccctcagcctgatcgcgtactccggcatccccagctactccagcctgtccatcctcaccagctccaccgaggccaagcacgtgttcagcccgggcctgttccccaagctgaaccacacgaactgcgacaagtccgccatccccctcacctggaccgggatgatcgacctgcccggctactacgaggccatccacccgtgcaccgtcttctgcgtgctgagcgggcccggcgcctcctgcgaggcgttcagcgaggggggcatcttcaacatcacgagccccatgtgcctcgtgtccaagcagaaccgcttccggctgaccgagcagcaggtcaacttcgtgtgccagcgcgtggacatggacatcgtcgtgtactgcaacggccagcggaaggtgatcctgaccaagaccctcgtcatcgggcagtgcatctacacgatcaccagcctgttctccctgctccccggcgtggcccacagcatcgccgtggagctgtgcgtcccggggttccacggctgggccaccgccgcgctgctcgtgaccttctgcttcgggtgggtgctgatccccgccatcacgttcatcatcctgaccgtcctcaagttcgtggccaacatcttccacacctccaaccaggagaaccgcctgaagagcgtgctgcggaagatcaaggaggagttcgagaagaccaagggctccatggtctgcgacgtgtgcaagtacgagtgcgagacgtacaaggagctcaaggcccacggcgtgagctgcccccagtcccagtgcccctactgcttcacccactgcgagccgaccgaggccgcgttccaggcccactacaaggtctgccaggtgacccaccgcttccgggacgacctgaagaagaccgtgacgccccagaacttcacccccgggtgctaccgcaccctgaacctcttccggtacaagagccgctgctacatcttcaccatgtgggtcttcctgctgatcctcgagtccgtgctgtgggccgccagcgcgtccgagacgccgctgacccccgtgtggaacgacaacgcccacggcgtcgggagcgtgcccatgcacaccgacctcgagctggacttctccctgaccagctccagcaagtacacgtaccggcgcaagctgaccaaccccctcgaggaggcccagagcatcgacctgcacatcgagatcgaggagcagaccatcggcgtggacgtccacgccctggggcactggttcgacggccggctcaacctgaagacctccttccactgctacggcgcctgcacgaagtacgagtacccgtggcacaccgcgaagtgccactacgagcgcgactaccagtacgagaccagctgggggtgcaacccctccgactgccccggcgtggggaccggctgcacggcctgcggcctgtacctcgaccagctgaagcccgtggggagcgcctacaagatcatcaccatccgctactcccggcgcgtctgcgtgcagttcggcgaggagaacctgtgcaagatcatcgacatgaacgactgcttcgtgagccggcacgtcaaggtgtgcatcatcgggaccgtgtccaagttcagccagggcgacaccctcctgttcttcgggccgctggagggcggcgggctcatcttcaagcactggtgcacgtccacctgccagttcggcgaccccggggacatcatgagcccccgcgacaagggcttcctgtgccccgagttcccggggtccttccggaagaagtgcaacttcgccaccacccccatctgcgagtacgacggcaacatggtcagcggctacaagaaggtgatggccacgatcgactccttccagagcttcaacacctccaccatgcacttcaccgacgagcgcatcgagtggaaggaccccgacgggatgctgcgggaccacatcaacatcctcgtgacgaaggacatcgacttcgacaacctgggcgagaacccctgcaagatcgggctgcagaccagctccatcgagggcgcgtgggggagcggcgtcggcttcaccctcacctgcctggtgtccctgacggagtgcccgaccttcctcaccagcatcaaggcctgcgacaaggccatctgctacggggccgagagcgtgaccctgacgcgcggccagaacaccgtcaaggtgtccgggaagggcgggcacagcggctccaccttcaagtgctgccacggcgaggactgcagccagatcgggctgcacgccgcggccccccacctcgacaaggtgaacggcatctccgagatcgagaacagcaaggtctacgacgacggggccccccagtgcggcatcaagtgctggttcgtgaagtccggcgagtggatcagcgggatcttctccggcaactggatcgtcctgatcgtgctgtgcgtgttcctcctgttcagcctggtcctcctgtccatcctgtgccccgtgcggaagcacaagaagagctga

SEQ ID NO: 11695 - RNA, 3408 nt, synthetic construct
  misc_feature 1..3408: note = derived and/or modified CDS sequence (opt1) from HTNV(CBAa11-26)__KC576786.1__GP
  source 1..3408: mol_type = other RNA
atgggcatgtggaagtggctggtgatcgccagcctcgtctggcccgccctgaccctgcgcaacgtgtacgacatgaagatcgagtgcccgcacaccgtgtccttcggggagaacagcgtcatcggctacgtggagctcccccccatgcccctggcggacacggcccagatggtgccggagtccagctgctccatggacaaccaccagagcatgaacaccatcaccaagtacacccaggtcatctggcgggggaaggccgaccccggccagtccagccagaactccttcgagacggtgagcaccgagatcgacctgaaggggacctgcgtgctcaagcacaagatggtcgaggagtcctaccgcagccggaagtccatcacctgctacgacctgagctgcaactccacgtactgcaagcccaccctgtacatgatcgtgcccatccacgcctgcaacatgatgaagagctgcctcatcgccctgggcccgtaccgcgtgcaggtcgtgtacgagcggacctactgcatgaccggcgtgctgatcgaggggaagtgcttcgtccccgaccagtccgtggtgagcatcatcaagcacggcatcttcgacatcgcgtccgtccacatcgtgtgcttcttcgtggccgtcaaggggaacacgtacaagctcttcgagcaggtgaagaagagcttcgagagcacctgcaacgacaccgagaacaaggtgcagggctactacatctgcatcgtcgggggcaactccgcccccatctacgtgcccaccctggacgacttccgcagcatggaggccttcacgggcatcttccggtccccgcacggggaggaccacgacctggcgggcgaggagatcgccagctactccatcgtcgggcccgccaacgccaaggtgccccacagcgcctccagcgacaccctctccctgatcgcgtacagcggcatcccctcctacagctccctgagcatcctcacctccagcaccgaggccaagcacgtgttctccccgggcctgttccccaagctgaaccacacgaactgcgacaagagcgccatccccctcacctggaccgggatgatcgacctgcccggctactacgaggccatccacccgtgcaccgtcttctgcgtgctgtccgggcccggcgccagctgcgaggcgttcagcgaggggggcatcttcaacatcacgtcccccatgtgcctcgtgagcaagcagaaccgcttccggctgaccgagcagcaggtcaacttcgtgtgccagcgcgtggacatggacatcgtcgtgtactgcaacggccagcggaaggtgatcctgaccaagaccctcgtcatcgggcagtgcatctacacgatcacctccctgttcagcctgctccccggcgtggcccactccatcgccgtggagctgtgcgtcccggggttccacggctgggccaccgccgcgctgctcgtgaccttctgcttcgggtgggtgctgatccccgccatcacgttcatcatcctgaccgtcctcaagttcgtggccaacatcttccacaccagcaaccaggagaaccgcctgaagtccgtgctgcggaagatcaaggaggagttcgagaagaccaagggcagcatggtctgcgacgtgtgcaagtacgagtgcgagacgtacaaggagctcaaggcccacggcgtgtcctgcccccagagccagtgcccctactgcttcacccactgcgagccgaccgaggccgcgttccaggcccactacaaggtctgccaggtgacccaccgcttccgggacgacctgaagaagaccgtgacgccccagaacttcacccccgggtgctaccgcaccctgaacctcttccggtacaagtcccgctgctacatcttcaccatgtgggtcttcctgctgatcctcgagagcgtgctgtgggccgcctccgcgagcgagacgccgctgacccccgtgtggaacgacaacgcccacggcgtcgggtccgtgcccatgcacaccgacctcgagctggacttcagcctgacctccagcagcaagtacacgtaccggcgcaagctgaccaaccccctcgaggaggcccagtccatcgacctgcacatcgagatcgaggagcagaccatcggcgtggacgtccacgccctggggcactggttcgacggccggctcaacctgaagaccagcttccactgctacggcgcctgcacgaagtacgagtacccgtggcacaccgcgaagtgccactacgagcgcgactaccagtacgagacctcctgggggtgcaaccccagcgactgccccggcgtggggaccggctgcacggcctgcggcctgtacctcgaccagctgaagcccgtggggtccgcctacaagatcatcaccatccgctacagccggcgcgtctgcgtgcagttcggcgaggagaacctgtgcaagatcatcgacatgaacgactgcttcgtgtcccggcacgtcaaggtgtgcatcatcgggaccgtgagcaagttctcccagggcgacaccctcctgttcttcgggccgctggagggcggcgggctcatcttcaagcactggtgcacgagcacctgccagttcggcgaccccggggacatcatgtccccccgcgacaagggcttcctgtgccccgagttcccggggagcttccggaagaagtgcaacttcgccaccacccccatctgcgagtacgacggcaacatggtctccggctacaagaaggtgatggccacgatcgacagcttccagtccttcaacaccagcaccatgcacttcaccgacgagcgcatcgagtggaaggaccccgacgggatgctgcgggaccacatcaacatcctcgtgacgaaggacatcgacttcgacaacctgggcgagaacccctgcaagatcgggctgcagacctccagcatcgagggcgcgtgggggtccggcgtcggcttcaccctcacctgcctggtgagcctgacggagtgcccgaccttcctcaccagcatcaaggcctgcgacaaggccatctgctacggggccgagtccgtgaccctgacgcgcggccagaacaccgtcaaggtgagcgggaagggcgggcactccggcagcaccttcaagtgctgccacggcgaggactgctcccagatcgggctgcacgccgcggccccccacctcgacaaggtgaacggcatcagcgagatcgagaactccaaggtctacgacgacggggccccccagtgcggcatcaagtgctggttcgtgaagagcggcgagtggatctccgggatcttcagcggcaactggatcgtcctgatcgtgctgtgcgtgttcctcctgttctccctggtcctcctgagcatcctgtgccccgtgcggaagcacaagaagtcctga

SEQ ID NO: 11696 - RNA, 3408 nt, synthetic construct
  misc_feature 1..3408: note = derived and/or modified CDS sequence (opt1) from HTNV(Fuyuan-Aa-145)__KJ857336.1__GP
  source 1..3408: mol_type = other RNA
atgggcatgtggaagtggctggtgatcgccagcctcgtctggcccgccctgtccctgcgcaacgtgtacgacatgaagatcgagtgcccgcacaccgtgagcttcggggagaactccgtcatcggctacgtggagctcccccccatgcccctggcggacaccgcccagatggtgccggagagctcctgcagcatggacaaccaccagtccatcaacacgatcaccaagtacacccaggtcatctggcgggggaaggccgaccccggccagagctcccagaacagcttcgagaccgtgtccacggaggtggacctgaaggggacctgcgtcctcaagcacaagatggtggaggagagctaccgctcccggaagagcatcacctgctacgacctgtcctgcaacagcaccttctgcaagcccacgctgtacatgatcgtgcccatccacgcctgcaacatgatgaagtcctgcctcatcgccctgggcccgtaccgcgtccaggtggtgtacgagcggacctactgcatgaccggcgtcctgatcgaggggaagtgcttcgtgcccgaccagagcgtggtctccatcatcaagcacggcatcttcgacatcgcgagcgtgcacgtggtctgcttcttcgtggccgtgaaggggaacacctacaagctcttcgagcaggtcaagaagagcttcgagtccacgtgcaacgacaccgagaacaaggtgcagggctactacatctgcatcgtcgggggcaacagcgcccccatctacgtgcccaccctggacgacttccgctccatggaggccttcaccggcatcttcaagagcccgcacggggaggaccacgacctggcgggcgaggagatcgcctcctacagcatcgtggggcccgccaacgccaaggtcccccactccgccagctccgacacgctcagcctgatcgcgtactccggcatccccagctactccagcctgtccatcctcaccagctccaccgacgccaagcacgtgttcagcccgggcctgttccccaagctgaaccacaccaactgcgacaagtccgccatccccctcacgtggaccgggatgatcgacctgcccggctactacgaggccatccacccgtgcaccgtgttctgcgtcctgagcgggcccggcgccagctgcgaggcgttctccgaggggggcatcttcaacatcaccagccccatgtgcctcgtgtccaagcagaaccggttccgcctgacggagcagcaggtgaacttcgtctgccagcgggtggacatggacatcgtggtctactgcaacggccagcgcaaggtgatcctgaccaagaccctcgtgatcgggcagtgcatctacaccatcacgagcctgttctccctgctccccggcgtcgcccacagcatcgccgtggagctgtgcgtgccggggttccacggctgggccaccgccgcgctgctcgtcaccttctgcttcgggtgggtgctgatccccgccgtgaccttcatcatcctgacggtcctcaagttcatcgccaacatcttccacacctccaaccaggagaaccggctgaagagcgtgctgcgcaagatcaaggaggagttcgagaagaccaagggctccatggtgtgcgacgtctgcaagtacgagtgcgagacctacaaggagctcaaggcccacggcgtgagctgcccccagtcccagtgcccctactgcttcacgcactgcgagccgaccgaggccgcgttccaggcccactacaaggtgtgccaggtcacccaccggttccgcgacgacctgaagaagaccgtgaccccccagaacttcacgcccgggtgctaccggaccctgaacctcttccgctacaagagccggtgctacatcttcaccatgtgggtgttcctgctgatcctcgagtccgtcctgtgggccgccagcgcgtccgagaccccgctgacgcccgtgtggaacgacaacgcccacggcgtggggagcgtccccatgcacaccgacctcgagctggacttctccctgaccagcagctccaagtacacctaccgccggaagctgacgaaccccctcgaggaggcccagagcatcgacctgcacatcgagatcgaggagcagaccatcggcgtggacgtgcacgccctggggcactggttcgacggccgcctcaacctgaagacctccttccactgctacggcgcctgcaccaagtacgagtacccgtggcacacggcgaagtgccactacgagcgggactaccagtacgagaccagctgggggtgcaacccctccgactgccccggcgtcgggaccggctgcaccgcctgcggcctgtacctcgaccagctgaagcccgtggggagcgcctacaagatcatcacgatccgctactcccgccgggtgtgcgtccagttcggcgaggagaacctgtgcaagatcatcgacatgaacgactgcttcgtgagccgccacgtgaaggtctgcatcatcgggaccgtgtccaagttcagccagggcgacaccctcctgttcttcgggccgctggagggcggcgggctcatcttcaagcactggtgcacctccacgtgccagttcggcgaccccggggacatcatgagcccccgggacaagggcttcctgtgccccgagttcccggggtccttccgcaagaagtgcaacttcgccaccacccccatctgcgagtacgacggcaacatggtgagcggctacaagaaggtcatggccaccatcgactccttccagagcttcaacacgtccaccatgcacttcaccgacgagcggatcgagtggaaggaccccgacgggatgctgcgcgaccacatcaacatcctcgtgaccaaggacatcgacttcgacaacctgggcgagaacccctgcaagatcgggctgcagacgagctccatcgagggcgcgtgggggagcggcgtgggcttcaccctcacctgcctggtcagcctgaccgagtgcccgacgttcctcacctccatcaaggcctgcgacaaggccatctgctacggggccgagagcgtgaccctgacccggggccagaacacggtgaaggtctccgggaagggcgggcacagcggctccaccttcaagtgctgccacggcgaggactgcagcaagatcgggctgcacgccgcggccccccacctcgacaaggtgaacggcatctccgagatcgagaacagcaaggtctacgacgacggggccccccagtgcggcatcaagtgctggttcgtgaagtccggcgagtggatcagcgggatcttctccggcaactggatcgtgctgatcgtcctgtgcgtgttcctcctgttcagcctggtgctcctgtccatcctgtgccccgtccgcaagcacaagaagagctga

SEQ ID NO: 11697 - RNA, 3408 nt, synthetic construct
  misc_feature 1..3408: note = derived and/or modified CDS sequence (opt1) from HTNV(Fuyuan-Aa-26)__KJ857334.1__GP
  source 1..3408: mol_type = other RNA
atgggcatgtggaagtggctggtgatcgccagcctcgtctggcccgccctgtccctgcgcaacgtgtacgacatgaagatcgagtgcccgcacaccgtgagcttcggggagaactccgtcatcggctacgtggagctcccccccatgcccctggcggacaccgcccagatggtgccggagagctcctgcagcatggacaaccaccagtccatcaacacgatcaccaagtacacccaggtcatctggcgggggaaggccgaccccggccagagctcccagaacagcttcgagaccgtgtccacggaggtggacctgaaggggacctgcgtcctcaagcacaagatggtggaggagagctaccgctcccggaagagcatcacctgctacgacctgtcctgcaacagcacctactgcaagcccacgctgtacatgatcgtgcccatccacgcctgcaacatgatgaagtcctgcctcatcgccctgggcccgtaccgcgtccaggtggtgtacgagcggacctactgcatgaccggcgtcctgatcgaggggaagtgcttcgtgcccgaccagagcgtggtctccatcatcaagcacggcatcttcgacatcgcgagcgtgcacatcgtgtgcttcttcgtcgccgtgaaggggaacacctacaagctcttcgagcaggtgaagaagagcttcgagtccacgtgcaacgacaccgagaacaaggtccagggctactacatctgcatcgtggggggcaacagcgcccccatctacgtccccaccctggacgacttccgctccatggaggccttcaccggcatcttcaagagcccgcacggggaggaccacgacctggcgggcgaggagatcgcctcctacagcatcgtggggcccgccaacgccaaggtgccccactccgccagctccgacacgctcagcctgatcgcgtactccggcatccccagctactccagcctgtccatcctcaccagctccaccgacgccaagcacgtcttcagcccgggcctgttccccaagctgaaccacaccaactgcgacaagtccgccatccccctcacgtggaccgggatgatcgacctgcccggctactacgaggccatccacccgtgcaccgtgttctgcgtgctgagcgggcccggcgccagctgcgaggcgttctccgaggggggcatcttcaacatcaccagccccatgtgcctcgtctccaagcagaaccggttccgcctgacggagcagcaggtgaacttcgtgtgccagcgggtcgacatggacatcgtggtgtactgcaacggccagcgcaaggtcatcctgaccaagaccctcgtgatcgggcagtgcatctacaccatcacgagcctgttctccctgctccccggcgtggcccacagcatcgccgtcgagctgtgcgtgccggggttccacggctgggccaccgccgcgctgctcgtgaccttctgcttcgggtgggtcctgatccccgccgtgaccttcatcatcctgacggtgctcaagttcatcgccaacatcttccacacctccaaccaggagaaccggctgaagagcgtcctgcgcaagatcaaggaggagttcgagaagaccaagggctccatggtgtgcgacgtgtgcaagtacgagtgcgagacctacaaggagctcaaggcccacggcgtcagctgcccccagtcccagtgcccctactgcttcacgcactgcgagccgaccgaggccgcgttccaggcccactacaaggtgtgccaggtgacccaccggttccgcgacgacctgaagaagaccgtcaccccccagaacttcacgcccgggtgctaccggaccctgaacctcttccgctacaagagccggtgctacatcttcaccatgtgggtgttcctgctgatcctcgagtccgtgctgtgggccgccagcgcgtccgagaccccgctgacgcccgtctggaacgacaacgcccacggcgtggggagcgtgcccatgcacaccgacctcgagctggacttctccctgaccagcagctccaagtacacctaccgccggaagctgacgaaccccctcgaggaggcccagagcatcgacctgcacatcgagatcgaggagcagaccatcggcgtcgacgtgcacgccctggggcactggttcgacggccgcctcaacctgaagacctccttccactgctacggcgcctgcaccaagtacgagtacccgtggcacacggcgaagtgccactacgagcgggactaccagtacgagaccagctgggggtgcaacccctccgactgccccggcgtggggaccggctgcaccgcctgcggcctgtacctcgaccagctgaagcccgtcgggagcgcctacaagatcatcacgatccgctactcccgccgggtgtgcgtgcagttcggcgaggagaacctgtgcaagatcatcgacatgaacgactgcttcgtcagccgccacgtgaaggtgtgcatcatcgggaccgtctccaagttcagccagggcgacaccctcctgttcttcgggccgctggagggcggcgggctcatcttcaagcactggtgcacctccacgtgccagttcggcgaccccggggacatcatgagcccccgggacaagggcttcctgtgccccgagttcccggggtccttccgcaagaagtgcaacttcgccaccacccccatctgcgagtacgacggcaacatggtgagcggctacaagaaggtgatggccaccatcgactccttccagagcttcaacacgtccaccatgcacttcaccgacgagcggatcgagtggaaggaccccgacgggatgctgcgcgaccacatcaacatcctcgtcaccaaggacatcgacttcgacaacctgggcgagaacccctgcaagatcgggctgcagacgagctccatcgagggcgcgtgggggagcggcgtgggcttcaccctcacctgcctggtgagcctgaccgagtgcccgacgttcctcacctccatcaaggcctgcgacaaggccatctgctacggggccgagagcgtcaccctgacccggggccagaacacggtgaaggtgtccgggaagggcgggcacagcggctccaccttcaagtgctgccacggcgaggactgcagcaagatcgggctgcacgccgcggccccccacctcgacaaggtcaacggcatctccgagatcgagaacagcaaggtgtacgacgacggggccccccagtgcggcatcaagtgctggttcgtcaagtccggcgagtggatcagcgggatcttctccggcaactggatcgtgctgatcgtgctgtgcgtcttcctcctgttcagcctggtgctcctgtccatcctgtgccccgtgcgcaagcacaagaagagctga

SEQ ID NO: 11698 - RNA, 3408 nt, synthetic construct
  misc_feature 1..3408: note = derived and/or modified CDS sequence (opt1) from HTNV(JS1)__KP970560.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcgggggcaacagcgtgatcgggtacgtggagctcccgcccgtccccctggccgacacggcccagatggtgcccgagtccagctgctccatggacaaccaccagagcctgaacaccatcgccaagtacacccaggtgtcctggcggggcaaggccgaccagagccagtccagccagaactccttcgagaccgtcagcacggaggtggacctcaaggggacctgcgtgctgaagcacaagatggtcgaggagtcctaccgcagccggaagtccgtgacctgctacgacctgagctgcaactccacctactgcaagcccacgctctacatgatcgtgcccatccacgcctgcaacatgatgaagtcctgcctgatcgccctgggcccctaccgcgtccaggtggtgtacgagcggacctactgcatgaccggcgtcctcatcgaggggaagtgcttcgtgccggaccagtccgtggtcagcatcatcaagcacggcatcttcgacatcgcgagcgtgcacatcgtgtgcttcttcgtcgccgtgaaggggaacacctacaagatcttcgagcaggtcaagaagtccttcgagagcacgtgcaacgacaccgagaacaaggtgcagggctactacatctgcatcgtcgggggcaactccgcccccatctacgtgcccaccctggacgacttccgcagcatggaggccttcaccggcatcttccggagcccccacggggaggaccacgacctggcgggcgaggagatcgcctcctactccatcgtggggccggccaacgccaaggtgccccacagcgcctccagcgacacgctctccctgatcgcgtacagcggcatcccctcctacagctccctgagcatcctcacctccagcaccgaggccaagcacgtcttctcccccggcctgttcccgaagctgaaccacaccaactgcgacaagagcgccatccccctcatctggacggggatgatcgacctgcccggctactacgaggccgtgcacccctgcaccgtgttctgcgtcctgagcgggccgggcgccagctgcgaggcgttcagcgagggcgggatcttcaacatcacctcccccatgtgcctcgtgagcaagcagaaccgcttccggctgaccgagcagcaggtcaacttcgtgtgccagcgcgtggacatggacatcgtggtctactgcaacggccagcggaaggtgatcctgacgaagaccctcgtgatcgggcagtgcatctacaccatcacctccctgttcagcctgctccccggcgtcgcccactccatcgccgtggagctgtgcgtgcccgggttccacggctgggccacggccgcgctgctcgtcaccttctgcttcgggtgggtgctgatcccggccatcaccttcatcatcctgaccgtgctcaagttcatcgccaacatcttccacacgagcaaccaggagaaccgcctgaagtccgtcctgcggaagatcaaggaggagttcgagaagaccaagggcagcatggtgtgcgacgtgtgcaagtacgagtgcgagacctacaaggagctcaaggcccacggcgtctcctgcccccagagccagtgcccctactgcttcacccactgcgagcccacggaggccgcgttccaggcccactacaaggtgtgccaggtgacccaccgcttccgggacgacctgaagaagaccgtcaccccgcagaacttcacccccgggtgctaccgcacgctgaacctcttccggtacaagtcccgctgctacatcttcaccatgtggatcttcctgctggtgctcgagagcatcctgtgggccgcctccgcgagcgagacgcccctgaccccggtgtggaacgacaacgcccacggcgtcgggtccgtgcccatgcacaccgacctcgagctggacttcagcctgaccagctccagcaagtacacctaccggcgcaagctgaccaaccccctcgaggaggcccagtccatcgacctgcacatcgagatcgaggagcagacgatcggcgtggacgtccacgccctggggcactggttcgacggccggctcaacctgaagaccagcttccactgctacggcgcctgcaccaagtacgagtacccctggcacaccgcgaagtgccactacgagcgcgactaccagtacgagacgtcctgggggtgcaacccgagcgactgccccggcgtggggaccggctgcaccgcctgcggcctgtacctcgaccagctgaagcccgtggggtccgcctacaagatcatcaccatccgctacagccggcgcgtctgcgtgcagttcggcgaggggaacctgtgcaagatcatcgacatgaacgactgcttcgtgtcccggcacgtcaaggtgtgcatcatcggcacggtgagcaagttctcccagggggacaccctcctgttcttcggccccctggagggcgggggcctcatcttcaagcactggtgcacctccacgtgccagttcggggacccgggcgacatcatgagcccccgcgacaaggggttcctgtgccccgagttccccggcagcttccggaagaagtgcaacttcgccaccaccccgatctgcgagtacgacggcaacatggtctccgggtacaagaaggtgatggccaccatcgacagcttccagtccttcaacaccagcacgatgcacttcaccgacgagcgcatcgagtggaaggaccccgacggcatgctgcgggaccacatcaacatcctcgtgaccaaggacatcgacttcgacaacctgggggagaacccctgcaagatcggcctgcagacctccagcatcgagggggcgtggggcagcggcgtcgggttcacgctgacctgcctcgtgtccctgaccgagtgccccaccttcctcacgagcatcaaggcctgcgacaaggccatctgctacggcgccgagtccgtgaccctgacccgcgggcagaacaccgtcaaggtgagcggcaagggcgggcactccggcagcacgttcaagtgctgccacggggaggactgctcccagatcggcctgcacgccgcggccccgcacctcgacaaggtcaacgggatcagcgagatcgagaactccaaggtgtacgacgacggcgcgccccagtgcggcatcaagtgctggttcgtcaagagcggggagtggatctccggcatcttcagcgggaactggatcgtgctgatcgtgctgtgcgtgttcctcctgttctccctggtcctcctgagcatcctgtgccccgtgcggaagcacaagaagtcctga

SEQ ID NO: 11699 - RNA, 3408 nt, synthetic construct
  misc_feature 1..3408: note = derived and/or modified CDS sequence (opt1) from HTNV(LongquanAa-08-150)__JQ912803.1__GP
  source 1..3408: mol_type = other RNA
atgggcatctggaagtggctggtgatggccagcctcgtctggcccgccttcaccctgcgcaacgtgtacgacatgaagatcgagtgcccgcacaccgtgtccttcggggagaacagcgtcatcggctacgtggagctgccgcccatgcccctcgccgacacggcccagatggtgcccgagtccagctgcaacatggacaaccaccagtccatgaacaccatcaccaagtacacccaggtcagctggcgggggaaggccgaccaggcccaggcctcccagaacagcttcgaggcggtgtccgccgaggtggacctgaagggcatctgcgtcctgaagcacaagatgctcgaggagagctaccgctcccggaagtccatcacgtgctacgacctgtcctgcaacagcacctactgcaagcccaccctgtacatgatcgtgcccatccacgcctgcaacatgatgaagtcctgcctcatcgccctggggccctaccgcgtgcaggtcgtgtacgagcggacctactgcatgacgggcgtgctgctcgagggcaagtgcttcgtcccggaccagagcgtggtgtccatcatcaagcacgggatcttcgacatcgcgagcgtccacatcgtgtgcttcttcgtggccgtcaagggcaacacctacaagctgctggagcaggtcaagaagtccttccagagcacgtgcaacgacaccgagaacaaggtgcaggggtactacatctgcatcgtgggcgggaacagcgcccccatctacgtgcccaccctcgacgacttccgctccatggaggccttcagcggcatcttccggagcccccacggcgaggaccacgacctggccggggaggagatcgcgagctactccatcgtcggcccggccaacgccaaggtgccccacagcgcctccagcgacaccctgtccctcatcgcctacagcgggatcccctcctacagctccctgagcatcctggcgtccagcaccgaggccaagcacgtgttctcccccggcttcttcccgcagctcaaccacaccaagtgcgacaagacggccatccccctgatctggaccggcatgatcgacctgcccgggtactacgaggccatccacccctgcaccgtcttctgcgtgctcagcggcccgggggcctcctgcgaggcgttcagcgagggcgggatcttcaacatcaccagccccatgtgcctggtgtccaagcagaaccgcttccggctgacggagcagcaggtcaacttcgtgtgccagcgcgtggacgtcgacatcatcgtgtactgcaacggccagcggaaggtgatcctcaccaagaccctggtcatcggccagtgcatctacaccatcacgagcctgttctccctcctgcccggggtggcccacagcatcgccgtggagctgtgcgtccccggcttccacgggtgggccaccgccgcgctcctggtgaccttctgcttcggctgggtgctgatcccggccctcaccctgatcatcctgacgatcctcaagttcatcgccaacatcttccacacgtgcaaccaggagaaccgcctgaagtccgtcctgcggaagatcaaggaggagttcgagaagaccaaggggagcatggtgtgcgacgtgtgcaagtacgagtgcgagacctacaaggagctcaaggcccacggcgtctcctgcccccagagccagtgcccctactgcttcacccactgcgagcccaccgaggcggccttccaggcccactaccgcgtgtgccaggtgacccaccggttccgcgacgacctgaagaagaccgtcacgccgcagaacttcacccccggctgctaccggaccctgaacctcttccgctacaagtcccggtgctacatcttcaccatgtgggtgtgcctgctggtgctcgagagcatcctgtgggccgcctccgcgagcgaggtccccctgaacccggtgtggaacgacaacgcccacggggtgggctccgtccccatgcacaccgacctggagctcgacttcagcctgacgtccagctccaagtacacctaccgccggcgcctgaccaaccccctcgaggagacccagagcatcaacctgcacatcgagatcgaggagcagacgatcggggtggacgtgcacgccctgggccactggttcgacgggcgcctcaacctgaagaccagcttccactgctacggcgcctgcaccaagtacgagtacccctggcacaccgccaagtgccactacgagcgggactaccagtacgagacgtcctggggctgcaacccggcggactgccccggggtcggcaccgggtgcaccgcctgcggcctgtacctcgaccagctgaagcccgtgggcagcgcctacaagatcatcaccatccgctactcccggaaggtgtgcgtccagttcggggaggagaacctgtgcaaggtgatcgacatgaacgactgcttcgtgacgcgccacgtcaaggtgtgcatcatcggcaccgtgagcaagttctcccagggggacaccctcctgttcttcggccccctggagggcgggggcctcatcttcaagcactggtgcaccagcacgtgccagttcggggacccgggcgacatcatgagcccccgggacaaggggttcctgtgccccgagttccccggcagcttccgcaagaagtgcaacttcgccaccaccccgctgtgcgagtacgacgggaacatggtctccggctacaagaaggtgatggccaccatcgacagcttccagtccttcaacacgagcaccatgcacttcaccgacgagcggatcgagtggaaggaccccgacggcatgctccgcgaccacatcaacatcctggtgaccaaggacatcgacttcgacaacctgggggagaacccctgcaagatcggcctccagacgtccagcatcgagggggcgtggggctccggggtcggcttcaccctgacctgcctgatcagcctcaccgagtgccccacgttcctgacctccatcaaggcctgcgacaaggccatctgctacggcgccgagagcgtgaccctgacccgggggcagaacacggtgaaggtctccggcaagggcgggcacagcgggagcaccttcaagtgctgccacggcgaggagtgctcccagatcggcctccacgcggccgccccgcacctggacaaggtgaacgggatcagcgagatcgagaacaacaaggtgtacgacgacggcgcgccccagtgcggggtcaagtgctggttcgtgaagtccggcgagtggatcagcggcatcttctccgggaactggatcgtcctgatcgtgctctgcgtgttcctgctgttcagcctcgtcctgctgtccgtgctctgccccgtgcgcaagcacaagaagtcctga

SEQ ID NO: 11700 - RNA, 3408 nt, synthetic construct
  misc_feature 1..3408: note = derived and/or modified CDS sequence (opt1) from HTNV(LongquanAa-08-157)__JQ912804.1__GP
  source 1..3408: mol_type = other RNA
atggagatctggaagtggctggtgatggccagcctcgtctggcccgccttcaccctgcgcaacgtgtacgacatgaagatcgagtgcccgcacaccgtgtccttcggcgagaacagcgtcatcgggtacgtggagctgtcccccatgcccctcgcggacacggcccagatggtgcccgagagctcctgcaacatggacaaccaccagagcatgaacaccatcaccaagtacacccaggtctcctggcggggcaaggccgaccaggcccaggccagccagaactccttcgaggcggtgagcgccgaggtggacctgaaggggacgtgcgtcctgaagcacaagatgctcgaggagtcctaccgcagccggaagtccatcacctgctacgacctgagctgcaactccacctactgcaagccgaccctgtacatgatcgtgcccatccacgcctgcaacatgatgaagagctgcctcatcgccctgggcccctaccgcgtgcaggtcgtgtacgagcggacgtactgcatgaccggggtgctgatcgagggcaagtgcttcgtccccgaccagtccgtggtgagcatcatcaagcacggcatcttcgacatcgcgtccgtccacatcgtgtgcttcttcgtggccgtcaaggggaacacctacaagctcttcgagcaggtgaagaagagcttccagagcacctgcaacggcacggagaacaaggtgcaggggtactacatctgcatcgtcggcgggaactccgccccgatctacgtgcccaccctggacgacttccgcagcatggaggccttctccggcatcttccggagcccccacggcgaggaccacgacctggccggggaggagatcgcgtcctacagcatcgtcggccccgccaacgccaaggtgccgcactccgccagctccgacaccctcagcctgatcgcctactccgggatccccagctactccagcctgtccatcctcgcgagctccaccgaggccaagcacgtgttcagccccggcttcttcccccagctgaaccacacgaagtgcgacaagaccgccatcccgctgacctggaccggcatgatcgacctccccgggtactacgaggccatccacccctgcacggtcttctgcgtgctgtccggccccggggccagctgcgaggcgttcagcgagggcgggatcttcaacatcacctccccgatgtgcctggtgagcaagcagaaccgcttccggctcaccgagcagcaggtcaacttcgtgtgccagcgcgtggacatggacatcatcgtctactgcaacggccagcggaaggtgatcctgaccaagacgctggtgatcggccagtgcatctacaccatcacctccctcttcagcctgctgcccggggtcgcccactccatcgccgtggagctctgcgtgcccggcttccacgggtgggccaccgccgcgctgctggtcacgttctgcttcggctgggtgctcatccccgccctgaccctgatcatcctcaccatcctgaagttcatcgccaacctgttccacaccagcaaccaggagaaccgcctcaagtccgtgctgcggaagatcaaggaggagttcgagaagacgaaggggagcatggtctgcgacgtgtgcaagtacgagtgcgagacctacaaggagctgaaggcccacggcgtgtcctgcccgcagagccagtgcccctactgcttcacccactgcgagcccaccgaggcggccttccaggcccactaccgcgtctgccaggtgacgcaccggttccgcgacgacctcaagaagaccgtgaccccccagaacttcaccccgggctgctaccggaccctgaacctgttccgctacaagtcccggtgctacatcttcacgatgtgggtctgcctcctggtgctggagagcatcctctgggccgcctccgcgagcgaggtgcccctgaaccccgtctggaacgacaacgcccacggggtgggctccgtgccgatgcacaccgacctggagctggacttcagcctcacctccagcagcaagtacacctaccgccggcgcctgacgaaccccctggaggagacccagtccatcaacctccacatcgagatcgaggagcagaccatcggggtcgacgtgcacgccctgggccactggttcgacgggcgcctgaacctcaagaccagcttccactgctacggcgcctgcacgaagtacgagtacccctggcacaccgccaagtgccactacgagcgggactaccagtacgagacctcctggggctgcaaccccgcggactgcccgggggtgggcaccgggtgcacggcctgcggcctgtacctggaccagctcaagcccgtcggcagcgcctacaagatcatcaccatccgctactcccggaaggtgtgcgtgcagttcggggaggagaacctgtgcaaggtcatcgacatgaacgactgcttcgtgacccgccacgtgaaggtctgcatcatcggcaccgtgagcaagttctcccagggggacacgctgctcttcttcggccccctggaggggggcggcctgatcttcaagcactggtgcaccagcacctgccagttcggggaccccggcgacatcatgtccccgcgggacaaggggttcctctgccccgagttccccggcagcttccgcaagaagtgcaacttcgccaccacgcccctgtgcgagtacgacgggaacatggtgtccggctacaagaaggtcatggccaccatcgacagcttccagtccttcaacaccagcaccatgcacttcacggacgagcggatcgagtggaaggacccggacggcatgctgcgcgaccacatcaacatcctcgtgaccaaggacatcgacttcgacaacctgggggagaacccctgcaagatcggcctgcagacctccagcatcgagggggcgtggggctccggggtgggcttcaccctcacgtgcctgatcagcctgaccgagtgccccaccttcctcacctccatcaaggcctgcgacaaggccatctgctacggcgccgagagcgtcacgctgacccgggggcagaacaccgtgaaggtgagcggcaaggggggccactccgggagcaccttcaagtgctgccacggcgaggagtgctcccagatcggcctgcacgcggccgccccccacctcgacaaggtcaacgggatcagcgagatcgagaacaacaaggtgtacgacgacggcgccccgcagtgcggggtgaagtgctggttcgtcaagtccggcgagtggatcagcggcatcttctccgggaactggatcgtgctgatcgtcctgtgcgtgttcctcctgttcagcctggtgctcctgtccgtcctgtgccccgtgcgcaagcacaagaagagctga

SEQ ID NO: 11701 - RNA, 3408 nt, synthetic construct
  misc_feature 1..3408: note = derived and/or modified CDS sequence (opt1) from HTNV(LongquanAa-08-196)__JQ912805.1__GP
  source 1..3408: mol_type = other RNA
atggagatctggaagtggctggtgatggccagcctcgtctggcccgccttcaccctgcgcaacgtgtacgacatgaagatcgagtgcccgcacaccgtgtccttcggcgagaacagcgtcatcgggtacgtggagctgccgcccatgcccctcgccgacacggcccagatggtgcccgagtccagctgcaacatggacaaccaccagtccatgaacaccatcaccaagtacacccaggtcagctggcggggcaaggccgaccaggcccaggcctcccagaacagcttcgaggcggtgtccgccgaggtggacctgaaggggacgtgcgtcctgaagcacaagatgctcgaggagagctaccgctcccggaagtccatcacgtgctacgacctgtcctgcaacagcacctactgcaagcccaccctgtacatgatcgtgcccatccacgcctgcaacatgatgaagtcctgcctcatcgccctgggcccctaccgcgtgcaggtcgtgtacgagcggacctactgcatgaccggggtgctgatcgagggcaagtgcttcgtcccggaccagagcgtggtgtccatcatcaagcacggcatcttcgacatcgcgagcgtccacatcgtgtgcttcttcgtggccgtcaaggggaacacctacaagctgttcgagcaggtcaagaagtccttccagagcacgtgcaacggcaccgagaacaaggtgcaggggtactacatctgcatcgtgggcgggaacagcgcccccatctacgtgcccaccctggacgacttccgctccatggaggccttcagcggcatcttccggagcccccacggcgaggaccacgacctggccggggaggagatcgcgagctactccatcgtcggcccggccaacgccaaggtgccccacagcgcctccagcgacaccctctccctgatcgcctacagcgggatcccctcctacagctccctgagcatcctcgcgtccagcaccgaggccaagcacgtgttctcccccggcttcttcccgcagctgaaccacacgaagtgcgacaagaccgccatccccctgacctggaccggcatgatcgacctccccgggtactacgaggccatccacccctgcacggtcttctgcgtgctgagcggcccgggggcctcctgcgaggcgttcagcgagggcgggatcttcaacatcaccagccccatgtgcctggtgtccaagcagaaccgcttccggctcaccgagcagcaggtcaacttcgtgtgccagcgcgtggacatggacatcatcgtctactgcaacggccagcggaaggtgatcctgaccaagacgctggtgatcggccagtgcatctacaccatcaccagcctcttctccctgctgcccggggtcgcccacagcatcgccgtggagctctgcgtgcccggcttccacgggtgggccaccgccgcgctgctggtcacgttctgcttcggctgggtgctcatcccggccctgaccctgatcatcctcaccatcctgaagttcatcgccaacatcttccacacctccaaccaggagaaccgcctcaagagcgtgctccggaagatcaaggaggagttcgagaagacgaaggggtccatggtctgcgacgtgtgcaagtacgagtgcgagacctacaaggagctgaaggcccacggcgtgagctgcccccagtcccagtgcccctactgcttcacccactgcgagcccaccgaggcggccttccaggcccactaccgcgtctgccaggtgacgcaccggttccgcgacgacctgaagaagaccgtgaccccgcagaacttcacccccggctgctaccggaccctcaacctgttccgctacaagagccggtgctacatcttcacgatgtgggtctgcctgctcgtgctggagtccatcctgtgggccgccagcgcgtccgaggtgcccctcaacccggtctggaacgacaacgcccacggggtgggcagcgtgcccatgcacaccgacctggagctggacttctccctgaccagctccagcaagtacacctaccgccggcgcctcacgaaccccctggaggagacccagagcatcaacctgcacatcgagatcgaggagcagaccatcggggtcgacgtgcacgccctcggccactggttcgacgggcgcctgaacctgaagacctccttccactgctacggcgcctgcacgaagtacgagtacccctggcacaccgccaagtgccactacgagcgggactaccagtacgagaccagctggggctgcaacccggcggactgccccggggtgggcaccgggtgcacggcctgcggcctctacctggaccagctgaagcccgtcggctccgcctacaagatcatcaccatccgctacagccggaaggtgtgcgtgcagttcggggaggagaacctctgcaaggtcatcgacatgaacgactgcttcgtgacccgccacgtgaaggtctgcatcatcggcaccgtgtccaagttcagccagggggacacgctgctgttcttcggccccctcgagggcgggggcctgatcttcaagcactggtgcacctccacgtgccagttcggggacccgggcgacatcatgagcccccgggacaaggggttcctgtgccccgagttccccggctccttccgcaagaagtgcaacttcgccaccaccccgctctgcgagtacgacgggaacatggtgagcggctacaagaaggtcatggccaccatcgactccttccagagcttcaacacctccaccatgcacttcacggacgagcggatcgagtggaaggaccccgacggcatgctgcgcgaccacatcaacatcctggtgaccaaggacatcgacttcgacaacctcggggagaacccctgcaagatcggcctgcagaccagctccatcgagggggcgtggggcagcggggtgggcttcaccctgacgtgcctcatctccctgaccgagtgccccaccttcctgaccagcatcaaggcctgcgacaaggccatctgctacggcgccgagtccgtcacgctcacccgggggcagaacaccgtgaaggtgagcggcaagggcgggcacagcgggtccaccttcaagtgctgccacggcgaggagtgcagccagatcggcctgcacgcggccgccccgcacctggacaaggtcaacgggatctccgagatcgagaacaacaaggtgtacgacgacggcgcgccccagtgcggggtgaagtgctggttcgtcaagagcggcgagtggatctccggcatcttcagcgggaactggatcgtgctcatcgtcctgtgcgtgttcctcctgttctccctggtgctgctcagcgtcctgtgccccgtgcgcaagcacaagaagtcctga

SEQ ID NO: 11702 - RNA, 3408 nt, synthetic construct
  misc_feature 1..3408: note = derived and/or modified CDS sequence (opt1) from HTNV(LongquanAa-08-235)__JQ912810.1__GP
  source 1..3408: mol_type = other RNA
atggagatctggaagtggctggtgatggccagcctcgtctggcccgccttcaccctgcgcaacgtgtacgacatgaagatcgagtgcccgcacaccgtgtccttcggcgagaacagcgtcatcgggtacgtggagctgccgcccatgcccctcgccgacacggcccagatggtgcccgagtccagctgcaacatggacaaccaccagtccatgaacaccatcaccaagtacacccaggtcagctggcggggcaaggccgaccaggcccaggcctcccagaacagcttcgaggcggtgtccgccgaggtggacctgaaggggacgtgcgtcctgaagcacaagatgctcgaggagagctaccgctcccggaagtccatcacgtgctacgacctgtcctgcaacagcacctactgcaagcccaccctgtacatgatcgtgcccatccacgcctgcaacatgatgaagtcctgcctcatcgccctgggcccctaccgcgtgcaggtcgtgtacgagcggacctactgcatgaccggggtgctgatcgagggcaagtgcttcgtcccggaccagagcgtggtgtccatcatcaagcacggcatcttcgacatcgcgagcgtccacatcgtgtgcttcttcgtggccgtcaaggggaacacctacaagctgttcgagcaggtcaagaagtccttccagagcacgtgcaacggcaccgagaacaaggtgcaggggtactacatctgcatcgtgggcgggaacagcgcccccatctacgtgcccaccctggacgacttccgctccatggaggccttcagcggcatcttccggagcccccacggcgaggaccacgacctggccggggaggagatcgcgagctactccatcgtcggcccggccaacgccaaggtgccccacagcgcctccagcgacaccctctccctgatcgcctacagcgggatcccctcctacagctccctgagcatcctcgcgtccagcaccgaggccaagcacgtgttctcccccggcttcttcccgcagctgaaccacacgaagtgcgacaagaccgccatccccctgacctggaccggcatgatcgacctccccgggtactacgaggccatccacccctgcacggtcttctgcgtgctgagcggcccgggggcctcctgcgaggcgttcagcgagggcgggatcttcaacatcaccagccccatgtgcctggtgtccaagcagaaccgcttccggctcaccgagcagcaggtcaacttcgtgtgccagcgcgtggacatggacatcatcgtctactgcaacggccagcggaaggtgatcctgaccaagacgctggtgatcggccagtgcatctacaccatcaccagcctcttctccctgctgcccggggtcgcccacagcatcgccgtggagctctgcgtgcccggcttccacgggtgggccaccgccgcgctgctggtcacgttctgcttcggctgggtgctcatcccggccctgaccctgatcatcctcaccatcctgaagttcatcgccaacatcttccacacctccaaccaggagaaccgcctcaagagcgtgctccggaagatcaaggaggagttcgagaagacgaaggggtccatggtctgcgacgtgtgcaagtacgagtgcgagacctacaaggagctgaaggcccacggcgtgagctgcccccagtcccagtgcccctactgcttcacccactgcgagcccaccgaggcggccttccaggcccactaccgcgtctgccaggtgacgcaccggttccgcgacgacctgaagaagaccgtgaccccgcagaacttcacccccggctgctaccggaccctcaacctgttccgctacaagagccggtgctacatcttcacgatgtgggtctgcctgctcgtgttcgagtccatcctgtgggccgccagcgcgtccgaggtgcccctgaacccggtctggaacgacaacgcccacggggtgggcagcgtgcccatgcacaccgacctcgagctggacttctccctgaccagctccagcaagtacacctaccgccggcgcctgacgaaccccctcgaggagacccagagcatcaacctgcacatcgagatcgaggagcagaccatcggggtcgacgtgcacgccctgggccactggttcgacgggcgcctcaacctgaagacctccttccactgctacggcgcctgcacgaagtacgagtacccctggcacaccgccaagtgccactacgagcgggactaccagtacgagaccagctggggctgcaacccggcggactgccccggggtgggcaccgggtgcacggcctgcggcctgtacctcgaccagctgaagcccgtcggctccgcctacaagatcatcaccatccgctacagccggaaggtgtgcgtgcagttcggggaggagaacctgtgcaaggtcatcgacatgaacgactgcttcgtgacccgccacgtgaaggtctgcatcatcggcaccgtgtccaagttcagccagggggacacgctcctgttcttcggccccctggagggcgggggcctcatcttcaagcactggtgcacctccacgtgccagttcggggacccgggcgacatcatgagcccccgggacaaggggttcctgtgccccgagttccccggctccttccgcaagaagtgcaacttcgccaccaccccgctgtgcgagtacgacgggaacatggtgagcggctacaagaaggtcatggccaccatcgactccttccagagcttcaacacctccaccatgcacttcacggacgagcggatcgagtggaaggaccccgacggcatgctccgcgaccacatcaacatcctggtgaccaaggacatcgacttcgacaacctgggggagaacccctgcaagatcggcctccagaccagctccatcgagggggcgtggggcagcggggtgggcttcaccctgacgtgcctgatctccctcaccgagtgccccaccttcctgaccagcatcaaggcctgcgacaaggccatctgctacggcgccgagtccgtcacgctgacccgggggcagaacaccgtgaaggtgagcggcaagggcgggcacagcgggtccaccttcaagtgctgccacggcgaggagtgcagccagatcggcctccacgcggccgccccgcacctggacaaggtcaacgggatctccgagatcgagaacaacaaggtgtacgacgacggcgcgccccagtgcggggtgaagtgctggttcgtcaagagcggcgagtggatctccggcatcttcagcgtgaactggatcgtcctgatcgtgctctgcgtgttcctgctgttctccctcgtcctgctgagcgtgctctgccccgtgcgcaagcacaagaagtcctga

SEQ ID NO: 11703 - RNA, 3408 nt, synthetic construct
  misc_feature 1..3408: note = derived and/or modified CDS sequence (opt1) from HTNV(LongquanAa-09-171)__JQ912824.1__GP
  source 1..3408: mol_type = other RNA
atggagatctggaagtggctggtgatggccagcctcgtctggcccgccttcaccctgcgcaacgtgtacgacatgaagatcgagtgcccgcacaccgtgtccttcggcgagaacagcgtcatcgggtacgtggagctgccccccatgcccctcgcggacacggcccagatggtgccggagtccagctgcaacatggacaaccaccagtccatgaacaccatcaccaagtacacccaggtcagctggcggggcaaggccgaccaggcccaggcctcccagaacagcttcgaggcggtgtccgccgaggtggacctgaaggggacgtgcgtcctgaagcacaagatgctcgaggagagctaccgctcccggaagagcatcacctgctacgacctgtcctgcaacagcacctactgcaagcccaccctgtacatgatcgtgcccatccacgcctgcaacatgatgaagtcctgcctcatcgccctgggcccctaccgcgtgcaggtcgtgtacgagcggacgtactgcatgaccggggtgctgatcgagggcaagtgcttcgtcccggaccagagcgtggtgtccatcatcaagcacggcatcttcgacatcgcgagcgtccacatcgtgtgcttcttcgtggccgtcaaggggaacacctacaagctcttcgagcaggtgaagaagtccttccagagcacctgcaacggcacggagaacaaggtgcaggggtactacatctgcatcgtcggcgggaacagcgcccccatctacgtgcccaccctggacgacttccgctccatggaggccttcagcggcatcttccggtccccccacggcgaggaccacgacctggccggggaggagatcgcgagctactccatcgtcggcccggccaacgccaaggtgccccacagcgcctccagcgacaccctctccctgatcgcctacagcgggatcccctcctacagctccctgagcatcctcgcgtccagcaccgaggccaagcacgtgttctcccccggcttcttcccgcagctgaaccacacgaagtgcgacaagaccgccatccccctgacctggaccggcatgatcgacctccccgggtactacgaggccatccacccctgcacggtcttctgcgtgctgagcggcccgggggcctcctgcgaggcgttcagcgagggcgggatcttcaacatcaccagccccatgtgcctggtgtccaagcagaaccgcttccggctcaccgagcagcaggtcaacttcgtgtgccagcgcgtggacatggacatcatcgtctactgcaacggccagcggaaggtgatcctgaccaagacgctggtgatcggccagtgcatctacaccatcaccagcctcttctccctgctgcccggggtcgcccacagcatcgccgtggagctctgcgtgcccggcttccacgggtgggccaccgccgcgctgctggtcacgttctgcttcggctgggtgctcatcccggccctgaccctgatcatcctcaccatcctgaagttcatcgccaacatcttccacaccaacaaccaggagaaccgcctgaagtccgtgctccggaagatcaaggaggagttcgagaagacgaaggggagcatggtctgcgacgtgtgcaagtacgagtgcgagacctacaaggagctgaaggcccacggcgtgtcctgcccccagagccagtgcccctactgcttcacccactgcgagcccaccgaggcggccttccaggcccactaccgcgtctgccaggtgacgcaccggttccgcgacgacctgaagaagaccgtgaccccgcagaacttcacccccggctgctaccggaccctcaacctgttccgctacaagtcccggtgctacatcttcacgatgtgggtctgcctgctcgtgctggagagcatcctgtgggccgcctccgcgagcgaggtgcccctcaacccggtctggaacgacaacgcccacggggtgggctccgtgcccatgcacaccgacctggagctggacttcagcctgacctccagctccaagtacacctaccgccggcgcctcacgaaccccctggaggagacccagagcatcaacctgcacatcgagatcgaggagcagaccatcggggtcgacgtgcacgccctcggccactggttcgacgggcgcctgaacctgaagaccagcttccactgctacggcgcctgcacgaagtacgagtacccctggcacaccgccaagtgccactacgagcgggactaccagtacgagacctcctggggctgcaacccggcggactgccccggggtgggcaccgggtgcacggcctgcggcctctacctggaccagctgaagcccgtcggcagcgcctacaagatcatcaccatccgctactcccggaaggtgtgcgtgcagttcggggaggagaacctctgcaaggtcatcgacatgaacgactgcttcgtgacccgccacgtgaaggtctgcatcatcggcaccgtgagcaagttctcccagggggacacgctgctgttcttcggccccctcgaggggggcggcctgatcttcaagcactggtgcaccagcacctgccagttcggggacccgggcgacatcatgtccccccgggacaaggggttcctgtgccccgagttccccggcagcttccgcaagaagtgcaacttcgccaccacgccgctctgcgagtacgacgggaacatggtgtccggctacaagaaggtcatggccaccatcgacagcttccagtccttcaacaccagcaccatgcacttcacggacgagcggatcgagtggaaggaccccgacggcatgctgcgcgaccacatcaacatcctggtgaccaaggacatcgacttcgacaacctcggggagaacccctgcaagatcggcctgcagacctccagcatcgagggggcgtggggctccggggtgggcttcaccctgacgtgcctcatcagcctgaccgagtgccccaccttcctgacctccatcaaggcctgcgacaaggccatctgctacggcgccgagagcgtcacgctcacccgggggcagaacaccgtgaaggtgtccggcaaggggggccacagcgggagcaccttcaagtgctgccacggcgaggagtgctcccagatcggcctgcacgcggccgccccgcacctggacaaggtcaacgggatcagcgagatcgagaacaacaaggtgtacgacgacggcgccccccagtgcggggtgaagtgctggttcgtcaagtccggcgagtggatcagcggcatcttctccgggaactggatcgtgctcatcgtcctgtgcgtgttcctgctcttcagcctggtgctgctctccgtcctgtgccccgtgcgcaagcacaagaagagctga

SEQ ID NO: 11704 - RNA, 3408 nt, synthetic construct
  misc_feature 1..3408: note = derived and/or modified CDS sequence (opt1) from HTNV(LongquanAa-09-191)__JQ912825.1__GP
  source 1..3408: mol_type = other RNA
atggagatctggaagtggctggtgatggccagcctcgtctggcccgccttcaccctgcgcaacgtgtacgacatgaagatcgagtgcccgcacaccgtgtccttcggcgagaacagcgtcatcgggtacgtggagctgccccggatgcccctcgcggacacggcccagatggtgcccgagtccagctgcaacatggacaaccaccagtccatgaacaccatcaccaagtacacccaggtcagctggcgcggcaaggccgaccaggcccaggcctcccagaacagcttcgaggcggtgtccgccgaggtggacctgaaggggacgtgcgtcctgaagcacaagatgctcgaggagagctaccggtcccgcaagagcatcacctgctacgacctgtcctgcaacagcacctactgcaagccgaccctgtacatgatcgtgcccatccacgcctgcaacatgatgaagtcctgcctcatcgccctgggcccctaccgggtgcaggtcgtgtacgagcgcacgtactgcatgaccggggtgctgatcgagggcaagtgcttcgtccccgaccagagcgtggtgtccatcatcaagcacggcatcttcgacatcgcgagcgtccacatcgtgtgcttcttcgtggccgtcaaggggaacacctacaagctcttcgagcaggtgaagaagtccttccagagcacctgcaacggcacggagaacaaggtgcaggggtactacatctgcatcgtcggcgggaacagcgccccgatctacgtgcccaccctggacgacttccggtccatggaggccttcagcggcatcttccgctccccccacggcgaggaccacgacctggccggggaggagatcgcgagctactccatcgtcggccccgccaacgccaaggtgccgcacagcgcctccagcgacaccctctccctgatcgcctacagcgggatcccctcctacagctccctgagcatcctcgcgtccagcaccgaggccaagcacgtgttctcccccggcttcttcccccagctgaaccacacgaagtgcgacaagaccgccatcccgctgacctggaccggcatgatcgacctccccgggtactacgaggccatccacccctgcacggtcttctgcgtgctgagcggccccggggcctcctgcgaggcgttcagcgagggcgggatcttcaacatcaccagcccgatgtgcctggtgtccaagcagaaccggttccgcctcaccgagcagcaggtcaacttcgtgtgccagcgggtggacatggacatcatcgtctactgcaacggccagcgcaaggtgatcctgaccaagacgctggtgatcggccagtgcatctacaccatcaccagcctcttctccctgctgcccggggtcgcccacagcatcgccgtggagctctgcgtgcccggcttccacgggtgggccaccgccgcgctgctggtcacgttctgcttcggctgggtgctcatccccgccctgaccctgatcatcctcaccatcctgaagttcatcgccaacatcttccacacctccaaccaggagaaccggctgaagagcgtgctccgcaagatcaaggaggagttcgagaagacgaaggggtccatggtctgcgacgtgtgcaagtacgagtgcgagacctacaaggagctgaaggcccacggcgtgagctgcccgcagtcccagtgcccctactgcttcacccactgcgagcccaccgaggcggccttccaggcccactaccgggtctgccaggtgacgcaccgcttccgggacgacctgaagaagaccgtgaccccccagaacttcaccccgggctgctaccgcaccctcaacctgttccggtacaagagccgctgctacatcttcacgatgtgggtctgcctgctcgtgctggagtccatcctgtgggccgccagcgcgtccgaggtgcccctcaaccccgtctggaacgacaacgcccacggggtgggcagcgtgccgatgcacaccgacctggagctggacttctccctgaccagctccagcaagtacacctaccggcgccgcctcacgaaccccctggaggagacccagagcatcaacctgcacatcgagatcgaggagcagaccatcggggtcgacgtgcacgccctcggccactggttcgacgggcggctgaacctgaagacctccttccactgctacggcgcctgcacgaagtacgagtacccctggcacaccgccaagtgccactacgagcgcgactaccagtacgagaccagctggggctgcaaccccgcggactgcccgggggtgggcaccgggtgcacggcctgcggcctctacctggaccagctgaagcccgtcggctccgcctacaagatcatcaccatccggtacagccgcaaggtgtgcgtgcagttcggggaggagaacctctgcaaggtcatcgacatgaacgactgcttcgtgacccggcacgtgaaggtctgcatcatcggcaccgtgtccaagttcagccagggggacacgctgctgttcttcggccccctcgaggggggcggcctgatcttcaagcactggtgcacctccacctgccagttcggggaccccggcgacatcatgagcccgcgcgacaaggggttcctgtgccccgagttccccggctccttccggaagaagtgcaacttcgccaccacgcccctctgcgagtacgacgggaacatggtgagcggctacaagaaggtcatggccaccatcgactccttccagagcttcaacacctccaccatgcacttcacggacgagcgcatcgagtggaaggacccggacggcatgctgcgggaccacatcaacatcctggtgaccaaggacatcgacttcgacaacctcggggagaacccctgcaagatcggcctgcagaccagctccatcgagggggcgtggggcagcggggtgggcttcaccctgacgtgcctcatctccctgaccgagtgccccaccttcctgaccagcatcaaggcctgcgacaaggccatctgctacggcgccgagtccgtcacgctcacccgcgggcagaacaccgtgaaggtgagcggcaaggggggccacagcgggtccaccttcaagtgctgccacggcgaggagtgcagccagatcggcctgcacgcggccgccccccacctggacaaggtcaacgggatctccgagatcgagaacaacaaggtgtacgacgacggcgccccgcagtgcggggtgaagtgctggttcgtcaagagcggcgagtggatctccggcatcttcagcgggaactggatcgtgctcatcgtcctgtgcgtgttcctgctcttctccctggtgctgctcagcgtcctgtgccccgtgcggaagcacaagaagtcctga

SEQ ID NO: 11705 - RNA, 3408 nt, synthetic construct
  misc_feature 1..3408: note = derived and/or modified CDS sequence (opt1) from HTNV(LongquanAa-09-350)__JQ912835.1__GP
  source 1..3408: mol_type = other RNA
atggagatctggaagtggctggtgatggccagcctcgtctggcccgccttcacccgccggaacgtgtacgacatgaagatcgagtgcccgcacaccgtgtccttcggcgagaacagcgtcatcgggtacgtggagctgccgcccatgcccctggccgacacggcccagatggtgcccgagtccagctgcaacatggacaaccaccagtccatgaacaccatcaccaagtacacccaggtcagctggcgcggcaaggccgaccaggcccaggcctcccagaacagcttcgaggcggtgtccgccgaggtggacctcaaggggacgtgcgtcctgaagcacaagatgctggaggagagctaccggtcccgcaagagcatcacgtgctacgacctctcctgcaacagcacctactgcaagcccaccctgtacatgatcgtgcccatccacgcctgcaacatgatgaagtcctgcctgatcgccctcggcccctaccgggtgcaggtcgtgtacgagcgcacctactgcatgaccggggtgctgatcgagggcaagtgcttcgtcccggaccagagcgtggtgtccatcatcaagcacggcatcttcgacatcgcgagcgtccacatcgtgtgcttcttcgtggccgtcaaggggaacacctacaagctgttcgagcaggtcaagaagtccttccagagcacgtgcaacggcaccgagaacaaggtgcaggggtactacatctgcatcgtgggcgggaacagcgcccccatctacgtgcccaccctcgacgacttccggtccatggaggccttcagcggcatcttccgcagcccccacggcgaggaccacgacctggccggggaggagatcgcgagctactccatcgtcggcccggccaacgccaaggtgccccacagcgcctccagcgacaccctgtccctcatcgcctacagcgggatcccctcctacagctccctgagcatcctggcgtccagcaccgaggccaagcacgtgttctcccccggcttcttcccgcagctcaaccacacgaagtgcgacaagaccgccatccccctgacctggaccggcatgatcgacctgcccgggtactacgaggccatccacccctgcacggtcttctgcgtgctcagcggcccgggggcctcctgcgaggcgttcagcgagggcgggatcttcaacatcaccagccccatgtgcctggtgtccaagcagaaccggttccgcctgaccgagcagcaggtcaacttcgtgtgccagcgggtggacatggacatcatcgtctactgcaacggccagcgcaaggtgatcctcaccaagacgctggtgatcggccagtgcatctacaccatcaccagcctgttctccctcctgcccggggtcgcccacagcatcgccgtggagctgtgcgtgcccggcttccacgggtgggccaccgccgcgctcctggtcacgttctgcttcggctgggtgctgatcccggccctcaccctgatcatcctgaccatcctcaagttcatcgccaacatcttccacacctccaaccaggagaaccggctgaagtccgtgctgcgcaagatcaaggaggagttcgagaagacgaaggggtccatggtctgcgacgtgtgcaagtacgagtgcgagacctacaaggagctcaaggcccacggcgtgagctgcccccagtcccagtgcccctactgcttcacccactgcgagcccaccgaggcggccttccaggcccactaccgggtctgccaggtgacgcaccgcttccgggacgacctgaagaagaccgtgaccccgcagaacttcacccccggctgctaccgcaccctgaacctcttccggtacaagagccgctgctacatcttcacgatgtgggtctgcctgctggtgctcgagtccatcctgtgggccgccagcgcgtccgaggtgcccctgaacccggtctggaacgacaacgcccacggggtgggcagcgtgcccatgcacaccgacctcgagctggacttctccctgaccagctccagcaagtacacctaccggcgccgcctgacgaaccccctcgaggagacccagagcatcaacctgcacatcgagatcgaggagcagaccatcggggtcgacgtgcacgccctgggccactggttcgacgggcggctcaacctgaagacctccttccactgctacggcgcctgcacgaagtacgagtacccctggcacaccgccaagtgccactacgagcgcgactaccagtacgagaccagctggggctgcaacccggcggactgccccggggtgggcaccgggtgcacggcctgcggcctgtacctcgaccagctgaagcccgtcggctccgcctacaagatcatcaccatccggtacagccgcaaggtgtgcgtgcagttcggggaggagaacctgtgcaaggtcatcgacatgaacgactgcttcgtgacccggcacgtgaaggtctgcatcatcggcaccgtgtccaagttcagccagggggacacgctcctgttcttcggccccctggagggcgggggcctcatcttcaagcactggtgcacctccacgtgccagttcggggacccgggcgacatcatgagcccccgcgacaaggggttcctgtgccccgagttccccggctccttccggaagaagtgcaacttcgccaccaccccgctgtgcgagtacgacgggaacatggtgagcggctacaagaaggtcatggccaccatcgactccttccagagcttcaacacctccaccatgcacttcacggacgagcgcatcgagtggaaggaccccgacggcatgctccgggaccacatcaacatcctggtgaccaaggacatcgacttcgacaacctgggggagaacccctgcaagatcggcctccagaccagctccatcgagggggcgtggggcagcggggtgggcttcaccctgacgtgcctgatctccctcaccgagtgccccaccttcctgaccagcatcaaggcctgcgacaaggccatctgctacggcgccgagtccgtcacgctgacccgcgggcagaacaccgtgaaggtgagcggcaagggcgggcacagcgggtccaccttcaagtgctgccacggcgagaagtgcagccagatcggcctccacgcggccgccccgcacctggacaaggtcaacgggatctccgagatcgagaacaacaaggtgtacgacgacggcgcgccccagtgcggggtgaagtgctggttcgtcaagagcggcgagtggatctccggcatcttcagcgggaactggatcgtgctgatcgtcctctgcgtgttcctgctgttctccctcgtgctgctgagcgtcctctgccccgtgcggaagcacaagaagtcctga

SEQ ID NO: 11706 - RNA, 3408 nt, synthetic construct
  misc_feature 1..3408: note = derived and/or modified CDS sequence (opt1) from HTNV(LongquanAa-09-489)__JQ912844.1__GP
  source 1..3408: mol_type = other RNA
atggagatctggaagtggctggtgatggccagcctcgtctggcccgccttcaccctgcgcaacgtgtacgacatgaagatcgagtgcccgcacaccgtgtccttcggcgagaacagcgtcatcgggtacgtggagctgccccggatgcccctcgcggacacggcccagatggtgcccgagtccagctgcaacatggacaaccaccagtccatgaacaccatcaccaagtacacccaggtcagctggcgcggcaaggccgaccaggcccaggcctcccagaacagcttcgaggcggtgtccgccgaggtggacctgaaggggacgtgcgtcctgaagcacaagatgctcgaggagagctaccggtcccgcaagagcatcacctgctacgacctgtcctgcaacagcacctactgcaagccgaccctgtacatgatcgtgcccatccacgcctgcaacatgatgaagtcctgcctcatcgccctgggcccctaccgggtgcaggtcgtgtacgagcgcacgtactgcatgaccggggtgctgatcgagggcaagtgcttcgtccccgaccagagcgtggtgtccatcatcaagcacggcatcttcgacatcgcgagcgtccacatcgtgtgcttcttcgtggccgtcaaggggaacacctacaagctcttcgagcaggtgaagaagtccttccagagcacctgcaacggcacggagaacaaggtgcaggggtactacatctgcatcgtcggcgggaacagcgccccgatctacgtgcccaccctggacgacttccggtccatggaggccttcagcggcatcttccgctccccccacggcgaggaccacgacctggccggggaggagatcgcgagctactccatcgtcggccccgccaacgccaaggtgccgcacagcgcctccagcgacaccctctccctgatcgcctacagcgggatcccctcctacagctccctgagcatcctcgcgtccagcaccgaggccaagcacgtgttctcccccggcttcttcccccagctgaaccacacgaagtgcgacaagaccgccatcccgctgacctggaccggcatgatcgacctccccgggtactacgaggccatccacccctgcacggtcttctgcgtgctgagcggccccggggcctcctgcgaggcgttcagcgagggcgggatcttcaacatcaccagcccgatgtgcctggtgtccaagcagaaccggttccgcctcaccgagcagcaggtcaacttcgtgtgccagcgggtggacatggacatcatcgtctactgcaacggccagcgcaaggtgatcctgaccaagacgctggtgatcggccagtgcatctacaccatcaccagcctcttctccctgctgcccggggtcgcccacagcatcgccgtggagctctgcgtgcccggcttccacgggtgggccaccgccgcgctgctggtcacgttctgcttcggctgggtgctcatccccgccctgaccctgatcatcctcaccatcctgaagttcatcgccaacatcttccacacctccaaccaggagaaccggctgaagagcgtgctccgcaagatcaaggaggagttcgagaagacgaaggggtccatggtctgcgacgtgtgcaagtacgagtgcgagacctacaaggagctgaaggcccacggcgtgagctgcccgcagtcccagtgcccctactgcttcacccactgcgagcccaccgaggcggccttccaggcccactaccgggtctgccaggtgacgcaccgcttccgggacgacctgaagaagaccgtgaccccccagaacttcaccccgggctgctaccgcaccctcaacctgttccggtacaagagccgctgctacatcttcacgatgtgggtctgcctgctcgtgctggagtccatcctgtgggccgccagcgcgtccgaggtgcccctcaaccccgtctggaacgacaacgcccacggggtgggcagcgtgccgatgcacaccgacctgcagctggacttctccctgaccagctccagcaagtacacctaccggcgccgcctcacgaaccccctggaggagacccagagcatcaacctgcacatcgagatcgaggagcagaccatcggggtcgacgtgcacgccctcggccactggttcgacgggcggctgaacctgaagacctccttccactgctacggcgcctgcacgaagtacgagtacccctggcacaccgccaagtgccactacgagcgcgactaccagtacgagaccagctggggctgcaaccccgcggactgcccgggggtgggcaccgggtgcacggcctgcggcctctacctggaccagctgaagcccgtcggctccgcctacaagatcatcaccatccggtacagccgcaaggtgtgcgtgcagttcggggaggagaacctctgcaaggtcatcgacatgaacgactgcttcgtgacccggcacgtgaaggtctgcatcatcggcaccgtgtccaagttcagccagggggacacgctgctgttcttcggccccctcgaggggggcggcctgatcttcaagcactggtgcacctccacctgccagttcggggaccccggcgacatcatgagcccgcgcgacaaggggttcctgtgccccgagttccccggctccttccggaagaagtgcaacttcgccaccacgcccctctgcgagtacgacgggaacatggtgagcggctacaagaaggtcatggccaccatcgactccttccagagcttcaacacctccaccatgcacttcacggacgagcgcatcgagtggaaggacccggacggcatgctgcgggaccacatcaacatcctggtgaccaaggacatcgacttcgacaacctcggggagaacccctgcaagatcggcctgcagaccagctccatcgagggggcgtggggcagcggggtgggcttcaccctgacgtgcctcatctccctgaccgagtgccccaccttcctgaccagcatcaaggcctgcgacaaggccatctgctacggcgccgagtccgtcacgctcacccgcgggcagaacaccgtgaaggtgagcggcaaggggggccacagcgggtccaccttcaagtgctgccacggcgaggagtgcagccagatcggcctgcacgcggccgccccccacctggacaaggtcaacgggatctccgagatcgagaacaacaaggtgtacgacgacggcgccccgcagtgcggggtgaagtgctggttcgtcaagagcggcgagtggatctccggcatcttcagcgggaactggatcgtgctcatcgtcctgtgcgtgttcctgctcttctccctggtgctgctcagcgtcctgtgccccgtgcggaagcacaagaagtcctga

SEQ ID NO: 11707 - RNA, 3408 nt, synthetic construct
  misc_feature 1..3408: note = derived and/or modified CDS sequence (opt1) from HTNV(LongquanAa-09-541)__JQ912850.1__GP
  source 1..3408: mol_type = other RNA
atgggcatctggaagtggctggtgatggccagcctcgtctggcccgccttcaccctgcgcaacgtgtacgacatgaagatcgagtgcccgcacaccgtgtccttcggggagaacagcgtcatcggctacgtggagctgccgcccatgcccctcgccgacacggcccagatggtgcccgagtccagctgcaacatggacaaccaccagtccatgaacaccatcaccaagtacacccaggtcagctggcgggggaaggccgaccaggcccaggcctcccagaacagcttcgaggcggtgtccgccgaggtggacctgaagggcatctgcgtcctgaagcacaagatgctcgaggagagctaccgctcccgcaagagcatcacgtgctacgacctgtcctgcaacagcacctactgcaagcccaccctgtacatgatcgtgcccatccacgcctgcaacatgatgaagtcctgcctcatcgccctggggccctaccgggtgcaggtcgtgtacgagcggacctactgcatgacgggcgtgctgctcgagggcaagtgcttcgtcccggaccagagcgtggtgtccatcatcaagcacgggatcttcgacatcgcgagcgtccacatcgtgtgcttcttcgtggccgtcaagggcaacacctacaagctgttcgagcaggtcaagaagtccttccagagcacgtgcaacgggaccgagaacaaggtgcagggctactacatctgcatcgtcgggggcaacagcgcccccatctacgtgcccaccctggacgacttccgctccatggaggccttcagcggcatcttccggagcccccacggggaggaccacgacctcgccggcgaggagatcgcgtcctactccatcgtggggccggccaacgccaaggtgccccacagcgcctccagcgacaccctgtccctgatcgcctacagcggcatcccctcctacagctccctcagcatcctggcgtccagcaccgaggccaagcacgtgttctcccccggcttcttcccgcagctgaaccacaccaagtgcgacaagacggccatccccctcacctggaccgggatgatcgacctgcccggctactacgaggccatccacccctgcaccgtcttctgcgtgctgagcgggccgggcgcctcctgcgaggcgttcagcgagggcgggatcttcaacatcacgagccccatgtgcctcgtgtccaagcagaaccgcttccggctgaccgagcagcaggtcaacttcgtgtgccagcgcgtggacatggacatcatcgtctactgcaacggccagcggaaggtgatcctgaccaagaccctcgtgatcgggcagtgcatctacacgatcaccagcctgttctccctgctccccggcgtcgcccacagcatcgccgtggagctgtgcgtgcccgggttccacggctgggccaccgccgcgctgctcgtcaccttctgcttcgggtgggtgctgatcccggccctgacgctcatcatcctgaccatcctgaagttcatcgccaacatcttccacacctccaaccaggagaaccgcctcaagagcgtgctgcggaagatcaaggaggagttcgagaagaccaagggctccatggtctgcgacgtgtgcaagtacgagtgcgagacgtacaaggagctgaaggcccacggcgtgagctgcccccagtcccagtgcccctactgcttcacccactgcgagcccaccgaggcggccttccaggcccactaccgcgtctgccaggtgacccaccggttccgcgacgacctcaagaagacggtgaccccgcagaacttcacccccgggtgctaccggaccctgaacctgttccgctacaagagccggtgctacatcttcaccatgtgggtctgcctcctggtgctggagtccatcctctgggccgccagcgcgtccgaggtgcccctgaacccggtctggaacgacaacgcccacggcgtggggagcgtgcccatgcacacggacctggagctggacttctccctcaccagctccagcaagtacacctaccgccggcgcctgaccaaccccctggaggagacgcagagcatcaacctccacatcgagatcgaggagcagaccatcggcgtcgacgtgcacgccctggggcactggttcgacggccgcctgaacctcaagacctccttccactgctacggcgcctgcaccaagtacgagtacccctggcacacggccaagtgccactacgagcgggactaccagtacgagaccagctgggggtgcaacccggcggactgccccggcgtggggaccggctgcaccgcctgcggcctgtacctggaccagctcaagcccgtcgggtccgcctacaagatcatcacgatccgctacagccggaaggtgtgcgtgcagttcggcgaggagaacctgtgcaaggtcatcgacatgaacgactgcttcgtgacccgccacgtgaaggtctgcatcatcgggaccgtgtccaagttcagccagggcgacaccctcctcttcttcgggcccctggagggcggcgggctgatcttcaagcactggtgcacgtccacgtgccagttcggcgacccgggggacatcatgagcccccgggacaagggcttcctctgccccgagttccccgggtccttccgcaagaagtgcaacttcgccaccaccccgctgtgcgagtacgacggcaacatggtgagcggctacaagaaggtcatggccaccatcgactccttccagagcttcaacacctccaccatgcacttcaccgacgagcggatcgagtggaaggaccccgacgggatgctgcgcgaccacatcaacatcctcgtgacgaaggacatcgacttcgacaacctgggcgagaacccctgcaagatcgggctgcagaccagctccatcgagggcgcgtgggggagcggcgtgggcttcaccctgacctgcctgatctccctgacggagtgccccaccttcctcaccagcatcaaggcctgcgacaaggccatctgctacggggccgagtccgtcaccctgacgcggggccagaacaccgtgaaggtgagcgggaagggcgggcacagcggctccaccttcaagtgctgccacggcgaggagtgcagccagatcgggctgcacgcggccgccccgcacctcgacaaggtcaacggcatctccgagatcgagaacaacaaggtgtacgacgacggggcgccccagtgcggcgtgaagtgctggttcgtcaagagcggcgagtggatctccgggatcttcagcggcaactggatcgtgctgatcgtcctgtgcgtgttcctcctgttctccctggtgctcctgagcgtcctgtgccccgtgcgcaagcacaagaagtcctga

SEQ ID NO: 11708 - RNA, 3408 nt, synthetic construct
  misc_feature 1..3408: note = derived and/or modified CDS sequence (opt1) from HTNV(LongquanAa-09-698)__JQ912854.1__GP
  source 1..3408: mol_type = other RNA
atggagatctggaagtggctggtgatggccagcctcgtctggcccgccttcaccctgcgcaacgtgtacgacatgaagatcgagtgcccgcacaccgtgtccttcggcgagaacagcgtcatcgggtacgtggagctgccgcccatgcccctcgccgacacggcccagatggtgcccgagtccagctgcaacatggacaaccaccagtccatgaacaccatcaccaagtacacccaggtcagctggcggggcaaggccgaccaggcccaggcctcccagaacagcttcgaggcggtgtccgccgaggtggacctgaaggggacgtgcatcctgaagcacaagatgctcgaggagagctaccgctcccgcaagagcatcacgtgctacgacctgtcctgcaacagcacctactgcaagcccaccctgtacatgatcgtccccatccacgcctgcaacatgatgaagtcctgcctcatcgccctgggcccctaccgcgtccaggtggtctacgagcggacgtactgcatgaccggggtgctgatcgagggcaagtgcttcgtgccggaccagagcgtcgtgtccatcatcaagcacggcatcttcgacatcgcgagcgtgcacatcgtctgcttcttcgtggccgtgaaggggaacacctacaagctgttcgagcaggtcaagaagtccttccagtccacgtgcaacggcaccgagaacaaggtgcaggggtactacatctgcatcgtgggcgggaacagcgcccccatctacgtccccaccctggacgacttccgctccatggaggccttcagcggcatcttccggagcccccacggcgaggaccacgacctggccggggaggagatcgcgtcctactccatcgtgggcccggccaacgccaaggtcccccacagcgcctccagcgacaccctctccctgatcgcctacagcgggatcccctcctacagctccctgagcatcctcgcgtccagcaccgaggccaagcacgtgttctcccccggcttcttcccgcagctgaaccacacgaagtgcgacaagaccgccatccccctgacctggaccggcatgatcgacctccccgggtactacgaggccatccacccctgcacggtgttctgcgtgctcagcggcccgggggccagctgcgaggcgttcagcgagggcgggatcttcaacatcaccagccccatgtgcctggtgtccaagcagaaccggttccggctcaccgagcagcaggtcaacttcgtgtgccagcgcgtggacatggacatcatcgtgtactgcaacggccagcggaaggtcatcctgaccaagaccctggtgatcggccagtgcatctacaccatcaccagcctcttctccctgctgcccggggtggcccacagcatcgccgtcgagctctgcgtgcccggcttccacgggtgggccaccgccgcgctgctggtgacgttctgcttcggctgggtcctcatcccggccctgaccctgatcatcctcaccatcctgaagttcatcgccaacatcttccacacctccaaccaggagaaccgcctgaagtccgtgctccggaagatcaaggaggagttcgagaagacgaaggggagcatggtgtgcgacgtctgcaagtacgagtgcgagacctacaaggagctgaaggcccacggcgtgagctgcccccagtcccagtgcccctactgcttcacccactgcgagcccaccgaggcggccttccaggcccactaccgcgtgtgccaggtcacgcaccggttccgcgacgacctgaagaagaccgtgaccccgcagaacttcacccccggctgctaccggaccctcaacctgttccgctacaagagccggtgctacatcttcacgatgtgggtgtgcctgctcgtcctggagtccatcctgtgggccgccagcgcgtccgaggtgcccctcaacccggtgtggaacgacaacgcccacggggtcggcagcgtgcccatgcacaccgacctggagctggacttctccctgaccagctccagcaagtacacctaccgccggcgcctcacgaaccccctggaggagacccagagcatcaacctgcacatcgagatcgaggagcagaccatcggggtggacgtccacgccctcggccactggttcgacgggcgcctgaacctgaagacctccttccactgctacggcgcctgcacgaagtacgagtacccctggcacaccgccaagtgccactacgagcgggactaccagtacgagaccagctggggctgcaacccggcggactgccccggggtgggcaccgggtgcacggcctgcggcctctacctggaccagctgaagcccgtgggctccgcctacaagatcatcaccatccgctacagccggaaggtctgcgtgcagttcggggaggagaacctctgcaaggtgatcgacatgaacgactgcttcgtcacccgccacgtgaaggtgtgcatcatcggcaccgtctccaagttcagccagggggacacgctgctgttcttcggccccctcgagggcgggggcctgatcttcaagcactggtgcacctccacgtgccagttcggggacccgggcgacatcatgagcccccgggacaaggggttcctgtgccccgagttccccggctccttccgcaagaagtgcaacttcgccaccaccccgctctgcgagtacgacgggaacatggtgagcggctacaagaaggtgatggccaccatcgactccttccagagcttcaacacctccaccatgcacttcacggacgagcggatcgagtggaaggaccccgacggcatgctgcgcgaccacatcaacatcctggtcaccaaggacatcgacttcgacaacctcggggagaacccctgcaagatcggcctgcagaccagctccatcgagggggcgtggggcagcggggtgggcttcaccctgacgtgcctcatctccctgaccgagtgccccaccttcctgaccagcatcaaggcctgcgacaaggccatctgctacggcgccgagtccgtgacgctcacccgggggcagaacaccgtcaaggtgagcggcaagggcgggcacagcgggtccaccttcaagtgctgccacggcgaggagtgcagccagatcggcctgcacgcggccgccccgcacctggacaaggtgaacgggatctccgagatcgagaacaacaaggtctacgacgacggcgcgccccagtgcggggtgaagtgctggttcgtcaagagcggcgagtggatctccggcatcttcagcgggaactggatcgtgctcatcgtgctgtgcgtcttcctgctgttctccctcgtgctgctcagcgtgctgtgccccgtccgcaagcacaagaagtcctga

SEQ ID NO: 11709 - RNA, 3408 nt, synthetic construct
  misc_feature 1..3408: note = derived and/or modified CDS sequence (opt1) from HTNV(LongquanAa-10-393)__JQ912859.1__GP
  source 1..3408: mol_type = other RNA
atggagatctggaagtggctggtgatggccagcctcgtctggcccgccttcaccctgcgcaacgtgtacgacatgaagatcgagtgcccgcacaccgtgtccttcggcgagaacagcgtcatcgggtacgtggagctgccgcccatgcccctcgccgacacggcccagatggtgcccgagtccagctgcaacatggacaaccaccagtccatgaacaccatcaccaagtacacccaggtcagctggcggggcaaggccgaccaggcccaggcctcccagaacagcttcgaggcggtgtccgccgaggtggacctgaaggggacgtgcgtcctgaagcacaagatgctcgaggagagctaccgctcccggaagtccatcacgtgctacgacctgtcctgcaacagcacctactgcaagcccaccctgtacatgatcgtgcccatccacgcctgcaacatgatgaagtcctgcctcatcgccctgggcccctaccgcgtgcaggtcgtgtacgagcggacctactgcatgaccggggtgctgatcgagggcaagtgcttcgtcccggaccagagcgtggtgtccatcatcaagcacggcatcttcgacatcgcgagcgtccacatcgtgtgcttcttcgtggccgtcaaggggaacacctacaagctgttcgagcaggtcaagaagtccttccagagcacgtgcaacggcaccgagaacaaggtgcaggggtactacatctgcatcgtgggcgggaacagcgcccccatctacgtgcccaccctggacgacttccgctccatggaggccttcagcggcatcttccggagcccccacggcgaggaccacgacctggccggggaggagatcgcgagctactccatcgtcggcccggccaacgccaaggtgccccacagcgcctccagcgacaccctctccctgatcgcctacagcgggatcccctcctacagctccctgagcatcctcgcgtccagcaccgaggccaagcacgtgttctcccccggcttcttcccgcagctgaaccacacgaagtgcgacaagaccgccatccccctgacctggaccggcatgatcgacctccccgggtactacgaggccatccacccctgcacggtcttctgcgtgctgagcggcccgggggcctcctgcgaggcgttcagcgagggcgggatcttcaacatcaccagccccatgtgcctggtgtccaagcagaaccgcttccggctcaccgagcagcaggtcaacttcgtgtgccagcgcgtggacatggacatcatcgtctactgcaacggccagcggaaggtgatcctgaccaagacgctggtgatcggccagtgcatctacaccatcaccagcctcttctccctgctgcccggggtcgcccacagcatcgccgtggagctctgcgtgcccggcttccacgggtgggccaccgccgcgctgctggtcacgttctgcttcggccgcgtgctcatcccggccctgaccctgatcatcctcaccatcctgaagttcatcgccaacatcttccacacctccaaccaggagaaccggctcaagagcgtgctccgcaagatcaaggaggagttcgagaagacgaaggggtccatggtctgcgacgtgtgcaagtacgagtgcgagacctacaaggagctgaaggcccacggcgtgagctgcccccagtcccagtgcccctactgcttcacccactgcgagcccaccgaggcggccttccaggcccactaccgggtctgccaggtgacgcaccgcttccgggacgacctgaagaagaccgtgaccccgcagaacttcacccccggctgctaccgcaccctcaacctgttccggtacaagagccgctgctacatcttcacgatgtgggtctgcctgctcgtgctggagtccatcctgtgggccgccagcgcgtccgaggtgcccctcaacccggtctggaacgacaacgcccacggggtgggcagcgtgcccatgcacaccgacctggagctggacttctccctgaccagctccagcaagtacacctaccggcgccgcctcacgaaccccctggaggagacccagagcatcaacctgcacatcgagatcgaggagcagaccatcggggtcgacgtgcacgccctcggccactggttcgacgggcggctgaacctgaagacctccttccactgctacggcgcctgcacgaagtacgagtacccctggcacaccgccaagtgccactacgagcgcgactaccagtacgagaccagctggggctgcaacccggcggactgccccggggtgggcaccgggtgcacggcctgcggcctctacctggaccagctgaagcccgtcggctccgcctacaagatcatcaccatccggtacagccgcaaggtgtgcgtgcagttcggggaggagaacctctgcaaggtcatcgacatgaacgactgcttcgtgacccggcacgtgaaggtctgcatcatcggcaccgtgtccaagttcagccagggggacacgctgctgttcttcggccccctcgagggcgggggcctgatcttcaagcactggtgcacctccacgtgccagttcggggacccgggcgacatcatgagcccccgcgacaaggggttcctgtgccccgagttccccggctccttccggaagaagtgcaacttcgccaccaccccgctctgcgagtacgacgggaacatggtgagcggctacaagaaggtcatggccaccatcgactccttccagagcttcaacacctccaccatgcacttcacggacgagcgcatcgagtggaaggaccccgacggcatgctgcgggaccacatcaacatcctggtgaccaaggacatcgacttcgacaacctcggggagaacccctgcaagatcggcctgcagaccagctccatcgagggggcgtggggcagcggggtgggcttcaccctgacgtgcctcatctccctgaccgagtgccccaccttcctgaccagcatcaaggcctgcgacaaggccatctgctacggcgccgagtccgtcacgctcacccgcgggcagaacaccgtgaaggtgagcggcaagggcgggcacagcgggtccaccttcaagtgctgccacggcgaggagtgcagccagatcggcctgcacgcggccgccccgcacctggacaaggtcaacgggatctccgagatcgagaacaacaaggtgtacgacgacggcgcgccccagtgcggggtgaagtgctggttcgtcaagagcggcgagtggatctccggcatcttcagcgggaactggatcgtgctcatcgtcctgtgcgtgttcctcctgttctccctggtgctgctcagcgtcctgtgccccgtgcggaagcacaagaagtcctga

SEQ ID NO: 11710 - RNA, 3408 nt, synthetic construct
  misc_feature 1..3408: note = derived and/or modified CDS sequence (opt1) from HTNV(LongquanAa-10-58)__JQ912861.1__GP
  source 1..3408: mol_type = other RNA
atggagatctggaagtggctggtgatggccagcctcgtctggcccgccttcaccctgcgcaacgtgtacgacatgaagatcgagtgcccgcacaccgtgtccttcggcgagaacagcgtcatcgggtacgtggagctgccgcccatgcccctcgccgacacggcccagatggtgcccgagtccagctgcaacatggacaaccaccagtccatgaacaccatcaccaagtacacccaggtcagctggcggggcaaggccgaccaggcccaggcctcccagaacagcttcgaggcggtgtccgccgaggtggacctgaaggggacgtgcgtcctgaagcacaagatgctcgaggagagctaccgctcccggaagtccatcacgtgctacgacctgtcctgcaacagcacctactgcaagcccaccctgtacatgatcgtgcccatccacgcctgcaacatgatgaagtcctgcctcatcgccctgggcccctaccgcgtgcaggtcgtgtacgagcggacctactgcatgaccggggtgctgatcgagggcaagtgcttcgtcccggaccagagcgtggtgtccatcatcaagcacggcatcttcgacatcgcgagcgtccacatcgtgtgcttcttcgtggccgtcaaggggaacacctacaagctgttcgagcaggtcaagaagtccttccagagcacgtgcaacggcaccgagaacaaggtgcaggggtactacatctgcatcgtgggcgggaacagcgcccccatctacgtgcccaccctggacgacttccgctccatggaggccttcagcggcatcttccggagcccccacggcgaggaccacgacctggccggggaggagatcgcgagctactccatcgtcggcccggccaacgccaaggtgccccacagcgcctccagcgacaccctctccctgatcgcctacagcgggatcccctcctacagctccctgagcatcctcgcgtccagcaccgaggccaagcacgtgttctcccccggcttcttcccgcagctgaaccacacgaagtgcgacaagaccgccatccccctgacctggaccggcatgatcgacctccccgggtactacgaggccatccacccctgcacggtcttctgcgtgctgagcggcccgggggcctcctgcgaggcgttcagcgagggcgggatcttcaacatcaccagccccatgtgcctggtgtccaagcagaaccgcttccggctcaccgagcagcaggtcaacttcgtgtgccagcgcgtggacatggacatcatcgtctactgcaacggccagcggaaggtgatcctgaccaagacgctggtgatcggccagtgcatctacaccatcaccagcctcttctccctgctgcccggggtcgcccacagcatcgccgtggagctctgcgtgcccggcttccacgggtgggccaccgccgcgctgctggtcacgttctgcttcggctgggtgctcatcccggccctgaccctgatcatcctcaccatcctgaagttcatcgccaacatcttccacacctccaaccaggagaaccgcctcaagagcgtgctccggaagatcaaggaggagttcgagaagacgaaggggtccatggtctgcgacgtgtgcaagtacgagtgcgagacctacaaggagctgaaggcccacggcgtgagctgcccccagtcccagtgcccctactgcttcacccactgcgagcccaccgaggcggccttccaggcccactaccgcgtctgccaggtgacgcaccggttccgcgacgacctgaagaagaccgtgaccccgcagaacttcacccccggctgctaccggaccctcaacctgttccgctacaagagccggtgctacatcttcacgatgtgggtctgcctgctcgtgctggagtccatcctgtgggccgccagcgcgtccgaggtgcccctcaacccggtctggaacgacaacgcccacggggtgggcagcgtgcccatgcacaccgacctggagctggacttctccctgaccagctccagcaagtacacctaccgccggcgcctcacgaaccccctggaggagacccagagcatcaacctgcacatcgagatcgaggagcagaccatcggggtcgacgtgcacgccctcggccactggttcgacgggcgcctgaacctgaagacctccttccactgctacggcgcctgcacgaagtacgagtacccctggcacaccgccaagtgccactacgagcgggactaccagtacgagaccagctggggctgcaacccggcggactgccccggggtgggcaccgggtgcacggcctgcggcctctacctggaccagctgaagcccgtcggctccgcctacaagatcatcaccatccgctacagccggaaggtgtgcgtgcagttcggggaggagaacctctgcaaggtcatcgacatgaacgactgcttcgtgacccgccacgtgaaggtctgcatcatcggcaccgtgtccaagttcagccagggggacacgctgctgttcttcggccccctcgagggcgggggcctgatcttcaagcactggtgcacctccacgtgccagttcggggacccgggcgacatcatgagcccccgggacaaggggttcctgtgccccgagttccccggctccttccgcaagaagtgcaacttcgccaccaccccgctctgcgagtacgacgggaacatggtgagcggctacaagaaggtcatggccaccatcgactccttccagagcttcaacacctccaccatgcacttcacggacgagcggatcgagtggaaggaccccgacggcatgctgcgcgaccacatcaacatcctggtgaccaaggacatcgacttcgacaacctcggggagaacccctgcaagatcggcctgcagaccagctccatcgagggggcgtggggcagcggggtgggcttcaccctgacgtgcctcatctccctgaccgagtgccccaccttcctgaccagcatcaaggcctgcgacaaggccatctgctacggcgccgagtccgtcacgctcacccgggggcagaacaccgtgaaggtgagcggcaagggcgggcacagcgggtccaccttcaagtgctgccacggcgaggagtgcagccagatcggcctgcacgcggccgccccgcacctggacaaggtcaacgggatctccgagatcgagaacaacaaggtgtacgacgacggcgcgccccagtgcggggtgaagtgctggttcgtcaagagcggcgagtggatctccggcatcttcagcgggaactggatcgtgctcatcgtcctgtgcctgttcctcctgttctccctggtgctcctgagcgtgctgtgccccgtccgcaagcacaagaagtcctga

SEQ ID NO: 11711 - RNA, 3408 nt, synthetic construct
  misc_feature 1..3408: note = derived and/or modified CDS sequence (opt1) from HTNV(LongquanAa-10-74)__JQ912864.1__GP
  source 1..3408: mol_type = other RNA
atggagatctggaagtggctggtgatggccagcctcgtctggcccgccttcaccctgcgcaacgtgtacgacatgaagatcgagtgcccgcacaccgtgtccttcggcgagaacagcgtcatcgggtacgtggagctgccgcccatgcccctcgccgacacggcccagatggtgcccgagtccagctgcaacatggacaaccaccagtccatgaacaccatcaccaagtacacccaggtcagctggcggggcaaggccgaccaggcccaggcctcccagaacagcttcgaggcggtgtccgccgaggtggacctgaaggggacgtgcgtcctgaagcacaagatgctcgaggagagctaccgctcccggaagtccatcacgtgctacgacctgtcctgcaacagcacctactgcaagcccaccctgtacatgatcgtgcccatccacgcctgcaacatgatgaagtcctgcctcatcgccctgggcccctaccgcgtgcaggtcgtgtacgagcggacctactgcatgaccggggtgctgatcgagggcaagtgcttcgtcccggaccagagcgtggtgtccatcatcaagcacggcatcttcgacatcgcgagcgtccacatcgtgtgcttcttcgtggccgtcaaggggaacacctacaagctgttcgagcaggtcaagaagtccttccagagcacgtgcaacggcaccgagaacaaggtgcaggggtactacatctgcatcgtgggcgggaacagcgcccccatctacgtgcccaccctggacgacttccgctccatggaggccttcagcggcatcttccggagcccccacggcgaggaccacgacctggccggggaggagatcgcgagctactccatcgtcggcccggccaacgccaaggtgccccacagcgcctccagcgacaccctctccctgatcgcctacagcgggatcccctcctacagctccctgagcatcctcgcgtccagcaccgaggccaagcacgtgttctcccccggcttcttcccgcagctgaaccacacgaagtgcgacaagaccgccatccccctgacctggaccggcatgatcgacctccccgggtactacgaggccatccacccctgcacggtcttctgcgtgctgagcggcccgggggcctcctgcgaggcgttcagcgagggcgggatcttcaacatcaccagccccatgtgcctggtgtccaagcagaaccgcttccggctcaccgagcagcaggtcaacttcgtgtgccagcgcgtggacatggacatcatcgtctactgcaacggccagcggaaggtgatcctgaccaagacgctggtgatcggccagtgcatctacaccatcaccagcctcttctccctgctgcccggggtcgcccacagcatcgccgtggagctctgcgtgcccggcttccacgggtgggccaccgccgcgctgctggtcacgttctgcttcggctgggtgctcatcccggccctgaccctgatcatcctcaccatcctgaagttcatcgccaacatcttccacacctccaaccaggagaaccgcctcaagagcgtgctccggaagatcaaggaggagttcgagaagacgaaggggtccatggtctgcgacgtgtgcaagtacgagtgcgagacctacaaggagctgaaggcccacggcgtgagctgcccccagtcccagtgcccctactgcttcacccactgcgagcccaccgaggcggccttccaggcccactaccgcgtctgccaggtgacgcaccggttccgcgacgacctgaagaagaccgtgaccccgcagaacttcacccccggctgctaccggaccctcaacctgttccgctacaagagccggtgctacatcttcacgatgtgggtctgcctgctcgtgctggagtccatcctgtgggccgccagcgcgtccgaggtgcccctcaacccggtctggaacgacaacgcccacggggtgggcagcgtgcccatgcacaccgacctggagctggacttctccctgaccagctccagcaagtacacctaccgccggcgcctcacgaaccccctggaggagacccagagcatcaacctgcacatcgagatcgaggagcagaccatcggggtcgacgtgcacgccctcggccactggttcgacgggcgcctgaacctgaagacctccttccactgctacggcgcctgcacgaagtacgagtacccctggcacaccgccaagtgccactacgagcgggactaccagtacgagaccagctggggctgcaacccggcggactgccccggggtgggcaccgggtgcacggcctgcggcctctacctggaccagctgaagcccgtcggctccgcctacaagatcatcaccatccgctacagccggaaggtgtgcgtgcagttcggggaggagaacctctgcaaggtcatcgacatgaacgactgcttcgtgacccgccacgtgaaggtctgcatcatcggcaccgtgtccaagttcagccagggggacacgctgctgttcttcggccccctcgagggcgggggcctgatcttcaagcactggtgcacctccacgtgccagttcggggacccgggcgacatcatgagcccccgggacaaggggttcctgtgccccgagttccccggctccttccgcaagaagtgcaacttcgccaccaccccgctctgcgagtacgacgggaacatggtgagcggctacaagaaggtcatggccaccatcgactccttccagagcttcaacacctccaccatgcacttcacggacgagcggatcgagtggaaggaccccgacggcatgctgcgcgaccacatcaacatcctggtgaccaaggacatcgacttcgacaacctcggggagaacccctgcaagatcggcctgcagaccagctccatcgagggggcgtggggcagcggggtgggcttcaccctgacgtgcctcatctccctgaccgagtgccccaccttcctgaccagcatcaaggcctgcgacaaggccatctgctacggcgccgagtccgtcacgctcacccgggggcagaacaccgtgaaggtgagcggcaagggcgggcacagcgggtccaccttcgagtgctgccacggcgaggagtgcagccagatcggcctgcacgcggccgccccgcacctggacaaggtcaacgggatctccgagatcgagaacaacaaggtgtacgacgacggcgcgccccagtgcggggtgaagtgctggttcgtcaagagcggcgagtggatctccggcatcttcagcgggaactggatcgtgctcatcgtcctgtgcgtgttcctcctgttctccctggtgctgctcagcgtcctgtgccccgtgcgcaagcacaagaagtcctga

SEQ ID NO: 11712 - RNA, 3408 nt, synthetic construct
  misc_feature 1..3408: note = derived and/or modified CDS sequence (opt1) from HTNV(LongquanAa-10-98)__JQ912866.1__GP
  source 1..3408: mol_type = other RNA
atggagatctggaagtggctggtgatggccagcctcgtctggcccgccttcaccctgcgcaacgtgtacgacatgaagatcgagtgcccgcacaccgtgtccttcggcgagaacagcgtcatcgggtacgtggagctgccgcccatgcccctcgccgacacggcccagatggtgcccgagtccagctgcaacatggacaaccaccagtccatgaacaccatcaccaagtacacccaggtcagctggcggggcaaggccgaccaggcccaggcctcccagaacagcttcgaggcggtgtccgccgaggtggacctgaaggggacgtgcgtcctgaagcacaagatgctcgaggagagctaccgctcccgcaagagcatcacgtgctacgacctgtcctgcaacagcacctactgcaagcccaccctgtacatgatcgtgcccatccacgcctgcaacatgatgaagtcctgcctcatcgccctgggcccctaccgggtgcaggtcgtgtacgagcggacctactgcatgaccggggtgctgatcgagggcaagtgcttcgtcccggaccagagcgtggtgtccatcatcaagcacggcatcttcgacatcgcgagcgtccacatcgtgtgcttcttcgtggccgtcaaggggaacacctacaagctcctggagcaggtcaagaagtccttccagagcacgtgcaacgacaccgagaacaaggtgcagggctactacatctgcatcgtcgggggcaacagcgcccccatctacgtgcccaccctggacgacttccgctccatggaggccttcagcgggatcttccggagcccccacggcgaggaccacgacctcgccggcgaggagatcgcgtcctactccatcgtggggccggccaacgccaaggtgccccacagcgcctccagcgacaccctgtccctgatcgcctacagcggcatcccctcctacagctccctcagcatcctggcgtccagcaccgaggccaagcacgtgttctcccccgggttcttcccgcagctgaaccacacgaagtgcgacaagaccgccatccccctcacctggaccggcatgatcgacctgcccggctactacgaggccatccacccctgcacggtcttctgcgtgctgagcgggccgggcgcctcctgcgaggcgttcagcgagggcgggatcttcaacatcaccagccccatgtgcctcgtgtccaagcagaaccgcttccggctgaccgagcagcaggtcaacttcgtgtgccagcgcgtggacatggacatcatcgtctactgcaacgggcagcggaaggtgatcctgaccaagacgctcgtgatcggccagtgcatctacaccatcaccagcctgttctccctgctccccggcgtcgcccacagcatcgccgtggagctgtgcgtgcccgggttccacggctgggccaccgccgcgctgctcgtcacgttctgcttcgggtgggtgctgatcccggccctgaccctcatcatcctgaccatcctgaagttcatcgccaacatcttccacacctccaaccaggagaaccgcctcaagagcgtgctgcggaagatcaaggaggagttcgagaagacgaagggctccatggtctgcgacgtgtgcaagtacgagtgcgagacctacaaggagctgaaggcccacggggtgagctgcccccagtcccagtgcccctactgcttcacccactgcgagcccaccgaggcggccttccaggcccactaccgcgtctgccaggtgacgcaccggttccgcgacgacctcaagaagaccgtgaccccgcagaacttcacccccggctgctaccggaccctgaacctgttccgctacaagagccggtgctacatcttcacgatgtgggtctgcctcctggtgctggagtccatcctctgggccgccagcgcgtccgaggtgcccctgaacccggtctggaacgacaacgcccacggcgtggggagcgtgcccatgcacaccgacctggagctggacttctccctcaccagctccagcaagtacacctaccgccggcgcctgacgaaccccctggaggagacccagagcatcaacctccacatcgagatcgaggagcagaccatcggcgtcgacgtgcacgccctggggcactggttcgacggccgcctgaacctcaagacctccttccactgctacggggcctgcacgaagtacgagtacccctggcacaccgccaagtgccactacgagcgggactaccagtacgagaccagctggggctgcaacccggcggactgccccggcgtggggaccggctgcacggcctgcgggctgtacctggaccagctcaagcccgtcggctccgcctacaagatcatcaccatccgctacagccggaaggtgtgcgtgcagttcggcgaggagaacctgtgcaaggtcatcgacatgaacgactgcttcgtgacccgccacgtgaaggtctgcatcatcgggaccgtgtccaagttcagccagggcgacacgctcctgttcttcgggcccctggagggcgggggcctgatcttcaagcactggtgcacctccacgtgccagttcggcgacccgggggacatcatgagcccccgggacaagggcttcctctgccccgagttccccgggtccttccgcaagaagtgcaacttcgccaccaccccgctgtgcgagtacgacggcaacatggtgagcgggtacaagaaggtcatggccaccatcgactccttccagagcttcaacacctccaccatgcacttcacggacgagcggatcgagtggaaggaccccgacggcatgctgcgcgaccacatcaacatcctcgtgaccaaggacatcgacttcgacaacctgggcgagaacccctgcaagatcgggctgcagaccagctccatcgagggcgcgtgggggagcggcgtggggttcaccctcacgtgcctgatctccctgaccgagtgccccaccttcctcaccagcatcaaggcctgcgacaaggccatctgctacggcgccgagtccgtcacgctgacccggggccagaacaccgtgaaggtgagcgggaagggcgggcacagcggctccaccttcaagtgctgccacggggaggagtgcagccagatcggcctgcacgcggccgccccgcacctcgacaaggtcaacggcatctccgagatcgagaacaacaaggtgtacgacgacggggcgccccagtgcggcgtgaagtgctggttcgtcaagagcggggagtggatctccggcatcttcagcggcaactggatcgtgctgatcgtcctgtgcgtgttcctcctgttctccctggtgctcctgagcgtcctgtgccccgtgcgcaagcacaagaagtcctga

SEQ ID NO: 11713 - RNA, 3408 nt, synthetic construct
  misc_feature 1..3408: note = derived and/or modified CDS sequence (opt1) from HTNV(LongquanAa-11-452)__KC344264.1__GP
  source 1..3408: mol_type = other RNA
atggagatctggaagtggctggtgatggccagcctcgtctggcccgccttcaccctgcgcaacgtgtacgacatgaagatcgagtgcccgcacaccgtgtccttcggcgagaacagcgtcatcgggtacgtggagctgccgcccatgcccctcgccgacacggcccagatggtgcccgagtccagctgcaacatggacaaccaccagtccatcaacaccatcaccaagtacacccaggtcagctggcggggcaaggccgaccaggcccaggcctcccagaacagcttcgaggcggtgtccgccgaggtggacctgaaggggacgtgcgtcctgaagcacaagatgctcgaggagagctaccgctcccgcaagagcatcacgtgctacgacctgtcctgcaacagcacctactgcaagcccaccctgtacatgatcgtgcccatccacgcctgcaacatgatgaagtcctgcctcatcgccctgggcccctaccgggtgcaggtcgtgtacgagcggacctactgcatgaccggggtgctgatcgagggcaagtgcttcgtcccggaccagagcgtggtgtccatcatcaagcacggcatcttcgacatcgcgagcgtccacatcgtgtgcttcttcgtggccgtcaaggggaacacctacaagctcctggagcaggtcaagaagtccttccagagcacgtgcaacgacaccgagaacaaggtgcagggctactacatctgcatcgtcgggggcaacagcgcccccatctacgtgcccaccctggacgacttccgctccatggaggccttcagcgggatcttccggagcccccacggcgaggaccacgacctcgccggcgaggagatcgcgtcctactccatcatcgggccggccaacgccaaggtgccccacagcgcctccagcgacaccctgtccctgatcgcctacagcggcatcccctcctacagctccctcagcatcctggcgtccagcaccgaggccaagcacgtgttctcccccgggttcttcccgcagctgaaccacacgaagtgcgacaagaccgccatccccctcacctggaccggcatgatcgacctgcccggctactacgaggccatccacccctgcacggtgttctgcgtcctgagcgggccgggcgcctcctgcgaggcgttcagcgagggcgggatcttcaacatcaccagccccatgtgcctcgtgtccaagcagaaccgcttccggctgaccgagcagcaggtcaacttcgtgtgccagcgcgtggacatggacatcatcgtgtactgcaacgggcagcggaaggtcatcctgaccaagacgctcgtgatcggccagtgcatctacaccatcaccagcctgttctccctgctccccggcgtggcccacagcatcgccgtcgagctgtgcgtgcccgggttccacggctgggccaccgccgcgctgctcgtgacgttctgcttcgggtgggtcctgatcccggccctgaccctcatcatcctgaccatcctgaagttcatcgccaacatcttccacacctccaaccaggagaaccgcctcaagagcgtgctgcggaagatcaaggaggagttcgagaagacgaagggctccatggtgtgcgacgtctgcaagtacgagtgcgagacctacaaggagctgaaggcccacggggtgagctgcccccagtcccagtgcccctactgcttcacccactgcgagcccaccgaggcggccttccaggcccactaccgcgtgtgccaggtcacgcaccggttccgcgacgacctcaagaagaccgtgaccccgcagaacttcacccccggctgctaccggaccctgaacctgttccgctacaagagccggtgctacatcttcacgatgtgggtgtgcctcctggtcctggagtccatcctctgggccgccagcgcgtccgaggtgcccctgaacccggtgtggaacgacaacgcccacggcgtcgggagcgtgcccatgcacaccgacctggagctggacttctccctcaccagctccagcaagtacacctaccgccggcgcctgacgaaccccctggaggagacccagagcatcaacctccacatcgagatcgaggagcagaccatcggcgtggacgtccacgccctggggcactggttcgacggccgcctgaacctcaagacctccttccactgctacggggcctgcacgaagtacgagtacccctggcacaccgccaagtgccactacgagcgggactaccagtacgagaccagctggggctgcaacccggcggactgccccggcgtggggaccggctgcacggcctgcgggctgtacctggaccagctcaagcccgtgggctccgcctacaagatcatcaccatccgctacagccggaaggtctgcgtgcagttcggcgaggagaacctgtgcaaggtgatcgacatgaacgactgcttcgtcacccgccacgtgaaggtgtgcatcatcgggaccgtctccaagttcagccagggcgacacgctcctgttcttcgggcccctggagggcgggggcctgatcttcaagcactggtgcacctccacgtgccagttcggcgacccgggggacatcatgagcccccgggacaagggcttcctctgccccgagttccccgggtccttccgcaagaagtgcaacttcgccaccaccccgctgtgcgagtacgacggcaacatggtgagcgggtacaagaaggtgatggccaccatcgactccttccagagcttcaacacctccaccatgcacttcacggacgagcggatcgagtggaaggaccccgacggcatgctgcgcgaccacatcaacatcctcgtcaccaaggacatcgacttcgacaacctgggcgagaacccctgcaagatcgggctgcagaccagctccatcgagggcgcgtgggggagcggcgtggggttcaccctcacgtgcctgatctccctgaccgagtgccccaccttcctcaccagcatcaaggcctgcgacaaggccatctgctacggcgccgagtccgtgacgctgacccggggccagaacaccgtcaaggtgagcgggaagggcgggcacagcggctccaccttcaagtgctgccacggggaggagtgcagccagatcggcctgcacgcggccgccccgcacctcgacaaggtgaacggcatctccgagatcgagaacaacaaggtctacgacgacggggcgccccagtgcggcgtgaagtgctggttcgtcaagagcggggagtggatctccggcatcttcagcggcaactggatcgtgctgatcgtgctgtgcgtcttcctcctgttctccctggtgctcctgagcgtgctgtgccccgtccgcaagcacaagaagtcctga

SEQ ID NO: 11714 - RNA, 3408 nt, synthetic construct
  misc_feature 1..3408: note = derived and/or modified CDS sequence (opt1) from HTNV(LongquanAa-11-473)__KC344263.1__GP
  source 1..3408: mol_type = other RNA
atgggcatctggaagtggctggtgatggccagcctcgtctggcccgccttcaccctgcgcaacgtgtacgacatgaagatcgagtgcccgcacaccgtgtccttcggggagaacagcgtcatcggctacgtggagctgccgcccatgcccctcgccgacacggcccagatggtgcccgagtccagctgcaacatggacaaccaccagtccatgaacaccatcaccaagtacacccaggtcagctggcgggggaaggccgaccaggcccaggcctcccagaacagcttcgaggcggtgtccgccgaggtggacctgaagggcatctgcgtcctgaagcacaagatgctcgaggagagctaccgctcccggaagtccatcacgtgctacgacctgtcctgcaacagcacctactgcaagcccaccctgtacatgatcgtgcccatccacgcctgcaacatgatgaagtcctgcctcatcgccctggggccctaccgcgtgcaggtcgtgtacgagcggacctactgcatgacgggcgtgctgctcgagggcaagtgcttcgtcccggaccagagcgtggtgtccatcatcaagcacgggatcttcgacatcgcgagcgtccacatcgtgtgcttcttcgtggccgtcaagggcaacacctacaagctgttcgagcaggtcaagaagtccttccagagcacgtgcaacgacaccgagaacaaggtgcaggggtactacatctgcatcgtgggcgggaacagcgcccccatctacgtgcccaccctggacgacttccgctccatggaggccttcagcggcatcttccggagcccccacggcgaggaccacgacctcgccggggaggagatcgcgagctactccatcgtcggcccggccaacgccaaggtgccccacagcgcctccagcgacaccctgtccctgatcgcctacagcgggatcccctcctacagctccctcagcatcctggcgaactccaccgaggccaagcacgtgttcagccccggcttcttcccgcagctgaaccacaccaagtgcgacaagacggccatccccctcatctggaccggcatgatcgacctgcccgggtactacgaggccatccacccctgcaccgtcttctgcgtgctgtccggcccgggggccagctgcgaggcgttctccgagggcgggatcttcaacatcaccagccccatgtgcctcgtgagcaagcagaaccgcttccggctgacggagcagcagatcaacttcgtctgccagcgcgtggacgtggacatcatcgtctactgcaacggccagcggaaggtgatcctgaccaagaccctcgtgatcggccagtgcatctacaccatcacgtccctgttcagcctgctccccggggtcgcccactccatcgccgtggagctgtgcgtgcccggcttccacgggtgggccaccgccgcgctgctcgtcaccttctgcttcggctgggtgctgatcccggccctgaccctcatcatcctgacgatcctgaagttcatcgccaacatcttccacaccagcaaccaggagaaccgcctcaagtccgtgctgcggaagatcaaggaggagttcgagaagaccaaggggagcatggtctgcgacgtgtgcaagtacgagtgcgagacctacaaggagctgaaggcccacggcgtgtcctgcccccagagccagtgcccctactgcttcacgcactgcgagcccaccgaggcggccttccaggcccactaccgcgtctgccaggtgacccaccggttccgcgacgacctcaagaagaccgtgacgccgcagaacttcacccccggctgctaccggaccctgaacctgttccgctacaagtcccggtgctacatcttcaccatgtgggtctgcctcctggtgctggagagcatcctctgggccgcctccgcgagcgaggtgcccctgaacccggtctggaacgacaacgcccacggggtgggctccgtgcccatgcacaccgacctggagctggacttcagcctcacgtccagctccaagtacacctaccgccggcgcctgaccaaccccctggaggagacccagagcatcaacctccacatcgagatcgaggagcagacgatcggggtcgacgtgcacgccctgggccactggttcgacgggcgcctgaacctcaagaccagcttccactgctacggcgcctgcaccaagtacgagtacccctggcacaccgccaagtgccactacgagcgggactaccagtacgagacgtcctggggctgcaacccggcggactgccccggggtgggcaccgggtgcaccgcctgcggcctgtacctggaccagctcaagcccgtcggcagcgcctacaagatcatcaccatccgctactcccggaaggtgtgcgtgcagttcggggaggagaacctgtgcaaggtcatcgacatgaacgactgcttcgtgacgcgccacgtgaaggtctgcatcatcggcaccgtgagcaagttctcccagggggacaccctcctcttcttcggccccctggagggcgggggcctgatcttcaagcactggtgcaccagcacgtgccagttcggggacccgggcgacatcatgagcccccgggacaaggggttcctctgccccgagttccccggcagcttccgcaagaagtgcaacttcgccaccaccccgctgtgcgagtacgacgggaacatggtgtccggctacaagaaggtcatggccaccatcgacagcttccagtccttcaacacgagcaccatgcacttcaccgacgagcggatcgagtggaaggaccccgacggcatgctgcgcgaccacatcaacatcctcgtgaccaaggacatcgacttcgacaacctgggggagaacccctgcaagatcggcctgcagacgtccagcatcgagggggcgtggggctccggggtgggcttcaccctgacctgcctgatcagcctgaccgagtgccccacgttcctcacctccatcaaggcctgcgacaaggccatctgctacggcgccgagagcgtcaccctgacccgggggcagaacacggtgaaggtgtccggcaagggcgggcacagcgggagcaccttcaagtgctgccacggcgaggagtgctcccagatcggcctgcacgcggccgccccgcacctcgacaaggtcaacgggatcagcgagatcgagaacaacaaggtgtacgacgacggcgcgccccagtgcggggtgaagtgctggttcgtcaagtccggcgagtggatcagcggcatcttctccgggaactggatcgtgctgatcgtcctgtgcgtgttcctcctgttcagcctggtgctcctgtccgtcctgtgccccgtgcgcaagcacaagaagtcctga

SEQ ID NO: 11715 - RNA, 3408 nt, synthetic construct
  misc_feature 1..3408: note = derived and/or modified CDS sequence (opt1) from HTNV(LongquanAa-11-642)__KC344262.1__GP
  source 1..3408: mol_type = other RNA
atggagatctggaagtggctggtgatggccagcctcgtctggcccgccttcaccctgcgcaacgtgtacgacatgaagatcgagtgcccgcacaccgtgtccttcggcgagaacagcgtcatcgggtacgtggagctgccgcccatgcccctcgccgacacggcccagatggtgcccgagtccagctgcaacatggacaaccaccagtccatgaacaccatcaccaagtacacccaggtcagctggcggggcaaggccgaccaggcccaggcctcccagaacagcttcgaggcggtgtccgccgaggtggacctgaaggggacgtgcgtcctgaagcacaagatgctcgaggagagctaccgctcccgcaagagcatcacgtgctacgacctgtcctgcaacagcacctactgcaagcccaccctgtacatgatcgtgcccatccacgcctgcaacatgatgaagtcctgcctcatcgccctgggcccctaccgggtgcaggtcgtgtacgagcggacctactgcatgaccggggtgctgctcgagggcaagtgcttcgtcccggaccagagcgtggtgtccatcatcaagcacggcatcttcgacatcgcgagcgtccacatcgtgtgcttcttcgtggccgtcaaggggaacacctacaagctgttcgagcaggtcaagaagtccttccagagcacgtgcaacgacaccgagaacaaggtgcagggctactacatctgcatcgtcgggggcaacagcgcccccatctacgtgcccaccctggacgacttccgctccatggaggccttcagcgggatcttccggagcccccacggcgaggaccacgacctcgccggcgaggagatcgcgtcctactccatcgtggggccggccaacgccaaggtgccccacagcgcctccagcgacaccctgtccctgatcgcctacagcggcatcccctcctacagctccctcagcatcctggcgtccagcaccgaggccaagcacgtgttctcccccgggttcttcccgcagctgaaccacacgaagtgcgacaagaccgccatccccctcatctggaccggcatgatcgacctgcccggctactacgaggccatccacccctgcaccgtcttctgcgtgctgagcgggccgggcgcctcctgcgaggcgttcagcgagggcgggatcttcaacatcacgagccccatgtgcctcgtgtccaagcagaaccgcttccggctgaccgagcagcaggtcaacttcgtgtgccagcgcgtggacgtcgacatcatcgtgtactgcaacgggcagcggaaggtgatcctgaccaagaccctcgtcatcggccagtgcatctacacgatcaccagcctgttctccctgctccccggcgtggcccacagcatcgccgtggagctgtgcgtccccgggttccacggctgggccaccgccgcgctgctcgtgaccttctgcttcgggtgggtgctgatcccggccctgacgctcatcatcctgaccatcctgaagttcatcgccaacatcttccacacctccaaccaggagaaccgcctcaagagcgtcctgcggaagatcaaggaggagttcgagaagaccaagggctccatggtgtgcgacgtgtgcaagtacgagtgcgagacgtacaaggagctgaaggcccacggggtcagctgcccccagtcccagtgcccctactgcttcacccactgcgagcccaccgaggcggccttccaggcccactaccgcgtgtgccaggtgacccaccggttccgcgacgacctcaagaagacggtcaccccgcagaacttcacccccggctgctaccggaccctgaacctgttccgctacaagagccggtgctacatcttcaccatgtgggtgtgcctcctggtgctggagtccatcctctgggccgccagcgcgtccgaggtccccctgaacccggtgtggaacgacaacgcccacggcgtggggagcgtccccatgcacacggacctggagctggacttctccctcaccagctccagcaagtacacctaccgccggcgcctgaccaaccccctggaggagacgcagagcatcaacctccacatcgagatcgaggagcagaccatcggcgtggacgtgcacgccctggggcactggttcgacggccgcctgaacctcaagacctccttccactgctacggggcctgcaccaagtacgagtacccctggcacacggccaagtgccactacgagcgggactaccagtacgagaccagctggggctgcaacccggcggactgccccggcgtcgggaccggctgcaccgcctgcgggctgtacctggaccagctcaagcccgtgggctccgcctacaagatcatcacgatccgctacagccggaaggtgtgcgtccagttcggcgaggagaacctgtgcaaggtgatcgacatgaacgactgcttcgtgacccgccacgtcaaggtgtgcatcatcgggaccgtgtccaagttcagccagggcgacaccctcctcttcttcgggcccctggagggcgggggcctgatcttcaagcactggtgcacgtccacgtgccagttcggcgacccgggggacatcatgagcccccgggacaagggcttcctctgccccgagttccccgggtccttccgcaagaagtgcaacttcgccaccaccccgctgtgcgagtacgacggcaacatggtcagcgggtacaagaaggtgatggccaccatcgactccttccagagcttcaacacctccaccatgcacttcaccgacgagcggatcgagtggaaggaccccgacggcatgctgcgcgaccacatcaacatcctcgtgacgaaggacatcgacttcgacaacctgggcgagaacccctgcaagatcgggctgcagaccagctccatcgagggcgcgtgggggagcggcgtcgggttcaccctgacctgcctgatctccctgacggagtgccccaccttcctcaccagcatcaaggcctgcgacaaggccatctgctacggcgccgagtccgtgaccctgacgcggggccagaacaccgtgaaggtcagcgggaagggcgggcacagcggctccaccttcaagtgctgccacggggaggagtgcagccagatcggcctgcacgcggccgccccgcacctcgacaaggtgaacggcatctccgagatcgagaacaacaaggtgtacgacgacggggcgccccagtgcggcgtcaagtgctggttcgtcaagagcggggagtggatctccggcatcttcagcggcaactggatcgtgctgatcgtgctgtgcgtgttcctcctgttctccctggtcctcctgagcgtgctgtgccccgtgcgcaagcacaagaagtcctga

SEQ ID NO: 11716 - RNA, 3408 nt, synthetic construct
  misc_feature 1..3408: note = derived and/or modified CDS sequence (opt1) from HTNV(LongquanAa-11-774)__KC344257.1__GP
  source 1..3408: mol_type = other RNA
atggagatctggaagtggctggtgatggccagcctcgtctggcccgccttcaccctgcgcaacgtgtacgacatgaagatcgagtgcccgcacaccgtgtccttcggcgagaacagcgtcatcgggtacgtggagctgccgcccatgcccctcgccgacacggcccagatggtgcccgagtccagctgcaacatggacaaccaccagtccatgaacaccatcaccaagtacacccaggtcagctggcggggcaaggccgaccaggcccaggcctcccagaacagcttcgaggcggtgtccgccgaggtggacctgaaggggacgtgcgtcctgaagcacaagatgctcgaggagagctaccgctcccggaagtccatcacgtgctacgacctgtcctgcaacagcacctactgcaagcccaccctgtacatgatcgtgcccatccacgcctgcaacatgatgaagtcctgcctcatcgccctgggcccctaccgcgtgcaggtcgtgtacgagcggacctactgcatgaccggggtgctgatcgagggcaagtgcttcgtcccggaccagagcgtggtgtccatcatcaagcacggcatcttcgacatcgcgagcgtccacatcgtgtgcttcttcgtggccgtcaaggggaacacctacaagctgttcgagcaggtcaagaagtccttccagagcacgtgcaacggcaccgagaacaaggtgcaggggtactacatctgcatcgtgggcgggaacagcgcccccatctacgtgcccaccctggacgacttccgctccatggaggccttcagcggcatcttccggagcccccacggcgaggaccacgacctggccggggaggagatcgcgagctactccatcgtcggcccggccaacgccaaggtgccccacagcgcctccagcgacaccctctccctgatcgcctacagcgggatcccctcctacagctccctgagcatcctcgcgtccagcaccgaggccaagcacgtgttctcccccggcttcttcccgcagctgaaccacacgaagtgcgacaagaccgccatccccctgacctggaccggcatgatcgacctccccgggtactacgaggccatccacccctgcacggtcttctgcgtgctgagcggcccgggggcctcctgcgaggcgttcagcgagggcgggatcttcaacatcaccagccccatgtgcctggtgtccaagcagaaccgcttccggctcaccgagcagcaggtcaacttcgtgtgccagcgcgtggacatggacatcatcgtctactgcaacggccagcggaaggtgatcctgaccaagacgctggtgatcggccagtgcatctacaccatcaccagcctcttctccctgctgcccggggtcgcccacagcatcgccgtggagctctgcgtgcccggcttccacgggtgggccaccgccgcgctgctggtcacgttctgcttcggctgggtgctcatcccggccctgaccctgatcatcctcaccatcctgaagttcatcgccaacatcttccacacctccaaccaggagaaccgcctcaagagcgtgctccggaagatcaaggaggagttcgagaagacgaaggggtccatggtctgcgacgtgtgcaagtacgagtgcgagacctacaaggagctgaaggcccacggcgtgagctgcccccagtcccagtgcccctactgcttcacccactgcgagcccaccgaggcggccttccaggcccactaccgcgtctgccaggtgacgcaccggttccgcgacgacctgaagaagaccgtgaccccgcagaacttcacccccggctgctaccggaccctcaacctgttccgctacaagagccggtgctacatcttcacgatgtgggtctgcctgctcgtgctggagtccatcctgtgggccgccagcgcgtccgaggtgcccctcaacccggtctggaacgacaacgcccacggggtgggcagcgtgcccatgcacaccgacctggagctggacttctccctgaccagctccagcaagtacacctaccgccggcgcctcacgaaccccctggaggagacccagagcatcaacctgcacatcgagatcgaggagcagaccatcggggtcgacgtgcacgccctcggccactggttcgacgggcgcctgaacctgaagacctccttccactgctacggcgcctgcacgaagtacgagtacccctggcacaccgccaagtgccactacgagcgggactaccagtacgagaccagctggggctgcaacccggcggactgccccggggtgggcaccgggtgcacggcctgcggcctctacctggaccagctgaagcccgtcggctccgcctacaagatcatcaccatccgctacagccggaaggtgtgcgtgcagttcggggaggagaacctctgcaaggtcatcgacatgaacgactgcttcgtgacccgccacgtgaaggtctgcatcatcggcaccgtgtccaagttcagccagggggacacgctgctgttcttcggccccctcgagggcgggggcctgatcttcaagcactggtgcacctccacgtgccagttcggggacccgggcgacatcatgagcccccgggacaaggggttcctgtgccccgagttccccggctccttccgcaagaagtgcaacttcgccaccaccccgctctgcgagtacgacgggaacatggtgagcggctacaagaaggtcatggccaccatcgactccttccagagcttcaacacctccaccatgcacttcacggacgagcggatcgagtggaaggaccccgacggcatgctgcgcgaccacatcaacatcctggtgaccaaggacatcgacttcgacaacctcggggagaacccctgcaagatcggcctgcagaccagctccatcgagggggcgtggggcagcggggtgggcttcaccctgacgtgcctcatctccctgaccgagtgccccaccttcctgaccagcatcaaggcctgcgacaaggccatctgctacggcgccgagtccgtcacgctcacccgggggcagaacaccgtgaaggtgagcggcaagggcgggcacagcgggtccaccttcaagtgctgccacggcgagaagtgcagccagatcggcctgcacgcggccgccccgcacctggacaaggtcaacgggatctccgagatcgagaacaacaaggtgtacgacgacggcgcgccccagtgcggggtgaagtgctggttcgtcaagagcggcgagtggatctccggcatcttcagcgggaactggatcgtgctcatcgtcctgtgcgtgttcctcctgttctccctggtgctgctcagcgtcctgtgccccgtgcgcaagcacaagaagtcctga

SEQ ID NO: 11717 - RNA, 3408 nt, synthetic construct
  misc_feature 1..3408: note = derived and/or modified CDS sequence (opt1) from HTNV(LongquanMf-09-8)__JQ912875.1__GP
  source 1..3408: mol_type = other RNA
atggagatctggaagtggctggtgatggccagcctcgtctggcccgccttcaccctgcgcaacgtgtacgacatgaagatcgagtgcccgcacaccgtgtccttcggcgagaacagcgtcatcgggtacgtggagctgccgcccatgcccctcgccgacacggcccagatggtgcccgagtccagctgcaacatggacaaccaccagtccatgaacaccatcaccaagtacacccaggtcagctggcggggcaaggccgaccaggcccaggcctcccagaacagcttcgaggcggtgtccgccgaggtggacctgaaggggacgtgcgtcctgaagcacaagatgctcgaggagagctaccgctcccggaagtccatcacgtgctacgacctgtcctgcaacagcacctactgcaagcccaccctgtacatgatcgtgcccatccacgcctgcaacatgatgaagtcctgcctcatcgccctgggcccctaccgcgtgcaggtcgtgtacgagcggacctactgcatgaccggggtgctgatcgagggcaagtgcttcgtcccggaccagagcgtggtgtccatcatcaagcacggcatcttcgacatcgcgagcgtccacatcgtgtgcttcttcgtggccgtcaaggggaacacctacaagctgttcgagcaggtcaagaagtccttccagagcacgtgcaacggcaccgagaacaaggtgcaggggtactacatctgcatcgtgggcgggaacagcgcccccatctacgtgcccaccctggacgacttccgctccatggaggccttcagcggcatcttccggagcccccacggcgaggaccacgacctggccggggaggagatcgcgagctactccatcgtcggcccggccaacgccaaggtgccccacagcgcctccagcgacaccctctccctgatcgcctacagcgggatcccctcctacagctccctgagcatcctcgcgtccagcaccgaggccaagcacgtgttctcccccggcttcttcccgcagctgaaccacacgaagtgcgacaagaccgccatccccctgacctggaccggcatgatcgacctccccgggtactacgaggccatccacccctgcacggtcttctgcgtgctgagcggcccgggggcctcctgcgaggcgttcagcgagggcgggatcttcaacatcaccagccccatgtgcctggtgtccaagcagaaccgcttccggctcaccgagcagcaggtcaacttcgtgtgccagcgcgtggacatggacatcatcgtctactgcaacggccagcggaaggtgatcctgaccaagacgctggtgatcggccagtgcatctacaccatcaccagcctcttctccctgctgcccggggtcgcccacagcatcgccgtggagctctgcgtgcccggcttccacgggtgggccaccgccgcgctgctggtcacgttctgcttcggctgggtgctcatcccggccctgaccctgatcatcctcaccatcctgaagttcatcgccaacatcttccacacctccaaccaggagaaccgcctcaagagcgtgctccggaagatcaaggaggagttcgagaagacgaaggggtccatggtctgcgacgtgtgcaagtacgagtgcgagacctacaaggagctgaaggcccacggcgtgagctgcccccagtcccagtgcccctactgcttcacccactgcgagcccaccgaggcggccttccaggcccactaccgcgtctgccaggtgacgcaccggttccgcgacgacctgaagaagaccgtgaccccgcagaacttcacccccggctgctaccggaccctcaacctgttccgctacaagagccggtgctacatcttcacgatgtgggtctgcctgctcgtgctggagtccatcctgtgggccgccagcgcgtccgaggtgcccctcaacccggtctggaacgacaacgcccacggggtgggcagcgtgcccatgcacaccgacctggagctggacttctccctgaccagctccagcaagtacacctaccgccggcgcctcacgaaccccctggaggagacccagagcatcaacctgcacatcgagatcgaggagcagaccatcggggtcgacgtgcacgccctcggccactggttcgacgggcgcctgaacctgaagacctccttccactgctacggcgcctgcacgaagtacgagtacccctggcacaccgccaagtgccactacgagcgggactaccagtacgagaccagctggggctgcaacccggcggactgccccggggtgggcaccgggtgcacggcctgcggcctctacctggaccagctgaagcccgtcggctccgcctacaagatcatcaccatccgctacagccggaaggtgtgcgtgcagttcggggaggagaacctctgcaaggtcatcgacatgaacgactgcttcgtgacccgccacgtgaaggtctgcatcatcggcaccgtgtccaagttcagccagggggacacgctgctgttcttcggccccctcgagggcgggggcctgatcttcaagcactggtgcacctccacgtgccagttcggggacccgggcgacatcatgagcccccgggacaaggggttcctgtgccccgagttccccggctccttccgcaagaagtgcaacttcgccaccaccccgctctgcgagtacgacgggaacatggtgagcggctacaagaaggtcatggccaccatcgactccttccagagcttcaacacctccaccatgcacttcacggacgagcggatcgagtggaaggaccccgacggcatgctgcgcgaccacatcaacatcctggtgaacaaggacatcgacttcgacaacctcggggagaacccctgcaagatcggcctgcagaccagctccatcgagggggcgtggggcagcggggtgggcttcaccctgacctgcctcatctccctgacggagtgccccaccttcctgaccagcatcaaggcctgcgacaaggccatctgctacggcgccgagtccgtcaccctcacgcgggggcagaacaccgtgaaggtgagcggcaagggcgggcacagcgggtccaccttcaagtgctgccacggcgaggagtgcagccagatcggcctgcacgcggccgccccgcacctggacaaggtcaacgggatctccgagatcgagaacaacaaggtgtacgacgacggcgcgccccagtgcggggtgaagtgctggttcgtcaagagcggcgagtggatctccggcatcttcagcgggaactggatcgtgctcatcgtcctgtgcgtgttcctcctgttctccctggtgctgctcagcgtcctgtgccccgtgcgcaagcacaagaagtcctga

SEQ ID NO: 11718 - RNA, 3408 nt, synthetic construct
  misc_feature 1..3408: note = derived and/or modified CDS sequence (opt1) from HTNV(ROKA14-11)__KU207203.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcggggagaacagcgtgatcggctacgtggagctcccccccatgcccctggccgacacggcgcagctggtcccggagtccagctgctccatggacaaccaccagagcctcaacaccatcaccaagtacacccaggtgtcctggcgggggaaggccgaccagagccagtccagccagaactccttcgagacggtgagcaccgaggtcgacctgaagggcacctgcgtgctgaagcacaagatggtggaggagtcctaccgcagccggaagtccatcacctgctacgacctcagctgcaactccacgtactgcaagcccaccctgtacatgatcgtccccatccacgcctgcaacatgatgaagagctgcctgatcgccctcgggccctaccgcgtgcaggtggtctacgagcggacctactgcatgaccggcgtgctgatcgagggcaagtgcttcgtgccggaccagtccgtcgtgagcatcatcaagcacgggatcttcgacatcgccagcgtgcacatcgtctgcttcttcgtggcggtgaagggcaacacgtacaagatcttcgagcaggtcaagaagtccttcgagagcacctgcaacgacaccgagaacaaggtgcaggggtactacatctgcatcgtcggcgggaactccgcccccatctacgtgcccaccctggacgacttccgcagcatggaggccttcacgggcatcttccggtccccccacggcgaggaccacgacctcgccggggaggagaccgcgacctacagcatcgtgggcccggccaacgccaaggtcccccactccgccagctccgacaccctgagcctgatcgccttctccgggatccccagctactccagcctctccatcctgacgagctccaccgaggcgaagcacgtgttcagccccggcctgttcccgaagctcaaccacaccaactgcgacaagggcgccatccccctgatgtggaccgggatgatcgacctgcccggctactacgaggccatccacccctgcacggtgttctgcgtcctctccgggccgggcgccagctgcgaggccttcagcgaggggggcatcttcaacatcacctcccccatgtgcctggtgagcaagcagaaccgcttccggctgaccgagcagcaggtgaacttcgtctgccagcgcgtggacgtggacatcgtcgtgtactgcaacggccagcggaaggtgatcctcaccaagacgctggtcatcgggcagtgcatctacaccatcacctccctgttcagcctcctgcccggcgtggcgcactccatcgccgtggagctgtgcgtccccgggttccacggctgggccaccgccgccctcctggtgacgttctgcttcgggtgggtgctgatcccggcgatcaccttcatcatcctcaccatcctgaagttcatcgccaacatcttccacaccagcaaccaggagaaccgcctgaagtccgtcctccggaagatcaaggaggagttcgagaagacgaagggcagcatggtgtgcgacgtgtgcaagtacgagtgcgagacctacaaggagctgaaggcccacggcgtctcctgcccccagagccagtgcccctactgcttcacccactgcgagcccaccgaggccgccttccaggcgcactacaaggtgtgccaggtgacccaccgcttccgggacgacctgaagaagacggtcaccccgcagaacttcacccccgggtgctaccgcaccctcaacctgttccggtacaagtcccgctgctacatcttcacgatgtggatcttcctgctcgtgctggagagcatcctgtgggccgcctccgccagcgagacccccctcaccccggtgtggaacgacaacgcgcacggcgtcgggtccgtgcccatgcacaccgacctggagctggacttcagcctgacgtccagcagcaagtacacctaccggcgcaagctcaccaaccccctggaggaggcccagtccatcgacctgcacatcgagatcgaggagcagaccatcggcgtggacgtccacgccctcgggcactggttcgacggccggctgaacctgaagacgagcttccactgctacggcgcctgcaccaagtacgagtacccctggcacaccgccaagtgccactacgagcgcgactaccagtacgagacctcctgggggtgcaacccgagcgactgccccggcgtggggacgggctgcaccgcgtgcggcctctacctggaccgcctgaagcccgtggggtccgcctacaagatcatcaccatccggtacagccgccgggtctgcgtgcagttcggcgaggagaacctctgcaagatcatcgacatgaacgactgcttcgtgtcccgccacgtcaaggtgtgcatcatcgggaccgtgagcaagttctcccagggcgacacgctgctgttcttcgggcccctcgagggcggcgggctgatcttcaagcactggtgcaccagcacctgccagttcggcgacccgggggacatcatgtccccccgggacaagggcttcctgtgccccgagttccccgggagcttccgcaagaagtgcaacttcgccaccacgccgatctgcgagtacgacggcaacatggtctccggctacaagaaggtgatggccaccatcgacagcttccagtccttcaacaccagcaccatgcacttcacggacgagcggatcgagtggaaggaccccgacgggatgctccgcgaccacatcaacatcctggtgaccaaggacatcgacttcgacaacctgggcgagaacccctgcaagatcgggctccagacctccagcatcgagggcgcctgggggtccggcgtcggcttcaccagcacgtgcctggtgagcctgaccgagtgccccaccttcctcacctccatcaaggcgtgcgacaaggccatctgctacggggccgagagcgtgacgctgacccggggccagaacaccgtcaaggtgtccgggaagggcgggcacagcggctccaccttcaagtgctgccacggcgaggactgcagccagatcgggctgcacgccgccgcgccgcacctcgacaaggtgaacggcatctccgagatggagaacagcaaggtctacgacgacggggccccccagtgcggcatcaagtgctggttcgtgaagtccggcgagtggatcagcgggatcttctccggcaactggatcgtcctgatcgtgctgtgcgtgttcctcctgttcagcctggtcctcctgtccatcctgtgccccgtgcgcaagcacaagaagagctga

SEQ ID NO: 11719 - RNA, 3408 nt, synthetic construct
  misc_feature 1..3408: note = derived and/or modified CDS sequence (opt1) from HTNV(US8A15-1)__KU207205.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcggggagaacagcgtgatcggctacgtggagctcccccccatgcccctggccgacacggcgcagctggtcccggagtccagctgctccatggacaaccaccagagcctcaacaccatcaccaagtacacccaggtgtcctggcgggggaaggccgaccagagccagtccagccagaactccttcgagacggtgagcaccgaggtcgacctgaagggcacctgcgtgctgaagcacaagatggtggaggagtcctaccgcagccggaagtccatcacctgctacgacctcagctgcaactccacgtactgcaagcccaccctgtacatgatcgtccccatccacgcctgcaacatgatgaagagctgcctgatcgccctcgggccctaccgcgtgcaggtggtctacgagcggacctactgcatgaccggcgtgctgatcgagggcaagtgcttcgtgccggaccagtccgtcgtgagcatcatcaagcacgggatcttcgacatcgccagcgtgcacatcgtctgcttcttcgtggcggtgaagggcaacacgtacaagatcttcgagcaggtcaagaagtccttcgagagcacctgcaacgacaccgagaacaaggtgcaggggtactacatctgcatcgtcggcgggaactccgcccccatctacgtgcccaccctggacgacttccgcagcatggaggccttcacgggcatcttccggtccccccacggcgaggaccacgacctcgccggggaggagaccgcgacctacagcatcgtgggcccggccaacgccaaggtcccccactccgccagctccgacaccctgagcctgatcgccttctccgggatccccagctactccagcctctccatcctgacgagctccaccgaggcgaagcacgtgttcagccccggcctgttcccgaagctcaaccacaccaactgcgacaagggcgccatccccctgatgtggaccgggatgatcgacctgcccggctactacgaggccatccacccctgcacggtgttctgcgtcctctccgggccgggcgccagctgcgaggccttcagcgaggggggcatcttcaacatcacctcccccatgtgcctggtgagcaagcagaaccgcttccggctgaccgagcagcaggtgaacttcgtctgccagcgcgtggacgtggacatcgtcgtgtactgcaacggccagcggaaggtgatcctcaccaagacgctggtcatcgggcagtgcatctacaccatcacctccctgttcagcctcctgcccggcgtggcgcactccatcgccgtggagctgtgcgtccccgggttccacggctgggccaccgccgccctcctggtgacgttctgcttcgggtgggtgctgatcccggcgatcaccttcatcatcctcaccatcctgaagttcatcgccaacatcttccacaccagcaaccaggagaaccgcctgaagtccgtcctccggaagatcaaggaggagttcgagaagacgaagggcagcatggtgtgcgacgtgtgcaagtacgagtgcgagacctacaaggagctgaaggcccacggcgtctcctgcccccagagccagtgcccctactgcttcacccactgcgagcccaccgaggccgccttccaggcgcactacaaggtgtgccaggtgacccaccgcttccgggacgacctgaagaagacggtcaccccgcagaacttcacccccgggtgctaccgcaccctcaacctgttccggtacaagtcccgctgctacatcttcacgatgtggatcttcctgctcgtgctggagagcatcctgtgggccgcctccgccagcgagacccccctcaccccggtgtggaacgacaacgcgcacggcgtcgggtccgtgcccatgcacaccgacctggagctggacttcagcctgacgtccagcagcaagtacacctaccggcgcaagctcaccaaccccctggaggaggcccagtccatcgacctgcacatcgagatcgaggagcagaccatcggcgtggacgtccacgccctcgggcactggttcgacggccggctgaacctgaagacgagcttccactgctacggcgcctgcaccaagtacgagtacccctggcacaccgccaagtgccactacgagcgcgactaccagtacgagacctcctgggggtgcaacccgagcgactgccccggcgtggggacgggctgcaccgcgtgcggcctctacctggaccgcctgaagcccgtggggtccgcctacaagatcatcaccatccggtacagccgccgggtctgcgtgcagttcggcgaggagaacctctgcaagatcatcgacatgaacgactgcttcgtgtcccgccacgtcaaggtgtgcatcatcgggaccgtgagcaagttctcccagggcgacacgctgctgttcttcgggcccctcgagggcggcgggctgatcttcaagcactggtgcaccagcacctgccagttcggcgacccgggggacatcatgtccccccgggacaagggcttcctgtgccccgagttccccgggagcttccgcaagcactgcaacttcgccaccacgccgatctgcgagtacgacggcaacatggtctccggctacaagaaggtgatggccaccatcgacagcttccagtccttcaacaccagcaccatgcacttcacggacgagcggatcgagtggaaggaccccgacgggatgctccgcgaccacatcaacatcctggtgaccaaggacatcgacttcgacaacctgggcgagaacccctgcaagatcgggctccagacctccagcatcgagggcgcctgggggtccggcgtcggcttcaccctgacgtgcctggtgagcctcaccgagtgccccaccttcctgaccagcatcaaggcgtgcgacaaggccatctgctacggggccgagtccgtgacgctgacccggggccagaacaccgtcaaggtgagcgggaagggcgggcactccggcagcaccttcaagtgctgccacggcgaggactgctcccagatcgggctccacgccgccgcgccgcacctggacaaggtgaacggcatcagcgagatggagaactccaaggtctacgacgacggggccccccagtgcggcatcaagtgctggttcgtgaagagcggcgagtggatctccgggatcttcagcggcaactggatcgtcctgaccgtgctctgcgtgttcctgctgttctccctcgtcctgctgagcatcctctgccccgtgcgcaagcacaagaagtcctga

SEQ ID NO: 11720 - RNA, 3408 nt, synthetic construct
  misc_feature 1..3408: note = derived and/or modified CDS sequence (opt1) from HTNV(Lee)__D00377.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcggggagaacagcgtgatcggctacgtggagctcccccccatgcccctggccgacacggcgcagctggtcccggagtccagctgctccatggacaaccaccagagcctcaacaccatcaccaagtacacccaggtgtcctggcgggggaaggccgaccagagccagtccagccagacgtccttcgagaccgtgagcaccgaggtcgacctgaagggcacctgcgtgctgaagcacaagatggtggaggagtcctaccgcagccggaagtccatcacgtgctacgacctcagctgcaactccacctactgcaagcccaccctgtacatgatcgtccccatccacgcctgcaacatgatgaagagctgcctgatcgccctcgggccctaccgcgtgcaggtggtctacgagcggacctactgcatgacgggcgtgctgatcgagggcaagtgcttcgtgccggaccagtccgtcgtgagcatcatcaagcacgggatcttcgacatcgccagcgtgcacatcgtctgcttcttcgtggcggtgaagggcaacacctacaagatcttcgagcaggtcaagaagtccttcgagagcacctgcaacgacaccgagaacaaggtgcaggggtactacatctgcatcgtcggcgggaactccgcccccatctacgtgcccacgctggacgacttccgcagcatggaggccttcaccggcatcttccggtccccccacggcgaggaccacgacctcgccggggaggagaccgcgacctacagcatcgtgggcccggccaacgccaaggtcccccactccgccagctccgacacgctgagcctgatcgccttctccgggatccccagcgactccagcctctccatcctgaccagctccaccgaggcgaagcacgtgttcagccccggcctgttcccgaagctcaaccacaccaactgcgacaagggcgccatccccctgatgtggacggggatgatcgacctgcccggctactacgaggccatccacccctgcaccgtgttctgcgtcctctccgggccgggcgccagctgcgaggccttcagcgaggggggcatcttcaacatcacctaccccatgtgcctggtgtccaagcagaaccgcttccggctgaccgagcagcaggtgaacttcgtctgccagcgcgtggacgtggacatcgtcgtgtactgcaacggccagcggaaggtgatcctcacgaagaccctggtcatcgggcagtgcatctacaccatcaccagcctgttctccctcctgcccggcgtggcgcacagcatcgccgtggagctgtgcgtccccgggttccacggctgggccacggccgccctcctggtgaccttctgcttcgggtgggtgctgatcccggcgatcaccttcatcatcctcaccatcctgaagttcatcgccaacatcttccacacgtccaaccaggagaaccgcctgaagagcgtcctccggaagatcaaggaggagttcgagaagaccaagggctccatggtgtgcgacgtgtgcaagtacgagtgcgagacctacaaggagctgaaggcccacggcgtcagctgcccccagtcccagtgcccctactgcttcacccactgcgagcccaccgaggccgccttccaggcgcactacaaggtgtgccaggtgacgcaccgcttccgggacgacctgaagaagaccgtcaccccgcagaacttcacccccgggtgctaccgcacgctcaacctgttccggtacaagagccgctgctacatcttcaccatgtggatcttcctgctcgtgctggagtccatcctgtgggccgccagcgcctccgagacccccctcaccccggtgtggaacgacaacgcgcacggcgtcgggagcgtgcccatgcacacggacctggagctggacttctccctgaccagctccagcaagtacacctaccggcgcaagctcaccaaccccctggaggaggcccagagcatcgacctgcacatcgagatcgaggagcagacgatcggcgtggacgtccacgccctcgggcactggttcgacggccggctgaacctgaagacctccttccactgctacggcgcctgcaccaagtacgagtacccctggcacaccgccaagtgccactacgagcgcgactaccagtacgagacgagctgggggtgcaacccgtccgactgccccggcgtggggaccggctgcaccgcgtgcggcctctacctggaccgcctgaagcccgtggggagcgcctacaagatcatcaccatccggtactcccgccgggtctgcgtgcagttcggcgaggagaacctctgcaagatcatcgacatgaacgactgcttcgtgagccgccacgtcaaggtgtgcatcatcgggacggtgtccaagttcagccagggcgacaccctgctgttcttcgggcccctcgagggcggcgggctgatcttcaagcactggtgcacctccacctgccagttcggcgacccgggggacatcatgagcccccgggacaagggcttcctgtgccccgagttccccgggtccttccgcaagaagtgcaacttcgccacgaccccgatctgcgagtacgacggcaacatggtcagcggctacaagaaggtgatggccaccatcgactccttccagagcttcaacacctccacgatgcacttcaccgacgagcggatcgagtggaaggaccccgacgggatgctccgcgaccacatcaacatcctggtgaccaaggacatcgacttcgacaacctgggcgagaacccctgcaagatcgggctccagaccagctccatcgagggcgcctgggggagcggcgtcggcttcacgctgacctgcctggtgtccctcaccgagtgccccaccttcctgacgagcatcaaggcgtgcgacaaggccatctgctacggggccgagagcgtgaccctgacccggggccagaacaccgtcaaggtgtccgggaagggcgggcacagcggctccaccttcaagtgctgccacggcgaggactgcagccagatcgggctccacgccgccgcgccgcacctggacaaggtgaacggcatctccgagatggagaacagcaaggagtacgacgacggggccccccagtgcggcatcaagtgctggttcgtcaagtccggcgagtggatcagcgggatcttctccggcaactggatcgtgctgatcgtcctctgcgtgttcctgctgttcagcctcgtgctgctgtccatcctctgccccgtccgcaagcacaagaagagctga

SEQ ID NO: 11721 - RNA, 3384 nt, synthetic construct
  misc_feature 1..3384: note = derived and/or modified CDS sequence (opt1) from HTNV(M)__U38177.1__GP
  source 1..3384: mol_type = other RNA
atggccagcctggtgtggcccgtcctcaccctgcgcaacgtgtacgacatgaagatcgagtgcccgcacaccgtgtccttcggcgagaacagcgtcatcgggtacgtggagctgccgcccgtgcccctcgccgacacggcccagatggtccccgagtccagctgcaacatggacaaccaccagtccctgaacaccatcaccaagtacacccaggtgagctggcggggcaaggccgaccagtcccagagctcccagaacagcttcgagacggtgtccaccgaggtcgacctgaaggggacctgcgtgctcaagcacaagatggtggaggagagctaccgctcccgcaagagcgtcacgtgctacgacctgtcctgcaacagcacgtactgcaagcccaccctgtacatgatcgtgcccatccacgcctgcaacatgatgaagtcctgcctcatcgccctgggcccctaccgcgtgcaggtcgtgtacgagcggagctactgcatgaccggggtgctgatcgagggcaagtgcttcgtcccggaccagtccgtggtgagcatcatcaagcacggcatcttcgacatcgccagcgtccacatcgtgtgcttcttcgtggcggtcaaggggaacacctacaagatcttcgagcaggtcaagaagtccttcgagagcacgtgcaacgacaccgagaacaaggtccagggctactacatctgcatcgtcgggggcaactccgcccccatctacgtgcccaccctcgacgacttccgcagcatggaggccttcaccgggatcttccggagcccccacggcgaggaccacgacctggccggcgaggagatcgcgtcctactccatcgtgggggccgccaacgccaaggtgccgcacagcgcctccagcgacacgctgcgcctcatcgcgtactccggcatccccagctactccagcctgtccatcctgaccagctccaccgaggccaagcacgtgttcagccccggcctcttccccaagctgaaccacaccaactgcgacaagtccgccatcccgctgatctggacgggcatgatcgacctccccggctactacgaggccgtccacccctgcaccgtgttctgcgtgctgagcgggcccggggccagctgcgaggcgttctccgagggcgggatcttcaacatcaccagcccgatgtgcctggtgtccaagcagaaccggttccggctcaccgagcagcaggtcaacttcgtgtgccagcgggtggacatggacatcgtggtgtactgcaacgggcagcgcaaggtcatcctgaccaagaccctggtgatcggccagtgcatctacaccatcaccagcctcttctccctgctgcccggcgtggcccacagcatcgccgtcgagctctgcgtgcccgggttccacggctgggccacggccgcgctgctggtgaccttctgcttcgggtgggtcctcatccccgccatcaccttcatcatcctgaccgtgctgaagttcatcgccaacatcttccacacgtccaaccaggagaaccggctcaagagcgtgctgcgcaagatcaaggaggagttcgagaagaccaagggctccatggtctgcgacgtgtgcaagtacgagtgcgagacctacaaggagctgaaggcccacggggtgagctgcccgcagtcccagtgcccctactgcttcacccactgcgagcccacggaggccgcgttccaggcccactacaaggtctgccaggtgacccaccggttccgcgacgacctcaagaagaccgtgacgccccagaacttcaccccgggctgctaccggaccctgaacctgttccgctacaagagccggtgctacatcttcaccatgtggatcttcctcctggtcctggagtccatcctctgggccgccagcgcgtccgagacgcccctgacccccgtgtggaacgacaacgcccacggcgtggggagcgtcccgatgcacaccgacctggagctcgacttctccctgaccagcagctccaagtacacctaccgccggaagctgaccaaccccctggaggaggcccagagcatcgacctccacatcgagatcgaggagcagacgatcggcgtggacgtgcacgccctggggcactggttcgacggccgcctgaacctcaagacctccttccactgctacggggcctgcaccaagtacgagtacccctggcacaccgcgaagtgccactacgagcgcgactaccagtacgagacgagctggggctgcaacccctccgactgcccgggcgtcgggaccggctgcaccgcctgcgggctgtacctggaccagctcaagcccgtgggcagcgcctacaagatcatcaccatccggtactcccgccgggtgtgcgtccagttcggcgaggagaacctgtgcaagatcatcgacatgaacgactgcttcgtgagccgccacgtgaaggtctgcatcatcgggacggtgtccaagttcagccagggcgacaccctcctgttcttcgggcccctggagggcgggggcctgatcttcaagcactggtgcaccagcacgtgccagttcggcgaccccggggacatcatgagcccgcgggacaagggcttcctctgccccgagttccccgggtccttccgcaagaagtgcaacttcgccaccacccccatctgcgagtacgacggcaacatggtgagcgggtacaagaaggtcatggccaccatcgactccttccagagcttcaacacctccacgatgcacttcaccgacgagcggatcgagtggaaggacccggacggcatgctgcgcgaccacatcaacatcctggtgaccaaggacatcgacttcgacaacctcggcgagaacccctgcaagatcgggctgcagaccagctccatcgagggcgcgtgggggagcggcgtggggttcacgctgacctgcctcgtcagcctgaccgagtgccccaccttcctgacgtccatcaaggcctgcgacaaggccatctgctacggcgccgagagcgtgaccctcacccggggccagaacaccgtgaaggtctccgggaagggcgggcacagcggctccacgttcaagtgctgccacggggaggactgcagccagatcggcctgcacgccgcggcgccccacctggacaaggtgaacggcatctccgagatcgagaacagcaaggtctacgacgacggggccccgcagtgcggcatcaagtgctggttcgtgaagtccggggagtggatcagcggcatcttctccggcaactggatcgtgctcatcgtcctgtgcgtgttcctcctgttcagcctggtgctgctctccatcctgtgccccgtccgcaagcacaagaagtcctga

SEQ ID NO: 11722 - RNA, 3408 nt, synthetic construct
  misc_feature 1..3408: note = derived and/or modified CDS sequence (opt1) from HTNV(N8)__EF077656.1__GP
  source 1..3408: mol_type = other RNA
atgggcatctggaagtggctggtgatggccagcctcgtctggcccgcctacaccctgcgcaacgtgtacgacatgaagatcgagtgcccgcacaccgtgagcttcggggagaacagcgtcatcggctacgtggagctgccgcccatgcccctcgcggacacggcccagatggtgcccgagtccagctgcaacatggacaaccaccagtccatgaacaccatcaccaagtacacccaggtcagctggcgggggaaggccgaccaggcccaggcctcccagaacagcttcgaggcggtgtccgccgaggtggacctgaagggcacgtgcgtcctgaagcacaagatgctcgaggagagctaccgctcccgcaagagcatcacgtgctacgacctgtcctgcaacaacacctactgcaagcccaccctgtacatgatcgtgcccatccacgcctgcaacatgatgaagtcctgcctcatcgccctggggccctaccgggtgcaggtcatctacgagcggacctactgcatgaccggcgtgctgatcgagggcaagtgcttcgtgccggaccagtccgtcgtgagcatcatcaagcacgggatcttcgacatcgcgtccgtgcacatcgtctgcttcttcgtggccgtgaagggcaacacctacaagctgttcgagcaggtcaagaagtccttccagagcacgtgcaacgacaccgagaacaaggtgcaggggtactacatctgcatcgtgggcgggaacagcgcccccatctacgtccccaccctggacgacttccgcagcatggaggccttctccggcatcttccggagcccccacggcgaggaccacgacctggccggggaggagatcgcgtcctacagcatcgtgggcccggccaacgccaaggtcccccactccgccagctccgacaccctcagcctgatcgcctactccgggatccccagctactccagcctgtccatcctcaccggcagcacggaggcgaagcacgtgttctcccccggcttcttcccgcagctgaaccacaccaagtgcgacaagaccgccatccccctgacctggacggggatgatcgacctccccggctactacgaggccatccacccctgcaccgtgttctgcgtcctgagcgggccgggcgcctcctgcgaggccttcagcgagggcgggatcttcaacatcacctcccccatgtgcctggtgagcaagcagaaccgcttccggctcaccgagcagcaggtcaacttcgtgtgccagcgcgtggacatggacatcatcgtgtactgcaacggccagcggaaggtcatcctgacgaagaccctggtgatcgggcagtgcatctacaccatcaccagcctcttctccctgctgcccggcgtggcgcacagcatcgccgtcgagctctgcgtgcccgggttccacggctgggccacggccgccctgctggtgaccttctgcttcgggtgggtcctcatcccggcgatcaccttcatcatcctgaccgtgctgaagttcatcgccaacatcttccacacgtccaaccaggagaaccgcctccgggccgtgctgcgcaagatcaaggaggagttcgagaagaccaagggcagcatggtctgcgacgtgtgcaagtacgagtgcgagacctacaaggagctgaaggcccacggcgtgtcctgcccccagagccagtgcccctactgcttcacccactgcgagcccacggaggcggccttccaggcccactaccgggtctgccaggtgacccaccgcttccgggacgacctcaagaagaccgtgaccccgcagaacttcacccccgggtgctaccgcacgctgaacctgttccggtacaagtcccgctgctacatcttcaccatgtgggtctgcctcctggtgctggagagcatcctctgggccgcctccgcgagcgaggtgcccctgaacccggtctggaacgacaacgcccacggcgtggggtccgtgcccatgcacaccgacctggagctcgacttcagcctgacctccagctccaagtacacgtaccggcgccgcctgaccaaccccctggaggagacccaggccatcaacctccacatcgagatcgaggagcagaccatcggcgtcgacgtgcacgccctggggcactggttcgacggccggctgaacctcaagacgagcttccactgctacggcgcctgcaccaagtacgagtacccctggcacaccgcgaagtgccactacgagcgcgactaccagtacgagacctcctgggggtgcaacccggccgactgccccggcgtggggacgggctgcaccgcctgcggcctgtacatcgaccagctgaagcccgtcgggagcgcctacaagatcatcaccatccggtacagccgcaaggtgtgcgtgcagttcggcgaggagaacctctgcaaggtcatcgacatgaacgactgcttcgtgtcccggcacgtgaaggtctgcatcatcgggaccgtgagcaagttctcccagggcgacacgctgctgttcttcgggcccctcgagggcggcgggctgatcttcaagcactggtgcaccagcacgtgccagttcggcgacccgggggacatcatgagcccccgcgacaagggcttcctgtgccccgagttccccgggagcttccggaagaagtgcaacttcgccaccaccccgctctgcgagtacgacggcaacatggtgtccggctacaagaaggtcatggcgaccatcgacagcttccagtccttcaacaccagcaccatgcacttcacggacgagcgcatcgagtggaaggaccccgacgggatgctgcgggaccacatcaacatcctggtgaccaaggacatcgacttcgacaacctcggcgagaacccctgcaagatcgggctgcagacctccagcatcgagggcgcctgggggtccggcgtgggcttcaccctgacgtgcctcgtcagcctgaccgagtgccccaccttcctgacctccatcaaggcctgcgacaaggccatctgctacggggcggagagcgtggccctcacgcgcggccagaacaccgtgaaggtctccgggaagggcgggcacagcggctccaccttcaagtgctgccacggcgaggagtgcagccagatcgggctgcacgccgccgccccgcacctggacaaggtgaacggcatcagcgaggtggagaacaacaaggtctacgacgacggggcgccccagtgcggcgtgaagtgctggttcgtcaagtccggcgagtggatcagcgggatcttctccggcaactggatcgtgctcatcgtgctgtgcgtcttcctcctcttcagcctggtgctgctctccgtgctgtgccccgtccggaagcacaagaagtcctga

SEQ ID NO: 11723 - RNA, 3408 nt, synthetic construct
  misc_feature 1..3408: note = derived and/or modified CDS sequence (opt1) from HTNV(Q32)__DQ371905.1__GP
  source 1..3408: mol_type = other RNA
atgggcatctggaagtggctggtgatggccagcctcgtctggcccgccttcgcgctgcgcaacgtgtacgacatgaagatcgagtgcccgcacaccgtgtccttcggggagaacagcgtcatcggctacgtggagctgccgcccatgcccctcgccgacaccacgcagatggtgcccgagtccagctgctccatggacaaccaccagagcctgaacaccatcaccaagtacacccagatcatctggcgggggaaggccgaccagtcccagagctcccagaacagcttcgagacggtctccaccgaggtggacctgaaggggacctgcgtgctcaagcacaagatgatcgaggagagctaccgctcccgcaagagcatcacgtgctacgacctgtcctgcaacagcacctactgcaagcccaccctgtacatgatcgtccccatccacgcctgcaacatgatgaagtcctgcctcatcgccctggggccctaccgggtccaggtggtgtacgagcggacctactgcatgaccggcgtgctgatcgagggcaagtgcttcgtgccggaccagagcgtcgtgtccatcatcaagcacgggatcttcgacatcgcgagcgtgcacatcgtctgcttcttcgtggccgtgaagggcaacacgtacaagatcttcgagcaggtcaagaagtccttcgagtccaactgcaacgacaccgagaacaaggtgcaggggtactacatctgcatcatcggcgggaacagctcccccgtgtacgtccccaccctcgacgacttccgcagcatggaggccttctccggcatcttccggagcccccacggcgaggaccacgacctggccggggaggaggtggcgtcctacagcatcgtcggcccggccaacgccaaggtgccccactccgccagctccgacaccctggggctcatcgcctacttcggcatccccagctactccagcctgtccatcctgacgagctccaccgaggcgaagcacgtgttcagccccggcctcttcccgcagctgaaccacaccaagtgcgacaagaccgccatccccctgacgtggaccgggatgatcgacctccccggctactacgaggccatccacccctgcaccgtcttctgcgtgctgtccgggccgggcgccagctgcgaggccttcagcgagggcggcatcttcaacatcacctcccccatgtgcctggtgagcaagcagaaccgcttccggctcacggagcagcaggtcaacttcgtgtgccagcgcgtggacgtcgacatcatcgtgtactgcaacggccagcggaaggtgatcctgaccaagaccctggtcatcgggcagtgcatctacaccatcacgtccctcttcagcctgctgcccggcgtggcgcactccatcgccgtggagctctgcgtccccgggttccacggctgggccaccgccgccctgctggtgaccttctgcttcgggtgggtgctcatcccggcgatcaccttcatcatcctgacgatcctgaagttcatcgccaacatcttccacaccagcaaccaggagaaccgcctcaagtccgtcctgcggaagatcaaggaggagttcgagcgcaccaagggcagcatggtgtgcgacatctgcaagtacgagtgcgagacctacaaggagctgaaggcccacggcgtgtcctgcccccagagccagtgcccctactgcttcacgcactgcgagcccaccgaggccgccttccaggcgcactacaaggtctgccaggtgacccaccggttccgcgacgacctcaagaagaccgtgaccccgcagaacttcacgcccgggtgctaccggaccctgaacctgttccgctacaagtcccggtgctacatcttcaccatgtgggtcttcctcctggtgctggagagcatcctctgggccgcctccgccagcgagatccccctgaacccggtgtggaacgacaacgcgcacggcgtcgggtccatccccatgcacaccgacctggagctcgacttcagcctgacgtccagcagcaagtacacctaccgccggaagctgaccaaccccctggaggagtcccaggccatcgacctccacgtggagatcgaggagcagaccatcggcgtggacgtccacgccctggggcactggttcgacggccgcctgaacctcaagacgagcttccactgctacggcgcctgcaccaagtacgagtacccctggcacaccgccaagtgccactacgagcgcgactaccagtacgagacctcctgggggtgcaacccgagcgactgccccggcgtggggacgggctgcaccgcgtgcggcctgtacctggaccagctcaagcccgtggggtccgcctacaagatcatcaccatccggtacagccgccgggtctgcgtgcagttcggcgaggagaacctgtgcaagatcatcgacatgaacgactgcttcgtgtcccgccacgtcaaggtgtgcatcatcgggaccgtgagcaagttctcccagggcgacacgctgctgttcttcgggcccctggagggcggcgggctgatcttcaagcactggtgcaccagcacgtgccagttcggcgacccgggggacatcatgagcccccgggacaagggcttcctctgccccgagttccccgggagcttccgcaagaagtgcaacttcgccaccaccccggtctgcgagtacgacggcaacatggtgtccggctacaagaaggtgatggccaccatcgacagcttccagtccttcaacaccagcaccatgcacttcacggacgagcggatcgagtggaaggaccccgacgggatgctgcgcgaccacatcaacatcctggtcaccaaggacatcgacttcgacaacctcggcgagaacccctgcaagatcgggctgcagacctccagcatcgagggcgcctgggggtccggcgtgggcttcaccctgacgtgcctcatcagcctgaccgagtgcagcaccttcctgacctccatcaaggcgtgcgacaaggccatctgctacggggccgagagcgtgacgctcatccggggccagaacaccgtcaaggtgtccgggaagggcgggcacagcggctccagcttcaagtgctgccacggcgaggagtgctcccagatcgggctgcacgccgccgcgccccacctggacaaggtgaacggcatcagcgagatggagaactccaaggtcttcgacgacggggccccgcagtgcggcatcaagtgctggttcgtcaagagcggcgagtggatctccgggatcttcagcggcaactggatcgtgctcatcgtgctgtgcgtgttcctcctcttctccctggtcctgctcagcatcctgtgccccgtgcgcaagcacaagaagtcctga

SEQ ID NO: 11724 - RNA, 3408 nt, synthetic construct
  misc_feature 1..3408: note = derived and/or modified CDS sequence (opt1) from HTNV(Bao14)__AB127995.1__GP
  source 1..3408: mol_type = other RNA
atgggcatgtggaagtggctggtgatcgccagcctcgtctggcccgccctggcgctgcgcaacgtgtacgacatgaagatcgagtgcccgcacaccgtgtccttcggggagaacagcgtcatcggctacgtggagctcccccccatgcccctggccgacaccgcccagatggtgccggagtccagctgctccatggacaaccaccagagcatcaacacgatcaccaagtacacccaggtcatctggcgggggaaggccgaccccggccagtccagccagaactccttcgagaccgtgagcacggaggtggacctgaaggggacctgcgtcctcaagcacaagatggtggaggagtcctaccgcagccggaagtccatcacctgctacgacctgagctgcaactccacctactgcaagcccacgctgtacatgatcgtgcccatccacgcctgcaacatgatgaagagctgcctcatcgcgctgggcccgtaccgcgtccaggtggtgtacgagcggacctactgcatgaccggcgtcctgatcgaggggaagtgcttcgtgcccgaccagtccgtggtcagcatcatcaagcacggcatcttcgacatcgcctccgtgcacatcgtgtgcttcttcgtcgccgtgaaggggaacacctacaagctcttcgagcaggtgaagaagagcttcgagagcacgtgcaacgacaccgagaacaaggtccagggctactacatctgcatcgtggggggcaactccgcccccatctacgtccccaccctggacgacttccgcagcatggaggcgttcaccggcatcttcaagtccccgcacggggaggaccacgacctggccggcgaggagatcgccagctactccatcgtggggcccgccaacgccaaggtgccccacagcgcgtccagcgacacgctctccctgatcgcctacagcggcatcccctcctacagctccctgagcatcctcacctccagcaccgacgccaagcacgtcttctccccgggcctgttccccaagctgaaccacaccaactgcgacaagagcgccatccccctcacgtggaccgggatgatcgacctgcccggctactacgaggccatccacccgtgcaccgtgttctgcgtgctgtccgggcccggcgcgagctgcgaggccttcagcgaggggggcatcttcaacatcacctcccccatgtgcctcgtcagcaagcagaaccggttccgcctgacggagcagcaggtgaacttcgtgtgccagcgggtcgacatggacatcgtggtgtactgcaacggccagcgcaaggtcatcctgaccaagaccctcgtgatcgggcagtgcatctacaccatcacgtccctgttcagcctgctccccggcgtggcccactccatcgccgtcgagctgtgcgtgccggggttccacggctgggccaccgcggccctgctcgtgaccttctgcttcgggtgggtcctgatccccgccgtgaccttcatcatcctgacggtgctcaagttcatcgccaacatcttccacaccagcaaccaggagaaccggctgaagtccgtcctgcgcaagatcaaggaggagttcgagaagaccaagggcagcatggtgtgcgacgtgtgcaagtacgagtgcgagacctacaaggagctcaaggcccacggcgtctcctgcccccagagccagtgcccctactgcttcacgcactgcgagccgaccgaggcggccttccaggcccactacaaggtgtgccaggtgacccaccggttccgcgacgacctgaagaagaccgtcaccccccagaacttcacgcccgggtgctaccggaccctgaacctcttccgctacaagtcccggtgctacatcttcaccatgtgggtgttcctgctgatcctcgagagcgtgctgtgggccgcgtccgccagcgagaccccgctgacgcccgtctggaacgacaacgcccacggcgtggggtccgtgcccatgcacaccgacctcgagctggacttcagcctgacctccagcagcaagtacacctaccgccggaagctgacgaaccccctcgaggaggcccagtccatcgacctgcacatcgagatcgaggagcagaccatcggcgtcgacgtgcacgccctggggcactggttcgacggccgcctcaacctgaagaccagcttccactgctacggcgcgtgcaccaagtacgagtacccgtggcacacggccaagtgccactacgagcgggactaccagtacgagacctcctgggggtgcaaccccagcgactgccccggcgtggggaccggctgcaccgcctgcggcctgtacctcgaccagctgaagcccgtcgggtccgcctacaagatcatcacgatccgctacagccgccgggtgtgcgtgcagttcggcgaggagaacctgtgcaagatcatcgacatgaacgactgcttcgtctcccgccacgtgaaggtgtgcatcatcgggaccgtcagcaagttctcccagggcgacaccctcctgttcttcgggccgctggagggcggcgggctcatcttcaagcactggtgcaccagcacgtgccagttcggcgaccccggggacatcatgtccccccgggacaagggcttcctgtgccccgagttcccggggagcttccgcaagaagtgcaacttcgccaccacccccatctgcgagtacgacggcaacatggtgtccggctacaagaaggtgatggcgaccatcgacagcttccagtccttcaacacgagcaccatgcacttcaccgacgagcggatcgagtggaaggaccccgacgggatgctgcgcgaccacatcaacatcctcgtcaccaaggacatcgacttcgacaacctgggcgagaacccctgcaagatcgggctgcagacgtccagcatcgagggcgcctgggggtccggcgtgggcttcaccctcacctgcctggtgagcctgaccgagtgcccgacgttcctcaccagcatcaaggcctgcgacaaggccatctgctacggggccgagtccgtcaccctgacccggggccagaacacggtgcgcgtgagcgggaagggcgggcactccggcagcaccttcaagtgctgccacggcgaggactgctccaagatcgggctgcacgcggccgccccccacctcgacaaggtcaacggcatcagcgagatcgagaactccaaggtgtacgacgacggggccccccagtgcggcatcaagtgctggttcgtcaagagcggcgagtggatctccgggatcttcagcggcaactggatcgtgctgatcgtgctgtgcgtcttcctcctgttctccctggtgctcctgagcatcctgtgccccgtgcggaagcacaagaagtcctga

SEQ ID NO: 11725 - RNA, 3408 nt, synthetic construct
  misc_feature 1..3408: note = derived and/or modified CDS sequence (opt1) from HTNV(HubeiHu02)__JQ665881.1__GP
  source 1..3408: mol_type = other RNA
atgggcatctggaagtggctggtgatggccagcctcgtctggcccgccttcgccctgcgcaacgtgtacgacatgaagatcgagtgcccgcacaccgtgtccttcggggagaacagcgtcatcggctacgtggagctgccgcccatgcccctcgccgacaccgcccagatggtgcccgagtccagctgctccatggacaaccaccagagcctgaacacgatcaccaagtacacccagatcgtctggcgggggaaggccgaccagtcccagagctcccagaacagcttcgagaccgtgtccacggaggtggacctgaaggggacctgcgtcctcaagcacaagatggtggaggagagctaccgctcccgcaagagcatcacgtgctacgacctgtcctgcaacagcacctactgcaagcccaccctgtacatgatcgtgcccatccacgcctgcaacatgatgaagtcctgcctcatcgcgctggggccctaccgggtccaggtggtgtacgagcggacctactgcatgaccggcgtcctgatcgagggcaagtgcttcgtgccggaccagagcgtggtctccatcatcaagcacgggatcttcgacatcgccagcgtgcacatcgtgtgcttcttcgtcgccgtgaagggcagcacctacaagctgttcgagcaggtcaagaagtccttcgagagcaactgcaacgacacggagaacaaggtgcaggggcactacatctgcatcgtgggcgggaactccgcccccatctacgtccccaccctggacgacttccgcagcatggaggcgttctccggcatcttcaagagcccccacggcgaggaccacgacctggccggggaggaggtggcctcctacagcatcgtgggcccggccaacgccaaggtcccccactccgcgagctccgacaccctcagcctgatcgcctactccgggatccccagctactccagcctgtccatcctcaccagcctgacggaggccaagcacgtgttctcccccggcctgttcccgcagctcaaccacaccaagtgcgacaagaccgccatccccctgacctggacgggcatgatcgacctgcccgggtactacgaggccgtgcacccctgcaccgtcttctgcgtgctcagcggcccgggggcgagctgcgaggccttctccgagggcgggatcctgaacatcaccagccccatgtgcctggtgtccaagcagaaccggttccgcctcaccgagcagcaggtcaacttcgtgtgccagcgggtggacgtcgacatcgtggtgtactgcaacggccagcgcaaggtcatcctgacgaagaccctggtgatcggccagtgcatctacaccatcaccagcctcttctccctgctgcccggggtggcccacagcatcgccgtcgagctctgcgtgcccggcttccacgggtgggccacggcggccctgctggtgaccttctgcttcggctgggtcctcatcccggccatcaccttcatcatcctgaccatcctgaagttcatcgccaacatcttccacacgtccaaccaggagaaccggctcaagagcgtgctgcgcaagatcaaggaggagttcgagcggaccaaggggtccatggtgtgcgacgtctgcaagtacgagtgcgagacctacaaggagctgaaggcccacggcgtgagctgcccccagtcccagtgcccctactgcttcacccactgcgagcccacggaggcggccttccaggcccactacaaggtgtgccaggtcacccaccgcttccgggacgacctcaagaagaccgtgaccccgcagaacttcacccccggctgctaccgcacgctgaacctgttccggtacaagagccgctgctacatcttcaccatgtgggtgttcctcctggtcctggagtccatcctctgggccgcgagcgcctccgagacgcccctgaacccggtgtggaacgacaacgcccacggggtgggcagcgtccccatgcacaccgacctggagctggacttctccctcaccagcagctccaagtacacctaccggcgcaagctgaccaaccccctggaggagagccaggccatcaacctccacatcgagatcgaggagcagaccatcggggtggacgtgcacgccctgggccactggttcgacgggcggctgaacctcaagacgtccttccactgctacggcgcgtgcaccaagtacgagtacccctggcacaccgccaagtgccactacgagcgcgactaccagtacgagaccagctggggctgcaacccgtccgactgccccggggtcggcacggggtgcaccgcctgcggcctgtacctggaccagctcaagcccgtgggcagcgcctacaagatcatcaccatccgctactcccggcgcgtgtgcgtccagttcggggaggagaacctgtgcaagatcatcgacatgaacgactgcttcgtgagccggcacgtgaaggtctgcatcatcggcaccgtgtccaagttcagccagggggacacgctcctcttcttcggccccctggagggcggcggcctgatcttcaagcactggtgcacctccacgtgccagttcggggacccgggcgacatcatgagcccccgcgacaaggggttcctctgccccgagttccccggctccttccggaagaagtgcaacttcgccaccaccccgatctgcgagtacgacgggaacatggtgagcggctacaagaaggtcatggcgaccatcgactccttccagagcttcaacacctccaccatgcacttcacggacgagcgcatcgagtggaaggaccccgacggcatgctgcgggaccacatcagcatcctggtgaccaaggacatcgacttcgacaacctcggggagaacccctgcaagatcggcctgcagacctccagcatcgagggggcctggggcagcggggtgggctacaccctgacgtgcctcatctccctgaccgagtgccccaccttcctgaccagcatcaaggcctgcgacaaggccatctgctacggcgccgagtccgtcacgctcacccgcgggcagaacaccgtgaaggtgagcggcaagggcgggcactccgggagctccttcaagtgctgccacggcgaggactgcagccagatcggcctgcacgcggccgccccgcacctggacaaggtcaacgggatctccgagatcgagaacagcaaggtgttcgacgacggcgcgccccagtgcgggatcaagtgctggttcgtcaagtccggcgagtggatcagcggcatcttcaacgggaactggatcgtgctcatcgtgctgtgcgtcttcctcctgttctccctggtgctgctcagcatcctgtgccccgtgcggaagcacaagaagtcctga

SEQ ID NO: 11726 - RNA, 3408 nt, synthetic construct
  misc_feature 1..3408: note = derived and/or modified CDS sequence (opt1) from HTNV(HV004)__JQ083394.1__GP
  source 1..3408: mol_type = other RNA
atgggcatctggaagtggctggtgatggccagcctcgtctggcccgccttcgccctgcgcaacgtgtacgacatgaagatcgagtgcccgcacaccgtgtccttcggggagaacagcgtcatcggctacgtggagctgccgcccatgcccctcgccgacaccgcccagatggtgcccgagtccagctgctccatggacaaccaccagagcctgaacacgatcaccaagtacacccagatcatctggcgggggaaggccgaccagtcccagagctcccagaacagcttcgagaccgtctccacggaggtggacctgaaggggacctgcgtgctcaagcacaagatggtcgaggagagctaccgctcccggaagtccatcacgtgctacgacctgtcctgcaacagcacctactgcaagcccaccctgtacatgatcgtgcccatccacgcctgcaacatgatgaagtcctgcctcatcgcgctggggccctaccgcgtgcaggtcgtgtacgagcggacctactgcatgaccggcgtgctgatcgagggcaagtgcttcgtcccggaccagagcgtggtgtccatcatcaagcacgggatcttcgacatcgccagcgtccacatcgtgtgcttcttcgtggccgtcaagggcagcacctacaagctgttcgagcaggtcaagaagtccttcgagagcaactgcaacgacacggagaacaaggtgcaggggtactacatctgcatcgtgggcgggaactccgcccccatctacgtgcccaccctcgacgacttccgcagcatggaggcgttctccggcatcttcaagagcccccacggcgaggaccacgacctggccggggaggaggtcgcctcctacagcatcgtgggcccggccaacgccaaggtgccccactccgcgagctccgacaccctcagcctgatcgcctactccgggatccccagctactccagcctgtccatcctcaccagctccacggaggccaagcacgtcttcagccccggcctgttcccgcagctgaaccacaccaagtgcgacaagaccgccatccccctcacctggacgggcatgatcgacctgcccgggtactacgaggccatccacccctgcaccgtgttctgcgtgctgagcggcccgggggcgtcctgcgaggccttcagcgagggcgggatcttcaacatcacctcccccatgtgcctcgtcagcaagcagaaccggttccgcctgaccgagcagcaggtcaacttcgtgtgccagcgggtggacgtggacatcgtggtctactgcaacggccagcgcaaggtgatcctgacgaagaccctcgtgatcggccagtgcatctacaccatcacctccctgttcagcctgctccccggggtcgcccactccatcgccgtggagctgtgcgtgcccggcttccacgggtgggccacggcggccctgctcgtcaccttctgcttcggctgggtgctgatcccggccatcaccttcatcatcctgaccatcctcaagttcatcgccaacatcttccacacgagcaaccaggagaacaagctgaagtccgtgctgcggaagatcaaggaggagttcgagcgcaccaaggggagcatggtctgcgacgtgtgcaagtacgagtgcgagacctacaaggagctcaaggcccacggcgtgtcctgcccccagagccagtgcccctactgcttcacccactgcgagcccacggaggcggccttccaggcccactacaaggtctgccaggtgacccaccggttccgcgacgacctgaagaagaccgtgaccccgcagaacttcacccccggctgctaccggacgctgaacctcttccgctacaagtcccggtgctacatcttcaccatgtgggtcttcctgctggtgctcgagagcatcctgtgggccgcgtccgccagcgagacgcccctgaacccggtgtggaacgacaacgcccacggggtcggctccgtgcccatgcacaccgacctcgagctggacttcagcctgaccagctccagcaagtacacctaccgccggaagctgaccaaccccctcgaggagtcccaggccatcaacctgcacatcgagatcgaggagcagaccatcggggtggacgtccacgccctgggccactggttcgacgggcgcctcaacctgaagacgagcttccactgctacggcgcgtgcaccaagtacgagtacccctggcacaccgccaagtgccactacgagcgggactaccagtacgagacctcctggggctgcaacccgagcgactgccccggggtgggcacggggtgcaccgcctgcggcctgtacctcgaccagctgaagcccgtgggctccgcctacaagatcatcaccatccgctacagccgccgggtctgcgtgcagttcggggaggagaacctgtgcaagatcatcgacatgaacgactgcttcgtgtcccgccacgtcaaggtgtgcatcatcggcaccgtgagcaagttctcccagggggacacgctcctgttcttcggccccctggagggcggcggcctcatcttcaagcactggtgcaccagcacgtgccagttcggggacccgggcgacatcatgagcccccgggacaaggggttcctgtgccccgagttccccggcagcttccgcaagaagtgcaacttcgccaccaccccgatctgcgagtacgacgggaacatggtctccggctacaagaaggtgatggcgaccatcgacagcttccagtccttcaacaccagcaccatgcacttcacggacgagcggatcgagtggaaggaccccgacggcatgctgcgcgaccacatcaacatcctcgtgaccaaggacatcgacttcgacaacctgggggagaacccctgcaagatcggcctgcagacctccagcatcgagggggcctggggcagcggggtcggcttcaccctcacgtgcctgatctccctgaccgagtgccccaccttcctcaccagcatcaaggcctgcgacaaggccatctgctacggcgccgagtccgtgacgctgacccgggggcagaacaccgtgaaggtcagcggcaagggcgggcactccgggagctccttcaagtgctgccacggcgaggactgcagccagatcggcctgcacgcggccgccccgcacctcgacaaggtgaacgggatctccgagatcgagaacagcaaggtgttcgacgacggcgcgccccagtgcgggatcaagtgctggttcgtcaagtccggcgagtggatcagcggcatcttcaacgggaactggatcgtgctgatcgtcctgtgcgtgttcctcctgttctccctggtgctcctgagcatcctgtgccccgtccgcaagcacaagaagtcctga

SEQ ID NO: 11727 - RNA, 3405 nt, synthetic construct
  misc_feature 1..3405: note = derived and/or modified CDS sequence (opt1) from HTNV(NC167)__AB027115.2__GP
  source 1..3405: mol_type = other RNA
atgtggggcctgctcgtggtcgccgggctgatcggcccctgcatcagcctgcgcaacgtgtacgacatgaagatcgagtgcccgcacaccgtgaacttcggggagaacagcgtcatcggctacgtggagctcccgcccgtgcccatcgccgacatcacccagatggtccccgagagctcctgcaacatggacaaccaccagagcctgtccacgttcaccaagtacacccagctgatctggcggaagaaggcggagcaggcccaggccagccagaactccttcgagaccgtgagccgcgaggtggacttcaaggggacgtgcgtcttcaagcacaagatggtggaggagtcctacaagaaccgcaagagcatcatctgctacgacctctcctgcaacatcacccactgcaagcccaccctgtacatgatcatccccgtgcacgcctgcaacatgatgaagtcctgcctgatcgccctcggccccttccgggtccaggtggtgtacgagcggacctactgcatgagcggcatcctgacggaggggcgctgcttcgtcccgtaccagagcgtggtgtccatcatcaagcacggcatcttcgacatcgcgagcatccacatcatctgcttcttcatcgccgtcgaggggaacacctacaagctgttcgaggaggtgaagaagtccttcgccctcaactgcaacgacaccgagaacaagatccagggctactacatctgcatcatcgggggcaacagcgcccccgtgtacgcgccctcccccgacgacttccggagcatggaggccttcagcggcatcttccgctccccgcacggggagaaccacgacctgaacggcgggcggaacgccccctacagcatcgtcggccccaccgacggcaaggtgccccactccagcaagcactacaacatcgagttcgactccatcttccagaagttcccgacgtacagctccttcagcatcctggccgggtccgtggagcccaagcacgtcttccagcccggcctcttccccaagctgaaccacaccaagtgcaccaagagcgccatcccgctggtgtggaccgggcgcatcgacatccccggctactacgaggcggtccaccccctcacggtgtactgcgagctgtccgggcccggcgccagctgcgaggccttctccgagggcgggatcttcaacatcaccagcccgatgtgcctggtgtccaagcagaaccggttccgcagcctccggcagcaggtctccttcgtgtgccagcgcgtggacatggacatcgtcgtgtactgcaacggccagaagaagaccatcctgaccaagacgctggtgatcgggcagtgcatctacaccatcaccagcctcttctccctgctgcccagcgtcgcccacagcatcgccgtggagctctgcgtgcccggcttccacgggtgggcgaccgccgccctgctgatcacgttctgcttcggctgggtcctcatccccgccctgaccttcatcatcctgaccatcctcaagttcatcgccaacatcttccacacctccaaccaggagaacaagctgaaggcggtgctgcggaagatcaaggaggagttcgagaagacgaagggcagcatggtgtgcgacatctgcaagtacgagtgcgacacctacaaggagctcaaggcccacgggctgtcctgcccgcagagccagtgcccctactgcttcacccactgcgagcccaccgagtccgccttccaggcccactacaaggtctgccaggtgacgcaccgcttccgggaggagctgaagaagaccgtgaccccgcagaacttcacccccggctgctaccgcacgctcaacctgttccggtacaagagccgctgctacatcttcaccatgtggatcctgctcctggtcttcgagtccatcctgtgggccgcgagcgcctccgacgtgcccctcagcaccgactggaacgacaacgcccacggggtgggctccgtccccatgcacaccgacctggagctggacttcagcctcacctccagctccaagtacacgtaccggcgcaagctgaccaacccggtggacaccagccaggccgtggacctgcacatcgagctggaggagcagaccatcgggctcgacgtccacgcgctgggccactggttcgacggccgcctgaacctcaagacgtccttccactgctacggggcctgcaccaagtacgagtacccctggcacaccgccaagtgccacttcgagcgggacttccagtacgagaccagctggggctgcaacccgcccgactgccccggggtgggcacgggctgcaccgcctgcgggctgtacatcgaccagctgcgccccgtgggcaacgcctacaagatcatcaccatccggtacagccgcaaggtctgcgtgcagttcggggacgagaacctctgcaagaccatcgacatgaacgactgcttcgtgtccaagcacgtcaaggtgtgcatcatcggcacggtgagcaagttctcccagggggacaccctgctgttcctcggccccatggagggcgggggcatcatcttcaagcactggtgcaccagcacgtgccagttcggggaccccggcgacatcatgtccccgaaggacaaggggttcagctgccccgagttctccggcagcttccggaagaagtgcaacttcgcgaccacccccgcctgcgagtacggcgggaacatggtctccggctaccgcaaggtgatggccaccatcgacagcttccaggccttcaacacctccacgatccacttcaccgacgagcggatcgagtggaaggaccccgacgggatgctgcgcgaccacatcaacatcctggtgacccgggacatcgacttcgacaacctcgccgagaacccgtgcaagatcggcctgcaggtcagcgcgatcgagggggcctggggctccggcgtggggttcaccctgacgtgccaggtgagcctcaccgagtgctccaccttcctgaccagcatcaaggcctgcgacaaggccatctgctacggcgcccagtccgtcacgctggtgcgcgggcagaacaccgtgaagatcagcggcaagggcgggcactccggcagcgcgttcaagtgctgccacggggaggactgcagccagaccggcctccaggccgacgcgccccacctggacaaggtcaacgggatctccgaggtggagaacgacaaggtgtacgacgacggcgcccccgagtgcggcatcaagtgctggttcgtcaagagcggggagtgggtggccggcatcttctccgggaactggatcgtgctggtcgtgctctgcatcttcctgatcatcagcctgatcctcctgtccatcctgtgccccgtgcggaagcacaagaagtcctga

SEQ ID NO: 11728 - RNA, 3408 nt, synthetic construct
  misc_feature 1..3408: note = derived and/or modified CDS sequence (opt1) from HTNV(WuhanAaJ10)__JQ665882.1__GP
  source 1..3408: mol_type = other RNA
atgggcatctggaagtggctggtgatggccagcctcgtctggcccgccttcgcgctgcgcaacgtgtacgacatgaagatcgagtgcccgcacaccgtgtccttcggggagaacagcgtcatcggctacgtggagctgccgcccatgcccctcgccgacaccgcccagatggtgcccgagtccagctgctccatggacaaccaccagagcctgaacacgatcaccaagtacacccagatcatctggcgggggaaggccgaccagtcccagagctcccagaacagcttcgagaccgtctccacggaggtggacctgaaggggacctgcgtgctcaagcacaagatggtcgaggagagctaccgctcccgcaagagcatcacgtgctacgacctgtcctgcaacagcacctactgcaagcccgccctgtacatgatcgtgcccatccacgcgtgcaacatgatgaagtcctgcctcatcgccctggggccctaccgcgtgcaggtcgtgtacgagcggacgtactgcatgaccggcgtgctgatcgagggcaagtgcttcgtcccggaccagagcgtggtgtccatcatcaagcacgggatcttcgacatcgccagcgtccacaccgtgtgcttcttcgtggccgtcaagggcagcacctacaagctgttcgagcaggcgaagaagtccttccagagcaactgcaacgacacggagaacaaggtgcaggggtactacatctgcatcgtgggcgggtccagcgcccccatctacgtccccaccctggacgacttccgctccatggaggccttcagcggcctgttcaagagcccccacggcgaggaccacgacctcgccggggaggaggtggcctcctactccatcgtcggcccggcgaacgccaaggtgccccacagcgcctccagcgacaccctgtccctgatcgcctacagcgggatcccctcctacagctccctcagcatcctgacctccagcacggaggccaagcacgtgttcagccccggcctgttcccgcagctcaaccacaccaagtgcgacaagaccgcgatccccctgacctggacgggcatgatcgacctgcccgggtactacgaggccgtccacccctgcaccgtgttctgcgtgctcagcggcccgggcgccagctgcgaggccttctccgagggcgggatcttcaacatcaccagccccatgtgcctcgtctccaagcagaaccggttccggctgaccgagcagcaggtcaacttcgtgtgccagcgggtggacgtggacatcatcgtgtactgcaacggccagcgcaaggtcatcctcaccaagaccctggtgatcggccagtgcatctacaccatcaccagcctgatctccctcctgcccggggtggcccacagcatcgcggtcgagctgtgcgtgcccggctcccacgggtgggccacggccgccctcctggtgaccttctgcttcggctgggtcctgatcccggccatcaccttcatcatcctcaccatcctgaagttcatcgcgaacatcttccacacgagcaaccaggagaaccggctgaagtccgtgctccgcaagatcaaggaggagttcgagcggaccaaggggagcatggtgtgcgacgtctgcaagtacgagtgcgagacctacaaggagctgaaggcccacggcgtgtcctgcccccagagccagtgcccctactgcttcacccactgcgagcccacggaggccgccttccaggcgcactacaaggtgtgccaggtcacccaccgcttccgggacgacctgaagaagaccgtgaccccgcagaacttcacccccggctgctaccgcacgctcaacctgttccggtacaagtcccgctgctacatcttcaccatgtgggtgttcctgctcgtcctggagagcatcctgtgggccgcctccgccagcgagacgcccctcaacccggtgtggaacgacaacgcccacggggtgggcagcgtccccatgcacaccgacctggagctggacttctccctgaccagctccagcaagtacacctaccggcgcaagctcaccaaccccctggaggagtcccaggcgatcgacctgcacatcgagatcgaggaccagaccatcggggtggacgtgcacgccctcggccactggttcgacgggcggctgaacctggagacgagcttccactgctacggcgcctgcaccaagtacgagtacccctggcacaccgccaagtgccactacgagcgcgactaccagtacgagacctcctggggctgcagcccgtccgactgccccggggtcggcacggggtgcaccgcctgcggcctctacctggaccagctgaagcccgtgggcagcgcgtacaagatcatcaccatccgctactcccggcgcgtgtgcgtccagagcggggaggagaacctctgcaagatcatcgacatgaacgactgcttcgtgtcccggcacgtgaaggtctgcatcatcggcaccgtgagcaagttctcccagggggacacgctgctgttcttcggccccctcgagggcgggggcctgatcttcaagcactggtgcacctccacgtgccagttcggggacccgggcgacatcatgagcccccgcgacaaggggttcctgtgccccgagttccccggcagcttccggaagaagtgcaacttcgccaccaccccgatctgcgagtacgacgggaacatggtgtccggctacaagaaggtcatggccaccatcgacagcttccagagcttcaacacctccaccatgcacttcacggacgagcgcatcgagtggaaggaccgggacggcatgctccgcgaccacatcaacatcctggtgaccaaggacatcgacttcgacaacctgggggagaacccctgcaagatcggcctccagaccagctccatcgagggggcctggggcagcggggtgggcttcaccctgacgtgcctgatctccctcaccgagtgccccaccttcctgaccagcatcaaggcctgcgacaaggcgatctgctacggcgccgagtccgtcacgctgacccgggggcagaacaccgtgaaggtgagcggcaagggcgggcactccgggagctccttcaagtgctgccacggcgaggactgcagccagatcggcctccacgccgccgcgccccacctggacaaggtcaacgggatctccgagatcgagaacagcaaggtgttcgacgacggcgccccgcagtgcgggatcaagtgctggtccgtcaagagcggcgagtggatctccggcatcttcagcgggaactggatcgtgctgatcgtgctctgcgtcttcctgctgttctccctcgtgctgctgagcatcctctgccccgtgcgcaagcacaagaagtcctga

SEQ ID NO: 11729 - RNA, 3408 nt, synthetic construct
  misc_feature 1..3408: note = derived and/or modified CDS sequence (opt1) from HTNV(Z5)__EU074224.1__GP
  source 1..3408: mol_type = other RNA
atgggcatctggaagtggctggtgatggccagcctcgtctggcccgcctgcaccctgcgcaacgtgtacgacatgaagatcgagtgcccgcacaccgtgtccttcggggagaacagcgtcatcggctacgtggagctgccgcccatgcccctcgccgacacggcccagctggtgcccgagtccagctgcaacatggacaaccaccagtccatgaacaccatcaccaagtacacccaggtcagctggcggtccaaggtggaccaggcccaggccagccagaactccttcgaggccgtgagcgcggaggtcgacctgaaggggacgtgcgtgctcaagcacaagatgctggaggagtcctaccgcagccggaagtccatcacgtgctacgacctgagctgcaactccacctactgcaagcccaccctctacatgatcgtgcccatccacgcctgcaacatgatgaagggctgcctgatcgccctggggccctaccgcgtccaggtggtgtacgagcggacctactgcatgaccggcgtcctcatcgagggcaagtgcttcgtgccggaccagagcgtggtctccatcatcaagcacgggatcttcgacatcgccagcgtgcacatcgtgtgcttcttcgtcgcggtgaagggcaacacctacaagctgttcgagcaggtcaagaagtccttccagagcacgtgcaacgacaccgagaacaaggtgcaggggtactacatctgcatcgtgggcgggaacagcgcccccatctgcgtccccaccctggacgacttccgctccatggaggccttcagcggcatcttccggagcccccacggcgaggaccacgacctcgccggggaggagatcgccagctactccatcgtgggcccggcgaacgccaaggtgccccacagcgcctccagcgacaccctgtccctgatcgcctacagcgggatcccctcctacagctccctcagcatcctggccggctccaccgaggcgaagcacgtcttcagccccggcttcttcccgcagctgaaccacacgaagtgcgacaagaccgccatccccctcacctggaccgggatgatcgacctgcccggctactacgaggccatccacccctgcacggtgttctgcgtgctgtccgggccgggcgccagctgcgaggccttctccgagggcgggatcttcaacatcaccagccccatgtgcctcgtcagcaagcagaaccgcttccggctgaccgagcagcaggtcaacttcgtgtgccagcgcgtggacatggacatcatcgtgtactgcaacggccagcggaaggtgatcctgaccaagacgctcgtcatcgggcagtgcatctacaccatcacctccctgttcagcctgctccccggcgtggcgcactccatcgccgtggagctgtgcgtccccgggttccacggctgggccaccgccgccctgctcgtgacgttctgcttcgggtgggtgctgatcccggcgatcaccttcgtcatcctgaccatcctcaagttcatcgccaacatcttccacaccagcaaccagggcaaccgcctgaagtccgtgctgaagaagatcaaggaggagttcgagaagacgaagggcagcatggtgtgcgacgtctgcaagtacgagtgcgagacctacaaggagctcaaggcccacggggtgtcctgcccccagagccagtgcccctactgcttcacccactgcgagcccaccgaggccgcgttccaggcccactaccgggtgtgccaggtcacgcaccgcttccgggacgacctgaagaagaccgtgaccccgcagaacttcacccccggctgctaccgcaccctgaacctcttccggtacaagtcccgctgctacatcttcacgatgtgggtgtgcctgctggtcctcgagagcatcctgtgggccgcctccgccagcgaggtgcccctgaacccgatctggaacgacaacgcgcacggggtgggctccgtccccatgcacaccgacctcgagctggacttcagcctgacctccagctccaagtacacctaccggcgccggctgacgaaccccctcgaggagacccaggccatcaacctgcacatcgagatcgaggagcagaccatcggggtggacgtgcacgccctgggccactggttcgacggccgcctcaacctgaagaccagcttccactgctacggggcctgcacgaagtacgagtacccctggcacaccgccaagtgccactacgagcgcgactaccagtacgagaccagctggggctgcaacccggcggactgccccggggtcggcaccggctgcacggcctgcgggctgtacctcgaccagctgaagcccgtgggctccgcctacaagatcatcaccatccggtacagccgcaaggtgtgcgtccagttcggggaggagaacctgtgcaaggtgatcgacatgaacgactgcttcgtgtcccggcacgtcaaggtgtgcatcatcggcaccgtgagcaagttctcccagggggacaccctcctgttcttcggccccctggagggcgggggcctcatcttcaagcactggtgcacgagcacgtgccagttcggggacccgggcgacatcatgagcccccgcgacaaggggttcctgtgccccgagttccccggctccttccggaagaagtgcaacttcgccaccaccccgctgtgcgagtacgacggcaacatggtctccgggtacaagaaggtgatggccaccatcgacagcttccagtccttcaacaccagcaccatgcacttcaccgacgagcgcatcgagtggaaggaccccgacggcatgctccgggaccacatcaacatcctggtgacgaaggacatcgacttcgacaacctgggggagaacccctgcaaggtcggcctccagacctccagcatcgagggggcgtggggctccggcgtggggttcaccctgacctgcctggtgagcctcacggagtgccccaccttcctgacctccatcaaggcctgcgacaaggccatctgctacggcgccgagagcgtcaccctgacgcgcgggcagaacaccgtgaaggtgtccggcaagggcgggcacagcggcagcaccttcaagtgctgccacggggaggagtgctcccagatcggcctccacgcggccgccccgcacctggacaaggtcaacgggatcagcgagatcgagaacaacaaggtgtacgacgacggcgcgccccagtgcggcgtcaagtgctggttcgtgaagtccggggagtggatcagcggcatcttctccgggaactggatcgtgctgatcgtcctctgcgtgttcctgctgttcagcctcgccctgctgtccgtgctctgccccgtccggcgccacaagaagtcctga

SEQ ID NO: 11730 - RNA, 3408 nt, synthetic construct
  misc_feature 1..3408: note = derived and/or modified CDS sequence (opt1) from HTNV(ZLS-12)__FJ753399.1__GP
  source 1..3408: mol_type = other RNA
atgggcatctggaagtggctgatcatggccagcctcgtgtggcccgcctacaccctgcgcaacgtctacgacatgcggatcgagtgcccgcacaccgtgagcttcggggagaacagcgtgatcggctacgtcgagctgccgcccatgcccctcgccgacacgtcccagatggtgcccgagagctcctgcagcatggacaaccaccagtccctgaacaccatcaccaagtacacccaggtgagctggcgcgggaaggccgaccagtcccaggccagccagaactccttcgaggccgtcagcgccgaggtggacctgaagggcacgtgcgtgctcaagcacaagatgctggaggagtcctaccggagccgcaagtccatcacgtgctacgacctgagctgcaactccacctactgcaagcccaccctctacatgatcgtccccatccacgcgtgcaacatgatgaagtcctgcctgatcgccctggggccctaccgggtccaggtggtgtacgagcgcacctactgcatgaccggcatcctcatcgagggcaagtgcttcgtgccggaccagagcgtggtcagcatcatcaagcacgggatcttcgacatcgccagcgtgcacatcgtgtgcttcttcgtcgccgtgaagggcaacacctacaagctgttcgagcaggtcaagaagtccttccagagcacgtgcaacgacaccgaggacaaggtgcaggggtactacatctgcatcgcgggcgggaactccgcccccatctacgtgcccaccctggacgacttccggagcatggaggccttctccggcatcttcaagagcccccacggcgaggaccacgacctcgccggggaggagatcgcctcctacagcatcgtgggcccggcgaacgccaaggtcccccactccgccagctccgacaccctgagcctgaccgcctactccgggatccccagctactccagcctctccatcctgacgagctccaccgaggccaagcacgtgttcagccccggcttcttcccgcagctgaaccacaccaagtgcgacaagaccgcgatccccctcatgtggacgggcatgatcgacctgcccgggtactacgaggccatccacccctgcaccgtcttctgcgtgctgagcggcccgggggcctcctgcgaggccttcagcgagggcgggatcttcaacatcacctcccccatgtgcctcgtgagcaagcagaaccgcttccggctgaccgagcagcaggtcaacttcgtgtgccagcgcgtggacatggacatcgtcgtgtactgcaacggccagcggaaggtgatcctgacgaagaccctcgtcatcggccagtgcatctacaccatcacctccctgttcagcctgctccccggggtggcccactccatcgcggtggagctgtgcgtccccggcttccacgggtgggccacggccgccctgctcgtgaccttctgcttcggctgggtgctgatcccggccatcaccttcatcatcctgaccatcctcaagttcatcgcgaacatcttccacacgagcaaccaggagaaccgcctgaagtccgtcctgcggaagatcaaggaggagttcgagaagaccaaggggagcatggtgtgcgacgtgtgcaagtacgagtgcgagacctacaaggagctcaaggcccacggcgtctcctgcccccagagccagtgcccctactgcttcacccactgcgagcccacggaggccgccttccaggcgcactaccgcgtgtgccaggtgacccaccggttccgcgacgacctgaagaagaccgtcaccccgcagaacttcacccccggctgctaccggacgctgaacctcttccgctacaagtcccggtgctacatcttcaccatgtgggtgttcctgctggtgctcgagagcatcctgtgggccgcctccgccagcgaggtccccctgtccccggtgtggaacgacaacgcccacggggtgggcagcatccccatgcacaccgacctcgagctggacttcagcctgacctccagctccaagtacacgtaccgccggaagctgaccaaccccctcgaggagacccaggcgatcaacctgcacatcgagatcgaggagcagaccatcggggtcgacgtgcacgccctgggccactggttcgacgggcgcctcaacctgaagacgagcttccactgctacggcgcctgcaccaagtacgagtacccctggcacaccgccaagtgccactacgagcgcgactaccagtacgagacctcctggggctgcaacccggccgactgccccggggtgggcacggggtgcaccgcgtgcggcctgtacctcgaccagctgaagcccgtcggcagcgcctacaagatcatcaccatccggtactcccgccgggtgtgcgtgcagctgggggaggagaacctctgcaagatcatcgacatgaacgactgcttcgtcagccgccacgtgaaggtgtgcatcatcggcaccgtctccaagttcagccagggggacacgctgctgttcttcggccccctcgagggcgggggcctgatcttcaagcactggtgcacctccacgtgccagttcggggacccgggcgacatcatgagcccccgggacaaggggttcctgtgccccgagttccccggctccttccgcaagaagtgcaacttcgccaccaccccgctctgcgagtacgacgggaacatggtgagcggctacaagaaggtgatggccaccatcgactccttccagagcttcaacacctccaccatgcacttcacggacgagcggatcaagtggaaggaccccgacggcatgctgcgcgaccacatcaacatcctggtcaccaaggacatcgacttcgacaacctcggggagaacccctgcaagatcggcctgcagaccagcgccatcgagggggcgtggggctccggggtgggcttcaccctgacgtgcctcgtgagcctgaccgagtgccccaccttcctgaccagcatcaaggcctgcgacaaggccatctgctacggcgccgagtccgtcacgctcacccgggggcagaacaccgtgaaggtgagcggcaagggcgggcactccgggagcctgttcaagtgctgccacggcgaggagtgctcccagatcggcctgcacgcggccgccccgcacctcgacaaggtcaacgggatcagcgagatcgagaacaacaaggtgtacgacgacggcgcgccccagtgcggggtgaagtgctggttcgtcaagtccggcgagtggatcagcggcatcttctccgggaactggatcgtgctgatcgtgctgtgcgtcttcctcctgttcagcctggtgctcctgtccgtcctgtgccccgtgcgcaagcacaagaagtcctga

SEQ ID NO: 11731 - RNA, 3408 nt, synthetic construct
  misc_feature 1..3408: note = derived and/or modified CDS sequence (opt1) from HTNV(ZLS6-11)__FJ753397.1__GP
  source 1..3408: mol_type = other RNA
atgggcatctggaagtggctgatcatggccagcctcgtgtggcccgcctacaccctgcgcaacgtctacgacatgcggatcgagtgcccgcacaccgtgagcttcggggagaacagcgtgatcggctacgtcgagctgccgcccatgcccctcgccgacacgtcccagatggtgcccgagagctcctgcagcatggacaaccaccagtccctgaacaccatcaccaagtacacccaggtgagctggcgcgggaaggccgaccagtcccaggccagccagaactccttcgaggccgtcagcgccgaggtggacctgaagggcacgtgcgtgctcaagcacaagatgctggaggagtcctaccggagccgcaagtccatcacgtgctacgacctgagctgcaactccacctactgcaagcccaccctctacatgatcgtccccatccacgcgtgcaacatgatgaagtcctgcctgatcgccctggggccctaccgggtccaggtggtgtacgagcgcacctactgcatgaccggcatcctcatcgagggcaagtgcttcgtgccggaccagagcgtggtcagcatcatcaagcacgggatcttcgacatcgccagcgtgcacatcgtgtgcttcttcgtcgccgtgaagggcaacacctacaagctgttcgagcaggtcaagaagtccttccagagcacgtgcaacgacaccgaggacaaggtgcaggggtactacatctgcatcgcgggcgggaactccgcccccatctacgtgcccaccctggacgacttccggagcatggaggccttctccggcatcttcaagagcccccacggcgaggaccacgacctcgccggggaggagatcgcctcctacagcatcgtgggcccggcgaacgccaaggtcccccactccgccagctccgacaccctgagcctgaccgcctactccgggatccccagctactccagcctctccatcctgacgagctccaccgaggccaagcacgtgttcagccccggcttcttcccgcagctgaaccacaccaagtgcgacaagaccgcgatccccctcatgtggacgggcatgatcgacctgcccgggtactacgaggccatccacccctgcaccgtcttctgcgtgctgagcggcccgggggcctcctgcgaggccttcagcgagggcgggatcttcaacatcacctcccccatgtgcctcgtgagcaagcagaaccgcttccggctgaccgagcagcaggtcaacttcgtgtgccagcgcgtggacatggacatcgtcgtgtactgcaacggccagcggaaggtgatcctgacgaagaccctcgtcatcggccagtgcatctacaccatcacctccctgttcagcctgctccccggggtggcccactccatcgcggtggagctgtgcgtccccggcttccacgggtgggccacggccgccctgctcgtgaccttctgcttcggctgggtgctgatcccggccatcaccttcatcatcctgaccatcctcaagttcatcgcgaacatcttccacacgagcaaccaggagaaccgcctgaagtccgtcctgcggaagatcaaggaggagttcgagaagaccaaggggagcatggtgtgcgacgtgtgcaagtacgagtgcgagacctacaaggagctcaaggcccacggcgtctcctgcccccagagccagtgcccctactgcttcacccactgcgagcccacggaggccgccttccaggcgcactaccgcgtgtgccaggtgacccaccggttccgcgacgacctgaagaagaccgtcaccccgcagaacttcacccccggctgctaccggacgctgaacctcttccgctacaagtcccggtgctacatcttcaccatgtgggtgttcctgctggtgctcgagagcatcctgtgggccgcctccgccagcgaggtccccctgtccccggtgtggaacgacaacgcccacggggtgggcagcatccccatgcacaccgacctcgagctggacttcagcctgacctccagctccaagtacacgtaccgccggaagctgaccaaccccctcgaggagacccaggcgatcaacctgcacatcgagatcgaggagcagaccatcggggtcgacgtgcacgccctgggccactggttcgacgggcgcctcaacctgaagacgagcttccactgctacggcgcctgcaccaagtacgagtacccctggcacaccgccaagtgccactacgagcgcgactaccagtacgagacctcctggggctgcaacccggccgactgccccggggtgggcacggggtgcaccgcgtgcggcctgtacctcgaccagctgaagcccgtcggcagcgcctacaagatcatcaccatccggtactcccgcaaggtgtgcgtgcagttcggggaggagaacctgtgcaagatcatcgacatgaacgactgcttcgtcagccggcacgtgaaggtgtgcatcatcggcaccgtctccaagttcagccagggggacacgctcctgttcttcggccccctggagggcgggggcctcatcttcaagcactggtgcacctccacgtgccagttcggggacccgggcgacatcatgagcccccgcgacaaggggttcctgtgccccgagttccccggctccttccggaagaagtgcaacttcgccaccaccccgctgtgcgagtacgacgggaacatggtgagcggctacaagaaggtgatggccaccatcgactccttccagagcttcaacacctccaccatgcacttcacggacgagcgcatcgagtggaaggaccccgacggcatgctccgggaccacatcaacatcctggtcaccaaggacatcgacttcgacaacctgggggagaacccctgcaagatcggcctccagaccagcgccatcgagggggcgtggggctccggggtgggcttcaccctgacgtgcctggtgagcctcaccgagtgccccaccttcctgaccagcatcaaggcctgcgacaaggccatctgctacggcgccgagtccgtcacgctgacccgcgggcagaacaccgtgaaggtgagcggcaagggcgggcactccgggagcctcttcaagtgctgccacggcgaggagtgctcccagatcggcctgcacgcggccgccccgcacctggacaaggtcgacgggatcagcgagatcgagaacaacaaggtgtacgacgacggcgcgccccagtgcggggtgaagtgctggttcgtcaagtccggcgagtggatcagcggcatcttctccgggaactggatcgtgctcatcgtgctgtgcgtcttcctcctgttcagcctggtgctgctctccgtcctgtgccccgtgcggaagcacaagaagtcctga

SEQ ID NO: 11732 - RNA, 3408 nt, synthetic construct
  misc_feature 1..3408: note = derived and/or modified CDS sequence (opt1) from HTNV__AB030232.1__GP
  source 1..3408: mol_type = other RNA
atgggcctgtggaagtggctcatcatggccgtgctggtctggccctgcttcgccctgcgcaacgtgtacgacatgaagatcgagtgcccgcacaccgtgaacttcggggagaacagcgtcgtgggctacgtggagctcccgcccatgcccatcgcggacatcacccagatgatgcccgagtccagctgctccatggacaaccaccagagcctgaacacgatcaccaagtacacccaggtctcctggcggaagaaggccgaccgcgcccagagctcccagaccagcttcgagacggtgtccagcgaggtggacttcaaggggacctgcgtcctgaagcacaagatggtggaggactcctaccggagccgcaagtccatcatctgctacgacctcagctgcaactccaccttctgcaagcccaccctgtacctgatcgtgcccgtccacgcctgcaacatgatgaagtcctgcctcatcgccctgggcccctaccgggtgcaggacgtgtacgagcgcacgtactgcatgagcggggtcctgctcgagggcaagtgcttcgtgccggaccggagcgtggtctccatcatcaagcacggcatcttcgacatcgcgagcgtgcacatcgtgtgcttcttcgtcgccatcaaggggagcacctacaagatcctggagcaggtcaagaagtccttcgagctgacctgcaacgacaccgacaacaagatccagggctactacatctgcctcgtcgggggcaacagcgcccccatctacgtgcccacgctggacgacttccgctccatggaggccttcgcggggatcttcaagagcccccacggcgaggaccacgacctggccggcgaggaggtggcctcctacagcatcgtggggccggccaacgccaaggtgccccactccgcgagcgccgacaccctctccctggtggccttcagcggcatcccctcctacagctccttcagcgtcctgaccgggtccaccgacgcccggcacgtgttcagccccggcttcttcccgcagctcaaccagacgcgctgcgacaagaccgccatccccctgacctggaccggcatgatcgacctgcccgggtactacgaggcggtgcacccctgcacggtcttctgcgtgctctccggcccgggggccagctgcgaggccttctccgagggcgggatcttcaacatcaccagccccatgtgcctggtgagcgagcagaaccggttccgctccagcgagcagcaggtcaacttcgtgtgccagcgggtggacatggacatcgtcgtgtactgcaacggccagaagaaggtgatcctgaccaagaccctcgtcatcggccagtgcatctacacgatcacctccctgttcagcctgctccccggggtggcccactccatcgccgtggagctgtgcgtccccggcttccacgggtgggcgaccgccgccctgctcgtgaccttctgcttcggctgggtgctgatcccggccgtcacgctggtgatcctcaccatcctgaagttcatcgccaacatcttccacaccagcaaccaggagaaccgcctgaagtccgtgctcaagaagatcaaggaggagttcgagaagaccaaggggagcatggtctgcgacgtgtgcaagtacgagtgcgagacgtacaaggagctgaaggcgcacggcgtgtcctgcccccagagccagtgcccctactgcttcacccactgcgagcccaccgaggccgccttccaggcccactacaaggtctgccaggtgacccaccggttccgcgacgacctgaagaagacggtgaccccgcagaacttcacccccggctgctaccggaccctcaacctgttccgctacaagtcccggtgctacatcttcaccatgtgggtcttcctgctcatcctggagagcatcctgtgggcggcctccgccagcgagacgccctccaccccgatctggaacgacaacgcccacggggtgggcagcatccccatgcacaccgacctcgagctggacttctccctgaccagcagctccaagtacacgtaccgccggaagctgaccaaccccctcgagaagacccaggccgtggacctgcacatcgagctggcggtccagaccatcggggtggacgtgcacgccctcggccactggttcgacgggcgcctgaacctgaagacgagcttccactgctacggcgcctgcaccaagtacgagtacccctggcacaccgccaagtgccactacgagcgcgactaccagtacgagacctcctggggctgcaacccggccgactgccccggggtcggcacggggtgcaccgcgtgcggcctctacctggaccagctgaagcccgtgggcagcgcctacaagatcatcaccatcaagtactcccggcgcgtgtgcgtccagttcggggaggagaacctctgcaaggtgatcgacatgaacgactgcttcgtgagccggcacgtcaagatctgcatcatcggcaccgtgtccaagttcagccagggggacacgctgctgttcttcggccccctcgagggcgggggcctgatcttcaagcactggtgcacctccacgtgccagttcggggacccgggcgacatcatgagcccccgcgacaaggggttcctgtgccccgagttccccggctccttccggaagaagtgcaacttcgccaccaccccggtgtgcgagtacgacgggaacatggtcagcggctacaagaaggtgatggccaccatcgactccttccagagcttcaacacctccatgatgcacttcaccgacgagcgcatcgagtggaaggaccccgacggcatgctccgggaccacatcaacatcctggtgacgaaggacatcgacttcgacaacctgggggacaacccctgcaaggtcggcctccagaccagcgccatcgagggggcgtggggctccggggtgggcttcaccctgacctgccaggtgagcctgacggagtgccccaccttcctcacctccatcaaggcctgcgacaaggccatctgctacggcgccgagagcatcaccctgacgcgcgggcagaacaccgtcaaggtgagcggcaagggcgggcactccgggagcaccttcaagtgctgccacggcgaggagtgctcccagatcggcctgcacgcggccgccccgcacctcgacaaggtcaacgggatcagcgagatggagaactccaaggtgtacgacgacggcgcccccgagtgcgggatcaagtgctggttcgtcaagagcggcgagtggatctccggcatcttcaacgggaactggatcgtgctgatcgtgctgtgcgccttcctcatcttcagcctggtgctgctctccctgctgtgccccgtccggaagcacaagaaggcgtga

SEQ ID NO: 11733 - RNA, 3408 nt, synthetic construct
  misc_feature 1..3408: note = derived and/or modified CDS sequence (opt1) from HTNV__AB620032.1__GP
  source 1..3408: mol_type = other RNA
atgggcatgtggaagtggctggtgatcgccagcctcgtctggcccgtgctggccctgcgcaacgtgtacgacatgaagatcgagtgcccgcacaccgtctccttcggggagaacagcgtgatcggcttcgtggagctcccccccatgcccctggcggacaccgcccagatggtcccggagtccagctgctccatggacaaccaccagagcatcaacacgatcaccaagtacacccaggtgacctggcgggggaaggccgaccccggccagtccagccagaactccttcgagacggtgagcaccgaggtcgacctgaaggggacctgcgtgctcaagcacaagatggtggaggagtcctaccgcagccggaagtccatcacctgctacgacctgagctgcaactccacgtactgcaagcccaccctgtacatgatcgtccccatccacgcctgcaacatgatgaagagctgcctcatcgccctgggcccgtaccgcgtgcaggtggtctacgagcggacctactgcatgaccggcgtgctgatcgaggggaagtgcttcgtgcccgaccagtccgtcgtgagcatcatcaagcacggcatcttcgacatcgcgtccgtgcacatcgtctgcttcttcgtggccatcaaggggaacacgtacaagctcttcgagcaggtgaagaagagcttcgagagcacctgcaacgacaccgagaacaaggtccagggctactacatctgcatcgtggggggcaactccgcccccatctacgtccccaccctggacgacttccgcagcatggaggccttcacgggcatcttcaagtccccgcacggggaggaccacgacctggcgggcgaggagatcgccagctactccatcgtggggcccgccaacgccaaggtgccccacagcgcctccagcgacaccctctccctgatcgcgtacagcggcatcccctcctacagctccctgagcatcctcacctccagcaccgacgccaagcacgtcttctccccgggcctgttccccaagctgaaccacacgaactgcgacaagagcgccatccccctcacctggaccgggatgatcgacctgcccggctactacgaggccatccacccgtgcaccgtgttctgcgtgctgtccgggcccggcgccagctgcgaggcgttcagcgaggggggcatcttcaacatcacgtcccccatgtgcctcgtcagcaagcagaaccggttccgcctgaccgagcagcaggtgaacttcgtgtgccagcgggtcgacatggacatcgtggtgtactgcaacggccagcgcaaggtcatcctgaccaagaccctcgtgatcgggcagtgcatctacacgatcacctccctgttcagcctgctccccggcgtggcccactccatcgccgtcgagctgtgcgtgccggggttccacggctgggccaccgccgcgctgctcgtgaccttctgcttcgggtgggtcctgatccccgccgtgacgttcgtgatcctgaccatcctcaagttcgtcgccaacatcttccacaccagcaaccaggagaaccggctgaagtccgtgctgcgcaagatcaaggaggagttcgagaagaccaagggcagcatggtgtgcgacgtctgcaagtacgagtgcgagacgtacaaggagctcaaggcccacggcgtgtcctgcccccagagccagtgcccctactgcttcacccactgcgagccgaccgaggccgcgttccaggcccactacaaggtgtgccaggtcacccaccggttccgcgacgacctgaagaagaccgtgacgccccagaacttcacccccgggtgctaccggaccctgaacctcttccgctacaagtcccggtgctacatcttcaccatgtgggtgttcctgctgatcctcgagagcgtcctgtgggccgcctccgcgagcgagacgccgctggcccccgtgtggaacgacaacgcccacggcgtggggtccgtccccatgcacaccgacctcgagctggacttcagcctgacctccagcagcaagtacacctaccgccggaagctgacgaaccccctcgaggaggcccagtccatcgacctgcacatcgagatcgaggagcagaccatcggcgtggacgtgcacgccctggggcactggttcgacggccgcctcaacctgaagaccagcttccactgctacggcgcgtgcaccaagtacgagtacccgtggcacacggccaagtgccactacgagcgggactaccagtacgagacctcctgggggtgcaaccccagcgactgccccggcgtcgggaccggctgcaccgcctgcggcctgtacctcgaccagctgaagcccgtggggtccgcctacaagatcatcacgatccgctacagccgccgggtgtgcgtccagttcggcgaggagaacctgtgcaagatcatcgacatgaacgactgcttcgtgtcccgccacgtgaaggtctgcatcatcgggaccgtgagcaagttctcccagggcgacaccctcctgttcttcgggccgctggagggcggcgggctcatcttcaagcactggtgcaccagcacgtgccagttcggcgaccccggggacatcatgtccccccgggacaagggcttcctgtgccccgagttcccggggagcttccgcaagaagtgcaacttcgccaccacccccatctgcgagtacgacggcaacaccgtgtccggctacaagaaggtcatggcgacgatcgacagcttccagtccttcaacaccagcaccatgcacttcaccgacgagcggatcgagtggaaggaccccgacgggatgctgcgcgaccacatcaacatcctcgtgacgaaggacatcgacttcgacaacctgggcgagaacccctgcaagatcgggctgcagacctccagcatcgagggcgcctgggggtccggcgtgggcttcaccctcacctgcctggtcagcctgacggagtgcccgaccttcctcaccagcatcaaggcctgcgacaaggccatctgctacggggccgagtccgtgaccctgacgcggggccagaacaccgtgaaggtcagcgggaagggcgggcactccggcagcaccttcaagtgctgccacggcgaggactgctcccagatcgggctgcacgcggccgccccccacctcgacaaggtgaacggcatcagcgagatcgagaactccaaggtctacgacgacggggccccccagtgcggcatcaagtgctggttcgtgaagagcggcgagtggatctccgggatcttcagcggcaactggatcgtgctgatcgtcctgtgcgtgttcctcctgttctccctggtgctcctgagcatcctgtgccccgtccgcaagcacaagaagtcctga

SEQ ID NO: 11734 - RNA, 3408 nt, synthetic construct
  misc_feature 1..3408: note = derived and/or modified CDS sequence (opt1) from HTNV__D25532.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtcagcttcgggggcaacagcgtgatcgggtacgtggagctcccgcccgtccccctggccgacacggcgcagatggtgcccgagtccagctgctccatggacaaccaccagagcctgaacaccatcaccaagtacacccaggtgtcctggcggggcaaggccgaccagagccagtccagccagaactccttcgagacggtcagcaccgaggtggacctcaaggggacctgcgtgctgaagcacaagatggtcgaggagtcctaccgcagccggaagtccgtgacctgctacgacctgagctgcaactccacgtactgcaagcccaccctctacatgatcgtgcccatccacgcctgcaacatgatgaagtcctgcctgatcgccctgggcccctaccgcgtccaggtggtgtacgagcggacctactgcatgaccggcgtcctcatcgaggggaagtgcttcgtgccggaccagtccgtggtcagcatcatcaagcacggcatcttcgacatcgccagcgtgcacatcgtgtgcttcttcgtcgcggtgaaggggaacacgtacaagatcttcgagcaggtcaagaagtccttcgagagcacgtgcaacgacaccgagaacaaggtgcagggctactacatctgcatcgtcgggggcaactccgcccccatctacgtgcccaccctggacgacttccgcagcatggaggccttcaccggcatcttccggagcccccacggggaggaccacgacctggccggcgaggagatcgcgagctactccatcgtggggccggccaacgccaaggtgccccacagcgcctccagcgacaccctccgcctgatcgcctactccggcatccccagctactccagcctgtccatcctcaccagctccaccgaggcgaagcacgtcttcagccccggcctgttcccgaagctgaaccacacgaactgcgacaagtccgccatccccctcatctggaccgggatgatcgacctgcccggctactacgaggccgtgcacccctgcaccgtgttctgcgtcctgagcgggccgggcgccagctgcgaggccttctccgagggcgggatcttcaacatcaccagctccatgtgcctcgtgagcaagcagaaccggttccgcctgacggagcagcaggtcaacttcgtgtgccagcgggtggacatggacatcgtggtctactgcaacggccagcgcaaggtgatcctgaccaagaccctcgtgatcgggcagtgcatctacaccatcacgtccctgttcagcctgctccccggcgtcgcgcactccatcgccgtggagctgtgcgtgcccgggttccacggctgggccaccgccgccctgctcgtcaccttctgcttcgggtgggtgctgatccccgcgatcaccttcatcatcctgacggtgctcaagttcatcgccaacatcttccacaccagcaaccaggagaaccggctgaagtccgtcctgcgcaagatcaaggaggagttcgagaagaccaagggcagcatggtgtgcgacgtgtgcaagtacgagtgcgagacctacaaggagctcaaggcccacggcgtctcctgcccgcagagccagtgcccctactgcttcacgcactgcgagcccaccgaggccgccttccaggcgcactacaaggtgtgccaggtgacccaccggttccgcgacgacctgaagaagaccgtcacgccccagaacttcaccccggggtgctaccggaccctgaacctcttccgctacaagtcccggtgctacatcttcaccatgtggatcttcctgctggtgctcgagagcatcctgtgggccgcctccgccagcgagacgcccctgacccccgtgtggaacgacaacgcgcacggcgtcgggtccgtgccgatgcacaccgacctcgagctggacttcagcctgaccagctccagcaagtacacctaccgccggaagctgacgaaccccctcgaggaggcccagtccatcgacctgcacatcgagatcgaggagcagaccatcggcgtggacgtccacgccctggggcactggttcgacggccgcctcaacctgaagaccagcttccactgctacggcgcctgcaccaagtacgagtacccctggcacacggccaagtgccactacgagcgcgactaccagtacgagacctcctgggggtgcaaccccagcgactgcccgggcgtggggaccggctgcaccgcgtgcggcctgtacctcgaccagctgaagcccgtggggtccgcctacaagatcatcacgatccggtacagccgccgggtctgcgtgcagttcggcgaggagaacctgtgcaagatcatcgacatgaacgactgcttcgtgtcccgccacgtcaaggtgtgcatcatcgggaccgtgagcaagttctcccagggcgacaccctcctgttcttcgggcccctggagggcggcgggctcatcttcaagcactggtgcaccagcacgtgccagttcggcgaccccggggacatcatgtccccgcgggacaagggcttcctgtgccccgagttccccgggagcttccgcaagaagtgcaacttcgccaccacccccatctgcgagtacgacggcaacatggtctccggctacaagaaggtgatggccaccatcgacagcttccagtccttcaacacgagcaccatgcacttcaccgacgagcggatcgagtggaaggacccggacgggatgctgcgcgaccacatcaacatcctcgtgaccaaggacatcgacttcgacaacctgggcgagaacccctgcaagatcgggctgcagacgtccagcatcgagggcgcctgggggagcggcgtcggcttcaccctgacctgcctcgtgtccctgaccgagtgccccacgttcctcaccagcatcaaggcgtgcgacaaggccatctgctacggggccgagtccgtgaccctgacccggggccagaacacggtcaaggtgagcgggaagggcgggcactccggcagcaccttcaagtgctgccacggcgaggactgctcccagatcgggctgcacgccgccgcgccccacctcgacaaggtcaacggcatcagcgagatcgagaactccaaggtgtacgacgacggggccccgcagtgcggcatcaagtgctggttcgtcaagagcggcgagtggatctccgggatcttcagcggcaactggatcgtgctgatcgtgctgtgcgtgttcctcctgttctccctggtcctcctggggatcctgtgccccgtgcgcaagcacaagaagtcctga

SEQ ID NO: 11735 - RNA, 3408 nt, synthetic construct
  misc_feature 1..3408: note = derived and/or modified CDS sequence (opt1) from HTNV__L08753.1__GP
  source 1..3408: mol_type = other RNA
atgggcatctggaagtggctggtgatggccagcctcgtctggcccgcctacaccctgcgcaacgtgtacgacatgaagatcgagtgcccgcacaccgtgtccttcggggagaacagcgtcatcggctacgtggagctgccgcccatccccctcgccgacacgacccagatggtgcccgagtccagctgctccatggacaaccaccagagcctgaacaccgtcaccaagtacacccaggtgtcctggcgggggaaggccgaccaggcccaggccagccagaactccttcgaggccgtgagcgcggaggtcgacctgaaggggacctgcgtgctcaagcacaagatgctggaggagtcctaccgcagccggaagtccatcgcctgctacgacctgagctgcaactccacctactgcaagcccaccctctacatgatcgtgcccatccacgcctgcaacatgatgaagtcctgcctgatcgccctggggccccaccgcgtccaggtggtgtacgagcggacgtactgcatgaccggcgtcctcatcgagggcaagtgcttcgtgccggaccagagcgtggtcagcatcatcaagcacgggatcttcgacatcgcgtccgtgcacatcgtgtgcttcttcgtcgccgtgaagggcaacacctacaagatcttcgagcagatcaagaagtccttcgagagcacctacaacgacacgaagaacaaggtggaggggtactacatctgcatcgtcggcgggaacagcgcccccatctacgtgcccaccctggacgacttccgcagcatggaggccttctccggcatcttccggagcccccacggcgaggaccacgacctggccggggaggagatcgcgtcctacagcatcgtcggcccggccaacgtgaaggtgccccactccgccagctccgacaccctcagcctgaccgcctactccgggatccccagctactccagcctgtccatcctcgccggcagcgcggaggccaagcacgtcttctcccccggcttcttcccgcagctgaaccacacgaagtgcgacaagaccgccatccccctgatgtggaccgggatgatcgacctccccggctactacgaggccatccacccctgcaccgtgttctgcgtgctgagcgggccgggcgcctcctgcgaggcgttcagcgagggcggcatcttcaacatcacgagccccatgtgcctggtctccaagcagaaccgcttccggctcaccgagcagcaggtcaacttcgtgtgccagcgcgtggacatggacatcatcgtgtactgcaacggccagcggaaggtgatcctgaccaagaccctggtcatcgggcagtgcatctacacgatcaccagcctcttctccctgctgcccggcgtggcccacagcatcgccgtggagctctgcgtccccgggttccacggctgggccaccgccgcgctgctggtgaccttctgcttcgggtgggtgctcatcccggccatgacgttcatcgtcctgaccatcctgaagttcatcgccaacatcttccacacctccaaccaggagaacaagctcaagagcgtgctgcgcaagatcaaggaggagttcgagaagaccaagggctccatggtgtgcgacgtctgcaagtacgagtgcgagacgtacaaggagctgaaggcccacggcgtgagctgcccccagtcccagtgcccctactgcttcacccactgcgagcccaccgaggcggccttccaggcccactaccgggtgtgccaggtcacccaccgcttccgggacgacctcaagaagacggtgaccccgcagaacttcacccccgggtgctaccgcaccctgaacctgttccggtacaagagccgctgctacatcttcaccatgtgggtgttcctcctggtcctggagtccatcctctgggccgccagcgcgtccgagatccccctgtacccggtgtggaacgacaacgcccacggcgtggggagcgtccccatgcacacggacctggagctcgacttctccctgaccagctccagcaagtacacctaccggcgcaagctgaccaaccccctggaggagagccaggccatcaacctccacatcgagatcgaggagcagacgatcggcgtggacgtgcacgccctggggcactggttcgacggccggctgaacctcaagacctccttccactgctacggcgcctgcaccaagtacgagtacccctggcacaccgcgaagtgccactacgaccgcgactaccagtacgagacgagctgggggtgcaacccgtccgactgccccggcgtcgggaccggctgcaccgcctgcggcctgtacctggaccagctcaagcccgtggggagcgcctacaagatcatcaccatccgctactcccggcgcgtgtgcgtccagttcggcgaggagaacctgtgcaagatcatcgacatgaacgactgcttcgtgagccggcacgtgaaggtctgcatcatcgggacggtgtccaagttcagccagggcgacaccctcctcttcttcgggcccctggagggcggcgggctgatcttcaagcactggtgcacctccacgtgccagttcggcgacccgggggacatcatgagcccccgcgacaagggcttcctctgccccgagttccccgggtccttccggaagaagtgcaacttcgccacgaccccgctgtgcgagtacgacggcaacatggtgagcggctacaagaaggtcatggccaccatcgactccttccagagcttcaacacctccacgatgcacttcaccgacgagcgcatcgagtggaaggaccccgacgggatgctgcgggaccacatcaacatcctcgtgaccaaggacatcgacttcgagaacctgggcgagaacccctgcaagatcgggctgcagaccagctccatcgagggcgcgtgggggagcggcgtgggcttcacgctgacctgcctggtctccctgaccgagtgccccaccttcctcacgagcatcaaggcctgcgacaaggccatctgctacggggccgagagcgtgaccctgacccgcggccagaacaccgtgaaggtctccgggaagggcgggtacagcggctccacgttcaagtgctgccacggcgaggagtgcagccagatcgggctgcacgcggccgccccgcacctcgacaaggtgaacggcatctccgagatcgagaacaacaaggtgtacgacgacggggcgccccagtgcggcatcaagtgctggttcgtcaagagcggcgagtggatctccgggatcttcagcggcaactggatcgtgctgatcgtcctgtgcgtgttcctcctgttctccctgatcctcctgagcatcctgtgccccgcccggaagcacaagaagtcctga

SEQ ID NO: 11736 - RNA, 3408 nt, synthetic construct
  misc_feature 1..3408: note = derived and/or modified CDS sequence (opt1) from HTNV__M14627.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcggggagaacagcgtgatcggctacgtggagctcccgcccgtccccctggccgacacggcccagatggtgcccgagtccagctgcaacatggacaaccaccagtccctgaacaccatcaccaagtacacccaggtgagctggcgggggaaggccgaccagtcccagagctcccagaacagcttcgagacggtctccaccgaggtggacctcaaggggacctgcgtgctgaagcacaagatggtcgaggagagctaccgctcccgcaagagcgtgacctgctacgacctgtcctgcaacagcacgtactgcaagcccaccctctacatgatcgtgcccatccacgcctgcaacatgatgaagtcctgcctgatcgccctggggccctaccgcgtccaggtggtgtacgagcggagctactgcatgaccggcgtcctcatcgagggcaagtgcttcgtgccggaccagtccgtggtcagcatcatcaagcacgggatcttcgacatcgccagcgtgcacatcgtgtgcttcttcgtcgcggtgaagggcaacacctacaagatcttcgagcaggtcaagaagtccttcgagagcacgtgcaacgacaccgagaacaaggtgcaggggtactacatctgcatcgtgggcgggaactccgcccccatctacgtccccaccctggacgacttccgcagcatggaggccttcaccggcatcttccggagcccccacggcgaggaccacgacctggccggggaggagatcgcgtcctactccatcgtgggcccggccaacgccaaggtgccccacagcgcctccagcgacacgctctccctgatcgcctacagcgggatcccctcctacagctccctgagcatcctcacctccagcaccgaggcgaagcacgtcttctcccccggcctgttcccgaagctgaaccacaccaactgcgacaagagcgccatccccctcatctggacgggcatgatcgacctgcccgggtactacgaggccgtgcacccctgcaccgtgttctgcgtcctgagcggcccgggcgcctcctgcgaggccttcagcgagggcgggatcttcaacatcacctcccccatgtgcctcgtgagcaagcagaaccggttccggctgaccgagcagcaggtcaacttcgtgtgccagcgcgtggacatggacatcgtggtctactgcaacggccagcggaaggtgatcctgacgaagaccctcgtgatcggccagtgcatctacaccatcacctccctgttcagcctgctccccggggtcgcgcactccatcgccgtggagctgtgcgtgcccggcttccacgggtgggccacggccgccctgctcgtcaccttctgcttcggctgggtgctgatcccggcgatcaccttcatcatcctgaccgtgctcaagttcatcgccaacatcttccacacgagcaaccaggagaaccgcctgaagtccgtcctgcggaagatcaaggaggagttcgagaagaccaaggggagcatggtgtgcgacgtgtgcaagtacgagtgcgagacctacaaggagctcaaggcccacggcgtctcctgcccccagagccagtgcccctactgcttcacccactgcgagcccacggaggccgccttccaggcgcactacaaggtgtgccaggtgacccaccgcttccgggacgacctgaagaagaccgtcaccccgcagaacttcacccccggctgctaccgcacgctgaacctcttccggtacaagtcccgctgctacatcttcaccatgtggatcttcctgctggtgctcgagagcatcctgtgggccgcctccgccagcgagacgcccctgaccccggtgtggaacgacaacgcgcacggggtcggctccgtgcccatgcacaccgacctcgagctggacttcagcctgaccagctccagcaagtacacctaccggcgcaagctgaccaaccccctcgaggaggcccagtccatcgacctgcacatcgagatcgaggagcagacgatcggggtggacgtccacgccctgggccactggttcgacgggcggctcaacctgaagaccagcttccactgctacggcgcctgcaccaagtacgagtacccctggcacaccgccaagtgccactacgagcgcgactaccagtacgagacgtcctggggctgcaacccgagcgactgccccggggtgggcaccgggtgcaccgcgtgcggcctgtacctcgaccagctgaagcccgtgggctccgcctacaagatcatcaccatccgctacagccggcgcgtctgcgtgcagttcggggaggagaacctgtgcaagatcatcgacatgaacgactgcttcgtgtcccggcacgtcaaggtgtgcatcatcggcacggtgagcaagttctcccagggggacaccctcctgttcttcggccccctggagggcgggggcctcatcttcaagcactggtgcacctccacgtgccagttcggggacccgggcgacatcatgagcccccgcgacaaggggttcctgtgccccgagttccccggcagcttccggaagaagtgcaacttcgccaccaccccgatctgcgagtacgacgggaacatggtctccggctacaagaaggtgatggccaccatcgacagcttccagtccttcaacaccagcacgatgcacttcaccgacgagcgcatcgagtggaaggaccccgacggcatgctgcgggaccacatcaacatcctcgtgaccaaggacatcgacttcgacaacctgggggagaacccctgcaagatcggcctgcagacctccagcatcgagggggcctggggcagcggggtcggcttcacgctgacctgcctcgtgtccctgaccgagtgccccaccttcctcacgagcatcaaggcgtgcgacaaggccatctgctacggcgccgagtccgtgaccctgacccgcgggcagaacaccgtcaaggtgagcggcaagggcgggcactccgggagcacgttccggtgctgccacggcgaggactgctcccagatcggcctgcacgccgccgcgccgcacctcgacaaggtcaacgggatcagcgagatcgagaactccaaggtgtacgacgacggcgcgccccagtgcgggatcaagtgctggttcgtcaagagcggcgagtggatctccggcatcttcagcgggaactggatcgtgctgatcgtgctgtgcgtgttcctcctgttctccctggtcctcctgagcatcctgtgccccgtgcgcaagcacaagaagtcctga

SEQ ID NO: 11737 - RNA, 3408 nt, synthetic construct
  misc_feature 1..3408: note = derived and/or modified CDS sequence (opt1) from HTNV__EU074672.1__GP
  source 1..3408: mol_type = other RNA
atgggcatctggaagtggctggtgatggccagcctcgtctggcccgccttcgcgctgcgcaacgtgtacgacatgaagatcgagtgcccgcacaccgtgagcttcggggagaacagcgtcatcggctacgtggagctgccgcccatgcccctcgccgacaccacgcagatggtgcccgagtccagctgctccatggacaaccaccagagcctgaacaccatcaccaagtacacccagatcatctggcgggggaaggccgaccagtcccagagctcccagaacagcttcgagacggtctccaccgaggtggacctgaaggggacctgcgtgctcaagcacaagatgatcgaggagagctaccgctcccgcaagagcatcacgtgctacgacctgtcctgcaacagcacctactgcaagcccaccctgtacatgatcgtccccatccacgcctgcaacatgatgaagtcctgcctcatcgccctggggccctaccgggtccaggtggtgtacgagcggacctactgcatgaccggcgtgctgatcgagggcaagtgcttcgtgccggaccagagcgtcgtgtccatcatcaagcacgggatcttcgacatcgcgagcgtgcacatcgtctgcttcttcgtggccgtgaagggcaacacgtacaagatcttcgagcaggtcaagaagtccttcgagagcaactgcaacgacaccgagaacaaggtgcaggggtactacatctgcatcatcggcgggaacagctcccccgtgtacgtccccaccctcgacgacttccgcagcatggaggccttctccggcatcttccggagcccccacggcgaggaccacgacctggccggggaggaggtggcgtcctacagcatcgtcggcccggccaacgccaaggtgccccactccgccagctccgacaccctggggctcatcgcctacagcggcatcccctcctacagctccctgagcatcctgacgtccagcaccgaggcgaagcacgtgttctcccccggcctcttcccgcagctgaaccacaccaagtgcgacaagaccgccatccccctgacgtggaccgggatgatcgacctccccggctactacgaggccatccacccctgcaccgtcttctgcgtgctgagcgggccgggcgccagctgcgaggccttctccgagggcggcatcttcaacatcaccagccccatgtgcctggtgtccaagcagaaccgcttccggctcacggagcagcaggtcaacttcgtgtgccagcgcgtggacgtcgacatcatcgtgtactgcaacggccagcggaaggtgatcctgaccaagaccctggtcatcgggcagtgcatctacaccatcacgagcctcttctccctgctgcccggcgtggcgcacagcatcgccgtggagctctgcgtccccgggttccacggctgggccaccgccgccctgctggtgaccttctgcttcgggtgggtgctcatcccggcgatcaccttcatcatcctgacgatcctgaagttcatcgccaacatcttccacacctccaaccaggagaaccgcctcaagagcgtcctgcggaagatcaaggaggagttcgagcgcaccaagggctccatggtgtgcgacatctgcaagtacgagtgcgagacctaccgggagctgaaggcccacggcgtgagctgcccccagtcccagtgcccctactgcttcacgcactgcgagcccaccgaggccgccttccaggcgcactacaaggtctgccaggtgacccaccgcttccgggacgacctcaagaagaccgtgaccccgcagaacttcacgcccgggtgctaccgcaccctgaacctgttccggtacaagagccgctgctacatcttcaccatgtgggtcttcctcctggtgctggagtccatcctctgggccgccagcgcctccgagatccccctgaacccggtgtggaacgacaacgcgcacggcgtcgggagcatccccatgcacaccgacctggagctcgacttctccctgacgagcagctccaagtacacctaccggcgcaagctgaccaaccccctggaggagagccaggccatcgacctccacgtggagatcgaggagcagaccatcggcgtggacgtccacgccctggggcactggttcgacggccgcctgaacctcaagacgtccttccactgctacggcgcctgcaccaagtacgagtacccctggcacaccgccaagtgccactacgagcgggactaccagtacgagaccagctgggggtgcaacccgtccgactgccccggcgtggggacgggctgcaccgcgtgcggcctgtacctggaccagctcaagcccgtggggagcgcctacaagatcatcaccatccgctactcccggcgcgtctgcgtgcagttcggcgaggagaacctgtgcaagatcatcgacatgaacgactgcttcgtgagccggcacgtcaaggtgtgcatcatcgggaccgtgtccaagttcagccagggcgacacgctgctgttcttcgggcccctggagggcggcgggctgatcttcaagcactggtgcacctccacgtgccagttcggcgacccgggggacatcatgagcccccgcgacaagggcttcctctgccccgagttccccgggtccttccggaagaagtgcaacttcgccaccaccccggtctgcgagtacgacggcaacatggtgagcggctacaagaaggtgatggccaccatcgactccttccagagcttcaacacctccaccatgcacttcacggacgagcgcatcgagtggaaggaccccgacgggatgctgcgggaccacatcaacatcctggtcaccaaggacatcgacttcgacaacctcggcgagaacccctgcaagatcgggctgcagaccagctccatcgagggcgcctgggggagcggcgtgggcttcaccctgacgtgcctcatcagcctgaccgagtgctccaccttcctgaccagcatcaaggcgtgcgacaaggccatctgctacggggccgagtccgtgacgctcacccgcggccagaacaccgtcaaggtgagcgggaagggcgggcactccggcagctccttcaagtgctgccacggcgaggagtgcagccagatcgggctgcacgccgccgcgccccacctggacaaggtgaacggcatctccgagatggagaacagcaaggtcttcgacgacggggccccgcagtgcggcatcaagtgctggttcgtgaagtccggcgagtggatcagcgggatcttctccggcaactggatcgtgctcatcgtcctgtgcgtgttcctcctcttcagcctggtcctgctctccatcctgtgccccgtgcggaagcacaagaagtcctga

SEQ ID NO: 11738 - RNA, 3408 nt, synthetic construct
  misc_feature 1..3408: note = derived and/or modified CDS sequence (opt1) from HTNV__GQ120966.1__GP
  source 1..3408: mol_type = other RNA
atggagatctggaagtggctggtgatggccagcctcgtctggcccgccttcaccctgcgcaacgtgtacgacatgaagatcgagtgcccgcacaccgtgtccttcggcgagaacagcgtcatcgggtacgtggagctgccccccatgcccctcgcggacacggcccagatggtgccggagtccagctgcaacatggacaaccaccagtccatgaacaccatcaccaagtacacccaggtcagctggcggggcaaggccgaccaggcccaggcctcccagaacagcttcgaggcggtgtccgccgaggtggacctgaaggggacgtgcgtcctgaagcacaagatgctcgaggagagctaccgctcccggaagagcatcacctgctacgacctgtcctgcaacagcacctactgcaagcccaccctgtacatgatcgtgcccatccacgcctgcaacatgatgaagtcctgcctcatcgccctgggcccctaccgcgtgcaggtcgtgtacgagcggacgtactgcatgaccggggtgctgatcgagggcaagtgcttcgtcccggaccagagcgtggtgtccatcatcaagcacggcatcttcgacatcgcgagcgtccacatcgtgtgcttcttcgtggccgtcaaggggaacacctacaagctcttcgagcaggtgaagaagtccttccagagcacctgcaacggcacggagaacaaggtgcaggggtactacatctgcatcgtcggcgggaacagcgcccccatctacgtgcccaccctggacgacttccgctccatggaggccttcagcggcatcttccggtccccccacggcgaggaccacgacctggccggggaggagatcgcgagctactccatcgtcggcccggccaacgccaaggtgccccacagcgcctccagcgacaccctctccctgatcgcctacagcgggatcccctcctacagctccctgagcatcctcgcgtccagcaccgaggccaagcacgtgttctcccccggcttcttcccgcagctgaaccacacgaagtgcgacaagaccgccatccccctgacctggaccggcatgatcgacctccccgggtactacgaggccatccacccctgcacggtcttctgcgtgctgagcggcccgggggcctcctgcgaggcgttcagcgagggcgggatcttcaacatcaccagccccatgtgcctggtgtccaagcagaaccgcttccggctcaccgagcagcaggtcaacttcgtgtgccagcgcgtggacatggacatcatcgtctactgcaacggccagcggaaggtgatcctgaccaagacgctggtgatcggccagtgcatctacaccatcaccagcctcttctccctgctgcccggggtcgcccacagcatcgccgtggagctctgcgtgcccggcttccacgggtgggccaccgccgcgctgctggtcacgttctgcttcggctgggtgctcatcccggccctgaccctgatcatcctcaccatcctgaagttcatcgccaacatcttccacacctccaaccaggagaaccgcctgaagagcgtgctccggaagatcaaggaggagttcgagaagacgaaggggtccatggtctgcgacgtgtgcaagtacgagtgcgagacctacaaggagctgaaggcccacggcgtgagctgcccccagtcccagtgcccctactgcttcacccactgcgagcccaccgaggcggccttccaggcccactaccgcgtctgccaggtgacgcaccggttccgcgacgacctgaagaagaccgtgaccccgcagaacttcacccccggctgctaccggaccctcaacctgttccgctacaagagccggtgctacatcttcacgatgtgggtctgcctgctcgtgctggagtccatcctgtgggccgccagcgcgtccgaggtgcccctcaacccggtctggaacgacaacgcccacggggtgggcagcgtgcccatgcacaccgacctggagctggacttccccctgacctccagctccaagtacacctaccgccggcgcctcacgaaccccctggaggagacccagagcatcaacctgcacatcgagatcgaggagcagaccatcggggtcgacgtgcacgccctcggccactggttcgacgggcgcctgaacctgaagaccagcttccactgctacggcgcctgcacgaagtacgagtacccgtggcacaccgccaagtgccactacgagcgggactaccagtacgagacctcctggggctgcaaccccgcggactgccccggggtgggcaccgggtgcacggcctgcggcctctacctggaccagctgaagcccgtcggcagcgcctacaagatcatcaccatccgctactcccggaaggtgtgcgtgcagttcggggaggagaacctctgcaaggtcatcgacatgaacgactgcttcgtgacccgccacgtgaaggtctgcatcatcggcaccgtgagcaagttctcccagggggacacgctgctgttcttcggcccgctcgaggggggcggcctgatcttcaagcactggtgcaccagcacctgccagttcggggaccccggcgacatcatgtccccccgggacaaggggttcctgtgccccgagttcccgggcagcttccgcaagaagtgcaacttcgccaccacgcccctctgcgagtacgacgggaacatggtgtccggctacaagaaggtcatggccaccatcgacagcttccagtccttcaacaccagcaccatgcacttcacggacgagcggatcgagtggaaggaccccgacggcatgctgcgcgaccacatcaacatcctggtgaccaaggacatcgacttcgacaacctcggggagaacccctgcaagatcggcctgcagacctccagcatcgagggggcgtggggctccggggtgggcttcaccctgacgtgcctcatcagcctgaccgagtgcccgaccttcctgacctccatcaaggcctgcgacaaggccatctgctacggcgccgagagcgtcacgctcacccgggggcagaacaccgtgaaggtgtccggcaaggggggccacagcgggagcaccttcaagtgctgccacggcgaggagtgctcccagatcggcctgcacgcggccgccccccacctggacaaggtcaacgggatcagcgagatcgagaacaacaaggtgtacgacgacggcgccccccagtgcggggtgaagtgctggttcgtcaagtccggcgagtggatcagcggcatcttctccgggaactggatcgtgctcatcgtcctgtgcgtgttcctgctcttcagcctggtgctgctctccgtcctgtgccccgtgcgcaagcacaagaagagctga

SEQ ID NO: 11739 - RNA, 3408 nt, synthetic construct
  misc_feature 1..3408: note = derived and/or modified CDS sequence (opt1) from HTNV(CGAa1011)__EF990927.1__GP
  source 1..3408: mol_type = other RNA
atggagatctggaagtggctggtgatggccagcctcgtctggcccgccctggcgctgcgcaacgtgcacgacatgaagatcgagtgcccgcacaccgtgtccttcggcaagaacagcgtcatcgggtacgtggagctcccccccatgcccctggccgacaccatccagatggtgccggagtccagctgctccatggacaaccaccagagcctgtccacggtcaccaagtacacccaggtgagctggcggggcaaggccgaccaggcccagtccaaccagaccagcttcgagacggtgtccgtcgaggtggacctcaaggggacctgcgtgctgaagcacaagctggtcgaggagagctaccgctcccggaagagcctcacctgctacgacctgtcctgcaacagcacctactgcaagcccacgctgtacatgatcgtgcccatccacgcctgcaacatgatgaagtcctgcatcatcgcgctcggcccccaccgcgtgcaggtcgtgtacgagcggacctactgcatgaccggggtgctgctggagggcaagtgcttcgtcccggaccagagcgtggtgggcatcgtcaagcacgggatcttcgacatcgcctccgtgcacatcgcctgcttcttcgtggccatcaccggcaacacgtacaagctcttcgagcaggtcaagaagagcttcgggaccacctgcaacgacaccgagaacaaggtgcagggctactacatctgcatcctggggggcaacagcccccccatctacgtccccacgctggacgacttccgctccatggaggcgttcagcggcatcttcaagtccccgcacggggaggaccacgacctcgccggcgaggagatcgccagctactccatcgtggggcccgccaacgccaaggtgccccacagcgcgtccagcgacaccctgtccctgatcgccttcagcggcatcccctcctacagctccctcagcatcctgacctccagcaccgaggccaagcacgtcttctccccgggcctgttcccccagctcaaccacacgaagtgcgacaagaccgccatccccctgacctggaccgggatcatcgacctgcccggctactacgaggccgtgcacccgtgcacggtgttctgcgtcctcagcgggcccggcgcgtcctgcgaggccttcagcgaggggggcatcttcaacatcaccagccccatgtgcctggtgtccaagcagaaccggttccgcctgaccgagcagcaggtgaacttcgtctgccagcgggtggacatggacatcgtggtctactgcaacggccagcgcaaggtgatcctcaccaagacgctggtgatcgggcagtgcatctacaccatcaccagcctgttctccctcctgcccggcgtcgcccacagcatcgccgtggagctgtgcgtgccggggttccacggctgggccaccgcggccctcctgatcacgttctgcttcgggtgggtcctgatccccgccctcaccttcatcgtgctgaccgtgctgaagttcatcgccaacatcttccacacctccaaccaggagaaccggctcaagatggtcctgaagaagatcaaggaggagttcgagcgcacgaagggcagcatggtgtgcgacatctgcaagtacgagtgcgagacctacaaggagctgaaggcccacggcgtgtcctgcccccagagccagtgcccctactgcttcacccactgcgagccgaccgagtccgcgttccaggcccactaccgggtctgccaggtgacccaccgcttccgggacgacctcaagaagacggtgaccccccagaacttcacccccgggtgctaccgcaccctgaacctgttccggtacaagagccgctgctacatcttcacgatgtggatctgcctcctggtcctggagtccatcctgtgggccgccagcgcgtccgagatcccgctcagccccacctggaacgacaacgcccacggcgtggggtccatccccatgcacaccgacctggagctggacttcagcctcacctccagcagcaagtacacgtaccggcgcaagctgaccaaccccctggaggagtcccaggccgtgaacttccacgtcgagatcgaggagcaggccatcggcgtggacgtgcacgccctcgggcactggttcgacggccggctgaacctgaagaccagcttccactgctacggcgcgtgcaccaagtacgagtacccgtggcacacggccaagtgccactacgagcgcgactaccagtacgagacctcctgggggtgcaaccccagcgactgccccggcgtcgggaccggctgcaccgcctgcggcctctacctggaccagctgaagcccgtggggtccgcctacaagatcatcacgatccgctacagccggcgcgtgtgcgtccagttcggcgaggagaacctctgcaaggtgatcgacatgaacgactgcttcgtgtcccggcacgtcaaggtgtgcatcatcgggaccgtgagcaagttctcccagggcgacaccctgctgttcttcgggccgctcgagggcggcgggctgatcttcaagcactggtgcaccagcacgtgccagttcggcgaccccggggacatcatgtccccccgcgacaagggcttcctgtgccccgagttcccggggagcttccggaagaagtgcaacttcgccaccacccccgtctgcgagtacgacggcaacatggtgtccggctacaagaaggtgatggcgaccatcgacagcttccagtccagcaacacgtccaccatgcacttcaccgacgagcgcatcgagtggaaggaccccgacgggatgctccgggaccacatcaacatcctggtcaccaaggacatcgacttcgacaacctgggcgagaacccctgcaagatcgggctccagacgagctccatcgagggcgcctgggggagcggcgtgggcttcaccctgacctgcctgatcagcctcaccgagtgcccgacgttcctgacctccatcaaggcctgcgacaaggccatctgctacggggccgagagcgtgaccctgacccgcggccagaacacggtcaaggtgtccgggaagggcgggcacagcggctccaccttcaagtgctgccacggcgaggactgcagccagtccgggctccacgcggccgccccccacctggacaaggtgaacggcatcagcgagatcgagaactccaaggtctacgacgacggggccccccagtgcggcgtgaagtgctggttcgtcaagagcggcgagtggatctccgggatcttcagcggcaactggatcgtgctgatcgtgctctgcgtcttcctgctgttctccctcgtgctgctgagcatcctctgccccgtgcggaagcacaagaagtcctga

SEQ ID NO: 11740 - RNA, 3408 nt, synthetic construct
  misc_feature 1..3408: note = derived and/or modified CDS sequence (opt1) from HTNV(CGAa2)__EU092223.1__GP
  source 1..3408: mol_type = other RNA
atggagatctggaagtggctggtgatggccagcctcgtctggcccgccctggcgctgcgcaacgtgcacgacatgaagatcgagtgcccgcacaccgtgtccttcggcaagaacagcgtcatcgggtacgtggagctcccccccatgcccctggccgacaccatccagatggtgccggagtccagctgctccatggacaaccaccagagcctgtccacggtcaccaagtacacccaggtgagctggcggggcaaggccgaccaggcccagccctcccagaccagcttcgagacggtgtccgtcgaggtggacctcaaggggacctgcgtgctgaagcacaagctggtcgaggagagctaccgctcccggaagagcctcacctgctacgacctgtcctgcaacagcacctactgcaagcccacgctgtacatgatcgtgcccatccacgcctgcaacatgatgaagtcctgcatcatcgcgctcggcccgcaccgcgtgcaggtcgtgtacgagcggacctactgcatgaccggggtgctgctggagggcaagtgcttcgtccccgaccagagcgtggtgtccatcgtccgccacggcatcttcgacatcgccagcgtgcacatcgcctgcttcttcgtggccatcaccgggaacacgtacaagctcttcgagcaggtcaagaagagcttcggcaccacctgcaacgacaccgagaacaaggtgcaggggtactacatctgcatcctgggcgggaactccccccccatctacgtcccgacgctggacgacttccggagcatggaggcgttctccggcatcttcaagagcccccacggcgaggaccacgacctcgccggggaggagatcgcctcctacagcatcgtgggccccgccaacgccaaggtgccccactccgcgagctccgacaccctgagcctgatcgccttctccgggatcccgagctactccagcctctccatcctgaccagctccaccgaggccaagcacgtcttcagccccggcctgttcccccagctcaaccacacgaagtgcgacaagaccgccatccccctgacctggaccggcatcatcgacctgccggggtactacgaggccgtgcacccctgcacggtgttctgcgtcctctccggccccggggcgagctgcgaggccttcagcgagggcgggatcttcaacatcacctcccccatgtgcctggtgagcaagcagaaccgcttccggctgaccgagcagcaggtgaacttcgtctgccagcgcgtggacatggacatcgtggtctactgcaacggccagcggaaggtgatcctcaccaagacgctggtgatcggccagtgcatctacaccatcacctccctgttcagcctcctgccgggggtcgcccactccatcgccgtggagctgtgcgtgcccggcttccacgggtgggccaccgcggccctcctgatcacgttctgcttcggctgggtcctgatccccgccctcaccttcatcgtgctgaccgtgctgaagttcatcgccaacatcttccacaccagcaaccaggagaaccgcctcaagatggtcctgaagaagatcaaggaggagttcgagcggacgaaggggtccatggtgtgcgacatctgcaagtacgagtgcgagacctacaaggagctgaaggcccacggcgtgagctgcccccagtcccagtgcccgtactgcttcacccactgcgagcccaccgagagcgcgttccaggcccactaccgcgtctgccaggtgacccaccggttccgcgacgacctcaagaagacggtgaccccccagaacttcaccccgggctgctaccggaccctgaacctgttccgctacaagtcccggtgctacatcttcacgatgtggatctgcctcctggtcctggagagcatcctgtgggccgcctccgcgagcgagatccccctctcccccacctggaacgacaacgcccacggggtgggcagcatccccatgcacaccgacctggagctggacttctccctcaccagcagctccaagtacacgtaccgccggaagctgaccaacccgctggaggagagccaggccgtgaacttccacgtcgagatcgaggagcaggccatcggggtggacgtgcacgccctcggccactggtccgacgggcgcctgaacctgaagaccagcttccactgctacggcgcgtgcaccaagtacgagtacccctggcacacggccaagtgccactacgagcgcgactaccagtacgagacctcctggggctgcaaccccagcgactgccccggggtcggcaccgggtgcaccgcctgcggcctctacctggaccagctgaagccggtgggctccgcctacaagatcatcacgatccggtacagccgccgggtgtgcgtccagttcggggaggagaacctctgcaaggtgatcgacatgaacgactgcttcgtgtcccgccacgtcaaggtgtgcatcatcggcaccgtgagcaagttctcccagggggacaccctgctgttcttcggccccctcgaggggggcggcctgatcttcaagcactggtgcaccagcacgtgccagttcggggaccccggcgacatcatgtccccccgggacaaggggttcctgtgcccggagttccccggcagcttccgcaagaagtgcaacttcgccaccacccccgtctgcgagtacgacgggaacatggtgtccggctacaagaaggtgatggcgaccatcgacagcttccagtccagcaacacgtccaccatgcacttcaccgacgagcggatcgagtggaaggaccccgacggcatgctccgcgaccacatcaacatcctggtcaccaaggacatcgacttcgacaacctgggggagaacccgtgcaagatcggcctccagacgagcagcatcgagggggcctggggctccggggtgggcttcaccctgacctgcctgatcagcctcaccgagtgccccacgttcctgacctccatcaaggcctgcgacaaggccatctgctacggcgccgagagcgtgaccctgacccgggggcagaacacggtcaaggtgtccggcaaggggggccacagcgggtccaccttcaagtgctgccacggcgaggactgcagccagtccggcctccacgcggccgccccccacctggacaaggtgaacgggatcagcgagatcgagaactccaaggtctacgacgacggcgccccccagtgcggggtgaagtgctggttcgtcaagagcggcgagtggatctccggcatcttcagcgggaactggatcgtgctgatcgtgctctgcgtcttcctgctgttctccctcgtgctgctgagcatcctctgcccggtgcgcaagcacaagaagtcctga

SEQ ID NO: 11741 - RNA, 3408 nt, synthetic construct
  misc_feature 1..3408: note = derived and/or modified CDS sequence (opt1) from HTNV(CGAa31MP7)__EF990925.1__GP
  source 1..3408: mol_type = other RNA
atgggcatctggaagtggctggtgatggccagcctcgtctggcccgccttcgccctgcgcaacgtgtacgacatgaagatcgagtgcccgcacaccgtgtccttcggggagaacagcgtcatcggctacgtggagctgccgcccatgcccctcgccgacaccacgcagatggtgcccgagtccagctgctccatggacaaccaccagagcctgaacaccatcaccaagtacacccagatcatctggcgggggaaggccgaccagtcccagagctcccagaacagcttcgagacggtctccaccggcgtggacctgaaggggacctgcgtgctcaagcacaagatgatcgaggagagctaccgctcccgcaagagcatcacgtgctacgacctgtcctgcaacagcacctactgcaagcccaccctgtacatgatcgtccccatccacgcctgcaacatgatgaagtcctgcctcatcgccctgggcccctaccgggtccaggtggtgtacgagcggacctactgcatgaccggcgtgctgatcgaggggaagtgcttcgtgccggaccagagcgtcgtgtccatcatcaagcacggcatcttcgacatcgcgagcgtgcacatcgtctgcttcttcgtggccgtgaaggggaacacgtacaagatcttcgagcaggtcaagaagtccttcgagagcaactgcaacgacaccgagaacaaggtgcagggctactacatctgcatcatcgggggcaacagctcccccgtgtacgtccccaccctcgacgacttccgcagcatggaggccttctccggcatcttccggagcccccacggggaggaccacgacctggccggcgaggaggtggcgtcctacagcatcgtcgggccggccaacgccaaggtgccccactccgccagctccgacaccctgggcctcatcgcctacagcggcatcccctcctacagctccctgagcatcctgacgtccagcaccgaggcgaagcacgtgttctcccccgggctgttcccgcagctgaaccacaccaagtgcgacaagaccgccatccccctgacgtggaccggcatgatcgacctccccgggtactacgaggccatccacccctgcaccgtcttctgcgtgctgagcggcccgggggccagctgcgaggccttctccgagggcggcatcttcaacatcaccagccccatgtgcctggtgtccaagcagaaccgcttccggctcacggagcagcaggtcaacttcgtgtgccagcgcgtggacgtcgacatcatcgtgtactgcaacgggcagcggaaggtgatcctgaccaagaccctggtcatcggccagtgcatctacaccatcacgagcctcttctccctgctgcccggggtggcgcacagcatcgccgtggagctctgcgtccccggcttccacgggtgggccaccgccgccctgctggtgaccttctgcttcggctgggtgctcatcccggcgatcaccttcatcatcctgacgatcctgaagttcatcgccaacatcttccacacctccaaccaggagaaccgcctcaagagcgtcctgcggaagatcaaggaggagttcgagcgcaccaagggctccatggtgtgcgacatctgcaagtacgagtgcgagacctacaaggagctgaaggcccacggggtgagctgcccccagtcccagtgcccctactgcttcacgcactgcgagcccaccgaggccgccttccaggcgcactaccgggtctgccaggtgacccaccgcttccgggacgacctcaagaagaccgtgaccccgcagaacttcacgcccggctgctaccgcaccctgaacctgttccggtacaagagccgctgctacatcttcaccatgtggatctgcctcctggtcctggagtccatcctctgggccgccagcgcctccgagatccccctgaacccggtgtggaacgacaacgcgcacggggtgggcagcatccccatgcacaccgacctggagctcgacttctccctgacgagcagctccaagcacacctaccggcgcaagctgaccaaccccctggaggagagccaggccatcgacctccacgtcgagatcgaggagcagaccatcggggtggacgtgcacgccctgggccactggttcgacggccgcctgaacctcaagacgtccttccactgctacggggcctgcaccaagtacgagtacccctggcacaccgccaagtgccactacgagcgggactaccagtacgagaccagctggggctgcaacccgtccgactgccccggggtcggcacgggctgcaccgcgtgcgggctgtacctggaccagctcaagcccgtgggcagcgcctacaagatcatcaccatccgctactcccggcgcgtgtgcgtccagttcggggaggagaacctgtgcaaggtgatcgacatgaacgactgcttcgtgagccggcacgtcaaggtgtgcatcatcggcaccgtgtccaagttcagccagggggacacgctcctcttcttcggccccctggagggcgggggcctgatcttcaagcactggtgcacctccacgtgccagttcggggacccgggcgacatcatgagcccccgcgacaaggggttcctctgccccgagttccccggctccttccggaagaagtgcaacttcgccaccaccccggtctgcggctacgacgggaacatggtgagcggctacaagaaggtgatggccaccatcgactccttccagagcttcaacacctccaccatgcacttcacggacgagcgcatcgagtggaaggaccccgacgggatgctgcgggaccacatcaacatcctggtcaccaaggacatcgacttcgacaacctcggcgagaacccctgcaagatcgggctgcagaccagctccatcgagggcgcctggggcagcggggtgggcttcaccctgacgtgcctcatcagcctgaccgagtgccccaccttcctgacctccatcaaggcgtgcgacaaggccatctgctacggggccgagagcgtgacgctcacccgcggccagaacaccgtcaaggtgtccgggaagggcggccacagcgggtccaccttcaagtgctgccacggcgaggactgcagccagtccgggctgcacgccgccgcgccgcacctggacaaggtgaacggcatcagcgagatcgagaactccaaggtctacgacgacggcgcgccccagtgcgggatcaagtgctggttcgtcaagagcggcgagtggatctccgggatcttcagcggcaactggatcgtgctcatcgtgctgtgcgtgttcctcctgttctccctggtcctgctcagcatcctgtgccccgtgcggaagcacaagaagtcctga

SEQ ID NO: 11742 - RNA, 3408 nt, synthetic construct
  misc_feature 1..3408: note = derived and/or modified CDS sequence (opt1) from HTNV(CGAa4MP9)__EF990929.1__GP
  source 1..3408: mol_type = other RNA
atggagatctggaagtggctggtgatggccagcctcgtctggcccgccctggcgctgcgcaacgtgtacgacatgaagatcgagtgcccgcacaccgtgtccttcggcgagaacagcgtcctcgggtacgtggagctgccccccatgcccctggccgacaccatccagatggtgccggagtccagctgctccatggacaaccaccagagcatgtccacggccaccaagtacacccaggtcagctggcggggcaaggccgaccaggcccagtccagccagacctccttcgagacggtgagcgtggaggtcgacctcaaggggacctgcgtgctgaagcacaagatggtggagaagtcctaccgcagccggaagtccctgacctgctacgacctcagctgcaactccacctactgcaagcccacgctgtacatgatcgtccccatccacgcgtgcaacatgatgaagagctgcatcatcgccctgggcccctaccgcgtgcaggtggtctacgagcggacctactgcatgaccggggtgctcctggagggcaagtgcttcgtgccggaccagtccgtcgtgagcatcgtgaagcacagcatcttcgacatcgcctccgtccacatcgcctgcttcttcgtggcgatcaccggcaacacgtacaagctgatcgagcaggtgaagaccagcttcgggaccacctgcaacgacacggaggacaaggtccagggctactacatctgcatcctcgggggcaactccccccccatctacgtgcccaccctggacgacttccgcagcatggaggccttctccgggatcttccggagcccgcacggcgaggaccacgacctggccggcgaggagatcgcctcctacagcatcgtcgggcccgccaacgcgaagatcccccactccgccagctccgacaccctcagcctgatcgccttctccggcatccccagctactccagcctgtccatcctcaccagctccacggaggccaagcacgtgttcagcccggggctgttcccccagctgaaccacaccaagtgcgacaagaccgccatccccctcacctggacgggcatcatcgacctgcccggctactacgaggcggtgcacccgtgcaccgtcttctgcgtgctgagcgggcccggcgcctcctgcgaggccttcagcgaggggggcatcttcaacatcacctcccccatgtgcctcgtgagcaagcagaaccgcttccggctgaccgagcagcaggtcaacttcgtgtgccagcgcgtggacatggacatcgtcgtgtactgcaacgggcagcggaaggtgatcctgacgaagaccctcgtcatcggccagtgcatctacaccatcacctccctgttcagcctgctccccggcgtggcccactccatcgccgtggagctgtgcgtcccggggttccacggctgggcgacggccgccctgctcgtgaccttctgcttcgggtgggtgctgatccccgccatcaccttcgtcgtgctgaccgtgctcaagttcatcgccaacatcttccacacgagcaaccaggagaaccgcctgaagatggtcctgaagaagatcaaggaggagttcgagaagaccaagggctccatggtgtgcgacatctgcaagtacgagtgcgagacctacaaggagctcaaggcgcacggggtgagctgcccccagtcccagtgcccctactgcttcacccactgcgagccgaccgagagcgccttccaggcccactaccgggtctgccaggtgacgcaccgcttccgggaggacctgaagaagaccgtgaccccccagaacttcacccccggctgctaccgcacgctgaacctcttccggtacaagtcccgctgctacatcttcaccatgtggatcttcctgctggtcctcgagagcatcctgtgggccgcgtccgccagcgagaccccgctgtcccccacctggaacgacaacgcccacggcgtggggagcatccccatgcacacggacctggagctcgacttcagcctgacctccagctccaagtacacctaccggcgcaagctgaccaaccccctcgaggaggcccaggccgtgagcttccacgtcgagatcgaggagcagacgatcggcgtggacgtgcacgcgctggggcactggttcgacggccggctgaacctcaagacctccttccactgctacggggcctgcaccaagtacgagtacccgtggcacaccgccaagtgccactacgagcgcgactaccagtacgagacgagctggggctgcaacccctccgactgccccggcgtcgggaccggctgcaccgcctgcgggctgtacctggaccagctcaagcccgtgggcagcgcctacaagatcatcaccatccgctactcccggcgcgtgtgcgtccagttcggcgaggagaacctgtgcaaggtgatcgacatggacgactgcttcgtgagccggcacgtcaaggtgtgcatcatcgggacggtgtccaagttcagccagggcgacaccctgctcttcttcgggccgctggagggcgggggcctgatctacaagcactggtgcacctccacctgccagttcggcgaccccggggacatcatgagcccccgcgacaagggcctcctgtgccccgagttcccggggtccttccggaagaagtgcaacttcgcgacgacccccgtctgcgagtacgacggcaacatggtgagcgggtacaagaaggtgatggccaccatcgactccttccagagcatcaacacctccacgatgcacttcaccgacgagcgcatcgagtggaaggaccccgacggcatgctgcgggaccacatcaacatcctcgtcaccaaggacatcgacttcgacaacctgggcgagaacccctgcaagatcgggctgcagaccagcagcatcgagggcgcctgggggtccggcgtggggttcacgctcacctgcctgatcagcctgaccgagtgcccgaccttcctcacgtccatcaaggcctgcgacaaggccatctgctacggcgcggagagcgtgaccctgacccgcggccagaacaccgtcaaggtgtccgggaagggcgggcacagcggctccaccttcaagtgctgccacggggaggactgcagccagtccggcctgcacgccgccgccccccacctcgacaaggtgaacggcatcagcgagatggagaactccaaggtctacgacgacggggcgccccagtgcggcatcaagtgctggttcgtgaagagcggggagtggatctccggcatcttcagcggcaactggatcgtcctgatcgtgctgtgcgtgttcctcctgttctccctggtcctcctgagcatcctgtgccccgtgcggaagcacaagaagtcctga

SEQ ID NO: 11743 - RNA, 3408 nt, synthetic construct
  misc_feature 1..3408: note = derived and/or modified CDS sequence (opt1) from HTNV(CGAa4P15)__EF990928.1__GP
  source 1..3408: mol_type = other RNA
atggagatctggaagtggctggtgatggccagcctcgtctggcccgccctggcgctgcgcaacgtgtacgacatgaagatcgagtgcccgcacaccgtgtccttcggcgagaacagcgtcctcgggtacgtggagctgccccccatgcccctggccgacaccatccagatggtgccggagtccagctgctccatggacaaccaccagagcatgtccacggccaccaagtacacccaggtcagctggcggggcaaggccgaccaggcccagtccagccagacctccttcgagacggtgagcgtggaggtcgacctcaaggggacctgcgtgctgaagcacaagatggtggagaagtcctaccgcagccggaagtccctgacctgctacgacctcagctgcaactccacctactgcaagcccacgctgtacatgatcgtccccatccacgcgtgcaacatgatgaagagctgcatcatcgccctgggcccctaccgcgtgcaggtggtctacgagcggacctactgcatgaccggggtgctcctggagggcaagtgcttcgtgccggaccagtccgtcgtgagcatcgtgaagcacagcatcttcgacatcgcctccgtccacatcgcctgcttcttcgtggcgatcaccggcaacacgtacaagctgttcgagcaggtgaagaccagcttcgggaccacctgcaacgacacggaggacaaggtccagggctactacatctgcatcctcgggggcaactccccccccatctacgtgcccaccctggacgacttccgcagcatggaggccttctccgggatcttccggagcccgcacggcgaggaccacgacctggccggcgaggagatcgcctcctacagcatcgtcgggcccgccaacgcgaagatcccccactccgccagctccgacaccctcagcctgatcgccttctccggcatccccagctactccagcctgtccatcctcaccagctccacggaggccaagcacgtgttcagcccggggctgttcccccagctgaaccacaccaagtgcgacaagaccgccatccccctcacctggacgggcatcatcgacctgcccggctactacgaggcggtgcacccgtgcaccgtcttctgcgtgctgagcgggcccggcgcctcctgcgaggccttcagcgaggggggcatcttcaacatcacctcccccatgtgcctcgtgagcaagcagaaccgcttccggctgaccgagcagcaggtcaacttcgtgtgccagcgcgtggacatggacatcgtcgtgtactgcaacgggcagcggaaggtgatcctgacgaagaccctcgtcatcggccagtgcatctacaccatcacctccctgttcagcctgctccccggcgtggcccactccatcgccgtggagctgtgcgtcccggggttccacggctgggcgacggccgccctgctcgtgaccttctgcttcgggtgggtgctgatccccgccatcaccttcgtcgtgctgaccgtgctcaagttcatcgccaacatcttccacacgagcaaccaggagaaccgcctgaagatggtcctgaagaagatcaaggaggagttcgagaagaccaagggctccatggtgtgcgacatctgcaagtacgagtgcgagacctacaaggagctcaaggcgcacggggtgagctgcccccagtcccagtgcccctactgcttcacccactgcgagccgaccgagagcgccttccaggcccactaccgggtctgccaggtgacgcaccgcttccgggaggacctgaagaagaccgtgaccccccagaacttcacccccggctgctaccgcacgctgaacctcttccggtacaagtcccgctgctacatcttcaccatgtggatcttcctgctggtcctcgagagcatcctgtgggccgcgtccgccagcgagaccccgctgtcccccacctggaacgacaacgcccacggcgtggggagcatccccatgcacacggacctggagctcgacttcagcctgacctccagctccaagtacacctaccggcgcaagctgaccaaccccctcgaggaggcccaggccgtgagcttccacgtcgagatcgaggagcagacgatcggcgtggacgtgcacgcgctggggcactggttcgacggccggctgaacctcaagacctccttccactgctacggggcctgcaccaagtacgagtacccgtggcacaccgccaagtgccactacgagcgcgactaccagtacgagacgagctggggctgcaacccctccgactgccccggcgtcgggaccggctgcaccgcctgcgggctgtacctggaccagctcaagcccgtgggcagcgcctacaagatcatcaccatccgctactcccggcgcgtgtgcgtccagttcggcgaggagaacctgtgcaaggtgatcgacatggacgactgcttcgtgagccggcacgtcaaggtgtgcatcatcgggacggtgtccaagttcagccagggcgacaccctgctcttcttcgggccgctggagggcgggggcctgatcttcaagcactggtgcacctccacctgccagttcggcgaccccggggacatcatgagcccccgcgacaagggcttcctctgccccgagttcccggggtccttccggaagaagtgcaacttcgcgacgacccccgtctgcgagtacgacggcaacatggtgagcgggtacaagaaggtgatggccaccatcgactccttccagagcatcaacacctccacgatgcacttcaccgacgagcgcatcgagtggaaggaccccgacggcatgctgcgggaccacatcaacatcctggtcaccaaggacatcgacttcgacaacctcggcgagaacccctgcaagatcgggctgcagaccagcagcatcgagggcgcctgggggtccggcgtggggttcacgctgacctgcctcatcagcctgaccgagtgcccgaccttcctgacgtccatcaaggcctgcgacaaggccatctgctacggcgcggagagcgtgaccctcacccgcggccagaacaccgtcaaggtgtccgggaagggcgggcacagcggctccaccttcaagtgctgccacggggaggactgcagccagtccggcctgcacgccgccgccccccacctggacaaggtgaacggcatcagcgagatggagaactccaaggtctacgacgacggggcgccccagtgcggcatcaagtgctggttcgtgaagagcggggagtggatctccggcatcttcagcggcaactggatcgtcctcatcgtgctgtgcgtgttcctgctcttctccctggtcctgctcagcatcctgtgccccgtgcggaagcacaagaagtcctga

SEQ ID NO: 11744 - RNA, 3408 nt, synthetic construct
  misc_feature 1..3408: note = derived and/or modified CDS sequence (opt1) from HTNV(CGAa75)__EU092224.1__GP
  source 1..3408: mol_type = other RNA
atggagatctggaagtggctggtgatggccagcctcgtctggcccgccctggcgctgcgcaacgtgcacgacatgaagatcgagtgcccgcacaccgtgtccttcggcaagaacagcgtcatcgggtacgtggagctcccccccatgcccctggccgacaccatccagatggtgccggagtccagctgctccatggacaaccaccagagcctgtccacggtcaccaagcacacccaggtgagctggcggggcaaggccgaccaggcccagtccagccagacctccttcgagacggtgagcgtcgaggtggacctcaaggggacctgcgtgctgaagcacaagctggtcgaggagtcctaccgcagccggaagtccctcacctgctacgacctgagctgcaactccacctactgcaagcccacgctgtacatgatcgtgcccatccacgcctgcaacatgatgaagagctgcatcatcgcgctcggcccccaccgcgtgcaggtcgtgtacgagcggacctactgcatgaccggggtgctgctggagggcaagtgcttcgtcccggaccagtccgtggtgagcatcgtccgccacggcatcttcgacatcgccagcgtgcacatcgcctgcttcttcgtggccatcaccgggaacacgtacaagctcttcgagcaggtcaagaagtccttcggcaccacctgcaacgacaccgagaacaaggtgcaggggtactacatctgcatcctgggcgggaacagcccccccatctacgtccccacgctggacgacttccggtccatggaggcgttcagcggcatcttcaagtccccgcacggcgaggaccacgacctcgccggggaggagatcgccagctactccatcgtgggccccgccaacgccaaggtgccccacagcgcgtccagcgacaccctgtccctgatcgccttcagcgggatcccctcctacagctccctcagcatcctgacctccagcaccgaggccaagcacgtcttctccccgggcctgttcccccagctcaaccacacgaagtgcgacaagaccgccatccccctgacctggaccggcatcatcgacctgcccgggtactacgaggccgtgcacccgtgcacggtgttctgcgtcctcagcggccccggggcgagctgcgaggccttctccgagggcgggatcttcaacatcaccagccccatgtgcctggtgtccaagcagaaccgcttccggctgaccgagcagcaggtgaacttcgtctgccagcgcgtggacatggacatcgtggtctactgcaacggccagcggaaggtgatcctcaccaagacgctggtgatcggccagtgcatctacaccatcaccagcctgttctccctcctgcccggggtcgcccacagcatcgccgtggagctgtgcgtgccgggcttccacgggtgggccaccgcggccctcctgatcacgttctgcttcggctgggtcctgatccccgccctcaccttcatcgtgctgaccgtgctgaagttcatcgccaacatcttccacacctccaaccaggagaaccgcctcaagatggtcctgaagaagatcaaggaggagttcgagcggacgaaggggagcatggtgtgcgacatctgcaagtacgagtgcgagaccaacaaggagctgaaggcccacggcgtgtcctgcccccagagccagtgcccctactgcttcacccactgcgagccgaccgagtccgcgagccaggcccactaccgcgtctgccaggtgacccaccggttccgcgacgacctcaagaagacggtgaccccccagaacttcacccccggctgctaccggaccctgaacctgttccgctacaagtcccggtgctacatcttcacgatgtggatctgcctcctggtcctggagagcatcctgtgggccgcctccgcgagcgagatcccgctctcccccacctggaacgacaacgcccacggggtgggcagcatccccatgcacaccgacctggagctggacttcagcctcacctccagctccaagtacacgtaccgccggaagctgaccaaccccctggaggagagccaggccgtgaacttccacgtcgagatcgaggagcaggccatcggggtggacgtgcacgccctcggccactggttcgacgggcgcctgaacctgaagacctccttccactgctacggcgcgtgcaccaagtacgagtacccgtggcacacggccaagtgccactacgagcgcgactaccagtacgagaccagctggggctgcaacccctccgactgccccggggtcggcaccgggtgcaccgcctgcggcctctacctggaccagctgaagcccgtgggcagcgcctacaagatcatcacgatccggtactcccgccgggtgtgcgtccagttcggggaggagaacctctgcatcgtgatcgacatgaacgactgcttcgtgagccgccacgtcaaggtgtgcatcatcggcaccgtgtccaagttcagccagggggacaccctgctgttcttcggcccgctcgaggggggcggcctgatcctgaagcactggtgcacctccacgtgccagttcggggaccccggcgacatcatgagcccccgggacaaggggttcctctgccccgagttcccgggctccttccgcaagaagtgcaacttcgccaccacccccgtctgcgagtacgggggcaacatggtgagcggctacaagaaggtgatggcgaccatcgactccttccagagcttcaacacgtccaccatgcacttcaccgacgagcggatcgagtggaaggaccccgacgggatgctgcgcgaccacatcaacatcctggtcaccaaggacatcgacttcgacaacctcggcgagaacccctgcaagatcgggctgcagacgagcagcatcgagggcgcctgggggtccggcgtgggcttcaccctgacctgcctcatcagcctgaccgagtgcccgacgttcctgacctccatcaaggcctgcgacaaggccatctgctacggggccgagagcgtgaccctcacccggggccagaacacggtcaaggtgtccgggaagggcgggcacagcggctccaccttcaagtgctgccacggcgaggactgcagccagtccgggctgcacgcggccgccccccacctggacaaggtgaacggcatcagcgagatcgagaactccaaggtctacgacgacggggccccccagtgcggcatcaagtgctggttcgtgaagagcggcgagtggatctccgggatcttcagcggcaactggatcgtcctcatcgtgctgtgcgtgttcctgctcttctccctggtcctgctcagcatcctgtgccccgtgcgcaagcacaaggagtcctga

SEQ ID NO: 11745 - RNA, 3408 nt, synthetic construct
  misc_feature 1..3408: note = derived and/or modified CDS sequence (opt1) from HTNV(CGHu2)__EU363819.1__GP
  source 1..3408: mol_type = other RNA
atgggcatctggaagtggctggtgatggccagcctcgtctggcccgccttcgccctgcgcaacgtgtacgacatgaagatcgagtgcccgcacaccgtgtccttcggggagaacagcgtcatcggctacgtggagctgccgcccatgcccctcgccgacaccacgcagatggtgcccgagtccagctgctccatggacaaccaccagagcctgaacaccatcaccaagtacacccagatcatctggcgggggaaggccgaccagtcccagagctcccagaacagcttcgagacggtctccaccggcgtggacctgaaggggacctgcgtgctcaagcacaagatgatcgaggagagctaccgctcccgcaagagcatcacgtgctacgacctgtcctgcaacagcacctactgcaagcccaccctgtacatgatcgtccccatccacgcctgcaacatgatgaagtcctgcctcatcgccctgggcccctaccgggtccaggtggtgtacgagcggacctactgcatgaccggcgtgctgatcgaggggaagtgcttcgtgccggaccagagcgtcgtgtccatcatcaagcacggcatcttcgacatcgcgagcgtgcacatcgtctgcttctacgtggccgtgaaggggaacacgtacaagatcttcgagcaggtcaagaagtccttcgagagcaactgcaacgacaccgagaacaaggtgcagggctactacatctgcatcatcgggggcaacagctcccccgtgtacgtccccaccctcgacgacttccgcagcatggaggccttctccggcatcatccggagcccccacggggaggaccacgacctggccggcgaggaggtggcgtcctacagcatcgtcgggccggccaacgccaaggtgccccactccgccagctccgacaccctgggcctcatcgcctacagcggcatcccctcctacagctccctgagcatcctgacgtccagcaccgaggcgaagcacgtgttctcccccgggctgttcccgcagctgaaccacaccaagtgcgacaagaccgccatccccctgacgtggaccggcatgatcgacctccccgggtactacgaggccatccacccctgcaccgtcatctgcgtgctgagcggcccgggggccagctgcgaggccctgtccgagggcggcatcttcaacatcaccagccccatgtgcctcgtgtccaagcagaaccgcttccggctgacggagcagcaggtcaacttcgtgtgccagcgcgtggacgtcgacatcatcgtgtactgcaacgggcagcggaaggtgatcctgaccaagaccctcgtcatcggccagtgcatctacaccatcacgagcctgttctccctgctccccggggtggcgcacagcatcgccgtggagctgtgcgtccccggcttccacgggtgggccaccgccgccctgctcgtgaccttctgcttcggctgggtgctgatcccggcgatcaccttcatcatcctgacgatcctcaagttcatcgccaacatcttccacacctccaaccaggagaaccgcctcaagagcgtcctgcggaagatcaaggaggagttcgagcgcaccaagggctccatggtgtgcgacatctgcaagtacgagtgcgagacctacaaggagctcaaggcccacggggtgagctgcccccagtcccagtgcccctactgcttcacgcactgcgagcccaccgaggccgccttccaggcgcactaccgggtctgccaggtgacccaccgcttccgggacgacctgaagaagaccgtgaccccgcagaacttcacgcccggctgctaccgcaccctgaacctcttccggtacaagagccgctgctacatcttcaccatgtggatctgcctgctggtcctcgagtccatcctgtgggccgccagcgcctccgagatccccctgaacccggtgtggaacgacaacgcgcacggggtgggcagcatccccatgcacaccgacctcgagctggacttctccctgacgagcagctccaagcacacctaccggcgcaagctgaccaaccccctcgaggagagccaggccatcgacctgcacgtcgagatcgaggagcagaccatcggggtggacgtgcacgccctgggccactggttcgacggccgcctcaacctgaagacgtccttccactgctacggggcctgcaccaagtacgagtacccctggcacaccgccaagtgccactacgagcgggactaccagtacgagaccagctggggctgcaacccgtccgactgccccggggtcggcacgggctgcaccgcgtgcgggctgtacctcgaccagctgaagcccgtgggcagcgcctacaagatcatcaccatccgctactcccggcgcgtgtgcgtccagttcggggaggagaacctgtgcaaggtgatcgacatgaacgactgcttcgtgagccggcacgtcaaggtgtgcatcatcggcaccgtgtccaagttcagccagggggacacgctcctgttcttcggccccctggagggcgggggcctcatcttcaagcactggtgcacctccacgtgccagttcggggacccgggcgacatcatgagcccccgcgacaaggggttcctgtgccccgagttccccggctccttccggaagaagtgcaacttcgccaccaccccggtctgcggctacgacgggaacatggtgagcggctacaagaaggtgatggccaccatcgactccttccagagcttcaacacctccaccatgcacttcacggacgagcgcatcgagtggaaggaccccgacgggatgctgcgggaccacatcaacatcctcgtcaccaaggacatcgacttcgacaacctgggcgagaacccctgcaagatcgggctgcagaccagctccatcgagggcgcctggggcagcggggtgggcttcaccctcacgtgcctgatcagcctgaccgagtgccccaccttcctcacctccatcaaggcgtgcgacaaggccatctgctacggggccgagagcgtgacgctgacccgcggccagaacaccgtcaaggtgtccgggaagggcggccacagcgggtccaccttcaagtgctgccacggcgaggactgcagccagtccgggctgcacgccgccgcgccgcacctcgacaaggtgaacggcatcagcgagatcgagaactccaaggtctacgacgacggcgcgccccagtgcgggatcaagtgctggttcgtcaagagcggcgagtggatctccgggatcttcagcggcaactggatcgtgctgatcgtgctgtgcgtgttcctcctgttctccctggtcctcctgagcatcctgtgccccgtgcggaagcacaagaagtcctga

SEQ ID NO: 11746 - RNA, 3408 nt, synthetic construct
  misc_feature 1..3408: note = derived and/or modified CDS sequence (opt1) from HTNV(CGHu3)__EU363818.1__GP
  source 1..3408: mol_type = other RNA
atggagatctggaagtggctggtgatggccagcctcgtctggcccgccctggcgctgcgcaacgtgcacgacatgaagatcgagtgcccgcacaccgtgtccttcggcaagaacagcgtcatcgggtacgtggagctcccccccatgcccctggccgacaccatccagatggtgccggagtccagctgctccatggacaaccaccagagcctgtccacggccaccaagtacacccaggtcagctggcggggcaaggccgaccaggcccagtccagccagacctccttcgagacggtgagcgtggaggtcgacctcaaggggacctgcgtgctgaagcacaagctggtggaggagtcctaccgcagccggaagtccctcacctgctacgacctgagctgcaactccacctactgcaagcccacgctgtacatgatcgtccccatccacgcgtgcaacatgatgaagagctgcatcatcgccctcggcccccaccgcgtgcaggtggtctacgagcggacctactgcatgaccggggtgctgctggagggcaagtgcttcgtgccggaccagtccgtcgtgagcatcgtgcgccacggcatcttcgacatcgccagcgtccacatcgcctgcttcttcgtggcgatcaccgggaacacgtacaagctcttcgagcaggtgaagaagtccttcggcaccacctgcaacgacaccgagaacaaggtccaggggtactacatctgcatcctgggcgggaacagcccccccatctacgtgcccacgctggacgacttccggtccatggaggccttcagcggcatcttcaagtccccgcacggcgaggaccacgacctcgccggggaggagatcgccagctactccatcgtcggccccgccaacgcgaaggtgccccacagcgcctccagcgacaccctgtccctgatcgccttcagcgggatcccctcctacagctccctcagcatcctgacctccagcaccgaggccaagcacgtgttctccccgggcctgttcccccagctcaaccacacgaagtgcgacaagaccgccatccccctgacctggaccggcatcatcgacctgcccgggtactacgaggcggtccacccgtgcacggtgttctgcgtgctcagcggccccggggccagctgcgaggccttctccgagggcgggatcttcaacatcaccagccccatgtgcctggtctccaagcagaaccgcttccggctgaccgagcagcaggtgaacttcgtgtgccagcgcgtcgacatggacatcgtggtgtactgcaacggccagcggaaggtcatcctcaccaagacgctggtgatcggccagtgcatctacaccctgaccagcctcttctccctgctgcccggggtggcccacagcatcgccgtcgagctctgcgtgccgggcttccacgggtgggcgaccgccgccctgctgatcacgttctgcttcggctgggtgctcatccccgccctgaccttcatcgtcctgaccgtgctcaagttcatcgccaacatcttccacacctccaaccaggagaaccgcctgaagatggtgctgaagaagatcaaggaggagttcgagcggacgaaggggagcatggtctgcgacatctgcaagtacgagtgcgagacctacaaggagctcaaggcgcacggcgtgtcctgcccccagagccagtgcccctactgcttcacccactgcgagccgaccgagtccgccttccaggcccactaccgcgtgtgccaggtcacccaccggttccgcgacgacctgaagaagacggtgaccccccagaacttcacccccggctgctaccggaccctgaacctcttccgctacaagagccggtgctacatcttcacgatgtggatctgcctgctggtgctggagtccatcctctgggccgcgagcgcctccgagatcccgctgagccccacctggaacgacaacgcccacggggtcggctccatccccatgcacaccgacctggagctcgacttcagcctgaccagctccagcaagtacacgtaccgccggaagctgaccaaccccctcgaggagtcccaggccgtgaacttccacgtggagatcgaggagcaggccatcggggtcgacgtgcacgcgctgggccactggttcgacgggcgcctgaacctcaagaccagcttccactgctacggcgcctgcaccaagtacgagtacccgtggcacacggccaagtgccactacgagcgcgactaccagtacgagacctcctggggctgcaaccccagcgactgccccggggtgggcaccgggtgcaccgcctgcggcctgtacctggaccagctcaagcccgtcggctccgcctacaagatcatcacgatccggtacagccgccgggtgtgcgtgcagttcggggaggagaacctgtgcaaggtcatcgacatgaacgactgcttcgtgtcccgccacgtgaaggtctgcatcatcggcaccgtgagcaagttctcccagggggacaccctgctcttcttcggcccgctggaggggggcggcctgatcttcaagcactggtgcaccagcacgtgccagttcggggaccccggcgacatcatgtccccccgggacaaggggttcctctgccccgagttcccgggcagcttccgcaagaagtgcaacttcgcgaccacccccgtgtgcgagtacgacgggaacatggtctccggctacaagaaggtgatggccaccatcgacagcttccagtccttcaacacgagcaccatgcacttcaccgacgagcggatcgagtggaaggaccccgacggcatgctgcgcgaccacatcaacatcctggtgaccaaggacatcgacttcgacaacctcggggagaacccctgcaaggtcggcctgcggacgtccagcatcgagggggcctggggcagcggggtgggcttcaccctgacctgcctcatctccctgaccgagtgcccgacgttcctgaccagcatcaaggcctgcgacaaggccatctgctacggcgcggagtccgtgaccctcacccgcgggcagaacacggtcaaggtgagcggcaaggggggccactccgggagcaccttcaagtgctgccacggcgaggactgctcccagagcggcctgcacgccgccgccccccacctggacaaggtgaacgggatctccgagatcgagaacagcaaggtctacgacgacggcgcgccccagtgcgggatcaagtgctggttcgtgaagtccggcgagtggatcagcggcatcttctccgggaactggatcgtcctcatcgtgctgtgcgtgttcctgctcttcagcctggtcctgctctccatcctgtgccccgtgcggaagcacaagaagagctga

SEQ ID NO: 11747 - RNA, 3408 nt, synthetic construct
  misc_feature 1..3408: note = derived and/or modified CDS sequence (opt1) from HTNV(CGHu3612)__EF990923.1__GP
  source 1..3408: mol_type = other RNA
atgggcatctggaagtggctggtgatggccagcctcgtctggcccgccttcgccctgcgcaacctgtacgacatgaagatcgagtgcccgcacaccgtgtccttcggggagaacagcgtgaccggctacgtcgagctcccgcccatgcccctggccgacacgacccagatggtgcccgagtccagctgctccatggacaaccaccagagcctgaacaccatcaccaagtacacgcagatcatctggcgggggaaggccgaccagtcccagagctcccagaacagcttcgagaccgtgtccaccgaggtcgacctcaaggggacctgcgtgctgaagcacaagatgatcgaggagagctaccgctcccgcaagagcatcacgtgctacgacctgtcctgcaacagcacctactgcaagcccaccctctacatgatcgtgcccatccacgcctgcaacatgatgaagtcctgcctgatcgccctggggccctaccgcgtccaggtggtgtacgagcggacctactgcatgacgggcgtcctcatcgagggcaagtgcttcgtgccggaccagagcgtggtctccatcatcaagcacgggatcttcgacatcgccagcgtgcacatcgtgtgcttcatcgtcgccgtgaagggcaacacctacaagatcttcgagcaggtcaagaagaccttcgagagcaactgcaacgacaccgagaacaaggtccaggggtactacatctgcatcatcggcgggaactccagccccgtgtacgtgcccacgctggacgacttccgctccatggaggccttcagcggcatcatccggagcccccacggcgaggaccacgacctggccggggaggaggtcgcgtcctactccatcgtgggcccggccaacgccaaggtcccccacagcgcctccagcgacaccctcgggctgatcgcctactccagcatcccctcctacagctccctgagcatcctcacctccagcaccgaggcgaagcacgtgttctcccccggcctgttccgccagctgaaccacacgaagtgcgacaagaccgccatcccgctcacctggaccggcatgatcgacctgcccgggtactacgaggccatccacccctgcacggtgttctgcgtgctgagcggccccggcgccagctgcgaggccttctccgagggcgggatcttcaacatcgcgagcccgatgtgcctcgtgtccaagcagaaccggttccggctgaccgagcagcaggtcaacttcgtgtgccagcgggtggacgtggacatcatcgtctactgcaacggccagcgcaaggtgatcctgaccaagaccctcgtgatcggccagtgcatctacacgatcaccagcctgttctccctgctccccggggtcgcccacagcatcgccgtggagctgtgcgtgcccggcttccacgggtgggccaccgccgcgctgctcgtcaccttctgcttcggctgggtgctgatccccgccatcacgttcatcatcctgaccatcctcaagttcatcgccaacatcttccacacctccaaccaggagaaccggctcaagagcgtgctgcgcaagatcaaggaggagttcgagcggaccaaggggtccatggtctgcgacatctgcaagtacgagtgcgagacgtacaaggagctcaaggcccacggcgtgagctgcccgcagtcccagtgcccctactgcttcacccactgcgagcccaccgaggccgcgttccaggcccactacaaggtgtgccaggtcacccaccgcttccgggacgacctgaagaagaccgtgacgccccagaacttcaccccgggctgctaccgcaccctgaacctcttccggtacaagagccgctgctacatcttcaccatgtgggtgttcctgctggtcctcgagtccatcctgtgggccgccagcgcgtccgagatccccctgaaccccgtgtggaacgacaacgcccacggggtgggcagcatcccgatgcacacggacctcgagctggacttctccctgaccagcagctccaagtacacctaccggcgcaagctgaccaaccccctcgaggagagccaggccatcgacctgcacgtcgagatcgaggagcagacgatcggggtggacgtgcacgccctgggccactggttcgacgggcgcctcaacctgaagacctccttccactgctacggcgcctgcaccaagtacgagtacccctggcacaccgcgaagtgccactacgagcgggactaccagtacgagacgagctggggctgcaacccctccgactgcccgggggtcggcaccgggtgcaccgcctgcggcctgtacctcgaccagctgaagcccgtgggcagcgcctacaagatcatcaccatccgctactcccggcgcgtgtgcgtccagttcggggaggagaacctgtgcaagatcatcgacatgaacgactgcttcgtgagccggcacgtgaaggtctgcatcatcggcacggtgtccaagttcagccagggggacaccctcctgttcttcggccccctggagggcgggggcctcatcttcaagcactggtgcaccagcacgtgccagttcggggaccccggcgacatcatgagcccgcgcgacaaggggttcctgtgccccgagttccccggctccttccggaagaagtgcaacttcgccaccacccccgtgtgcgagtacgacgggaacatggtcagcggctacaagaaggtgatggccaccatcgactccatccagagcttcaacacctccacgatgcacttcaccgacgagcgcatcgagtggaaggacccggacggcatgctgcgggaccacatcaacatcctcgtgaccaaggacatcgacttcgacaacctgggggagaacccctgcaagatcggcctgcagaccagctccatcgagggggcgtggggcagcggggtcggcttcacgctgacctgcctgatcagcctgaccgagtgctccaccttcctcacgagcatcaaggcctgcgacaaggccatctgctacggcgccgagtccgtgaccctgacccgcgggcagaacaccgtgaaggtcagcggcaagggcgggcactccgggagctccttcaagtgctgccacggcgaggagtgcagccagatcggcctgcacgccgcggcgccccacctcgacaaggtgaacgggatctccgagatggagaacagcaaggtgttcgacgacggcgcgccccagtgcgggatcaagtgctggttcgtcaagtccggcgagtggatcagcggcatcttctccgggaactggatcgtgctgatcgtgctgtgcgtcttcctcctgttcagcctggtgctcctgtccatcctgtgcccggtccggaagcacaagaagtcctga

SEQ ID NO: 11748 - RNA, 3408 nt, synthetic construct
  misc_feature 1..3408: note = derived and/or modified CDS sequence (opt1) from HTNV(CGHu3614)__EF990922.1__GP
  source 1..3408: mol_type = other RNA
atgggcatctggaagtggctggtgatggccagcctcgtctggcccgccttcgccctgcgcaacctgtacgacatgaagatcgagtgcccgcacaccgtgtccttcggggagaacagcgtgaccggctacgtcgagctcccgcccatgcccctggccgacacgacccagatggtgcccgagtccagctgctccatggacaaccaccagagcctgaacaccatcaccaagtacacgcagatcatctggcgggggaaggccgaccagtcccagagctcccagaacagcttcgagaccgtgtccaccgaggtcgacctcaaggggacctgcgtgctgaagcacaagatgatcgaggagagctaccgctcccgcaagagcatcacgtgctacgacctgtcctgcaacagcacctactgcaagcccaccctctacatgatcgtgcccatccacgcctgcaacatgatgaagtcctgcctgatcgccctggggccctaccgcgtccaggtggtgtacgagcggacctactgcatgacgggcgtcctcatcgagggcaagtgcttcgtgccggaccagagcgtggtctccatcatcaagcacgggatcttcgacatcgcgagcgtgcacatcgtgtgcttcttcgtcgccgtgaagggcaacacctacaagatcttcgagcaggtcaagaagaccttcgagagcaactgcaacgacaccgagaacaaggtccaggggtactacatctgcatcatcggcgggaactccagccccgtgtacgtgcccacgctggacgacttccgctccatggaggccttcagcggcatcttccggagcccccacggcgaggaccacgacctggccggggaggaggtcgcgtcctactccatcgtgggcccggccaacgccaaggtcccccacagcgcctccagcgacaccctcgggctgatcgcctactccagcatcccctcctacagctccctgagcatcctcacctccagcaccgaggcgaagcacgtgttctcccccggcctgttcccgcagctgaaccacacgaagtgcgacaagaccgccatccccctcacctggaccggcatgatcgacctgcccgggtactacgaggccatccacccctgcacggtgttctgcgtgctgagcggcccgggcgccagctgcgaggccttctccgagggcgggatcttcaacatcgcgagccccatgtgcctcgtgtccaagcagaaccggttccggctgaccgagcagcaggtcaacttcgtgtgccagcgcgtggacgtggacatcatcgtctactgcaacggccagcggaaggtgatcctgaccaagaccctcgtgatcggccagtgcatctacacgatcaccagcctgttctccctgctccccggggtcgcccacagcatcgccgtggagctgtgcgtgcccggcttccacgggtgggccaccgccgcgctgctcgtcaccttctgcttcggctgggtgctgatcccggccatcacgttcatcatcctgaccatcctcaagttcatcgccaacatcttccacacctccaaccaggagaaccgcctcaagagcgtgctgcggaagatcaaggaggagttcgagcgcaccaaggggtccatggtctgcgacatctgcaagtacgagtgcgagacgtacaaggagctcaaggcccacggcgtgagctgcccccagtcccagtgcccctactgcttcacccactgcgagcccaccgaggccgcgttccaggcccactacaaggtgtgccaggtcacccaccggttccgcgacgacctgaagaagaccgtgacgccgcagaacttcacccccggctgctaccggaccctgaacctcttccgctacaagagccggtgctacatcttcaccatgtgggtgttcctgctggtcctcgagtccatcctgtgggccgccagcgcgtccgagatccccctgaacccggtgtggaacgacaacgcccacggggtgggcagcatccccatgcacacggacctcgagctggacttctccctgaccagcagctccaagtacacctaccgccggaagctgaccaaccccctcgaggagagccaggccatcgacctgcacgtcgagatcgaggagcagacgatcggggtggacgtgcacgccctgggccactggttcgacgggcgcctcaacctgaagacctccttccactgctacggcgcctgcaccaagtacgagtacccctggcacaccgcgaagtgccactacgagcgcgactaccagtacgagacgagctggggctgcaacccgtccgactgccccggggtcggcaccgggtgcaccgcctgcggcctgtacctcgaccagctgaagcccgtgggcagcgcctacaagatcatcaccatccggtactcccgccgggtgtgcgtccagttcggggaggagaacctgtgcaagatcatcgacatgaacgactgcttcgtgagccgccacgtgaaggtctgcatcatcggcacggtgtccaagttcagccagggggacaccctcctgttcttcggccccctggagggcgggggcctcatcttcaagcactggtgcaccagcacgtgccagttcggggacccgggcgacatcatgagcccccgggacaaggggttcctgtgccccgagttccccggctccttccgcaagaagtgcaacttcgccaccaccccggtgtgcgagtacgacgggaacatggtcagcggctacaagaaggtgatggccaccatcgactccttccagagcttcaacacctccacgatgcacttcaccgacgagcggatcgagtggaaggaccccgacggcatgctgcgcgaccacatcaacatcctcgtgaccaaggacatcgacttcgacaacctgggggagaacccctgcaagatcggcctgcagaccagctccatcgagggggcgtggggcagcggggtcggcttcacgctgacctgcctgatcagcctgaccgagtgctccaccttcctcacgagcatcaaggcctgcgacaaggccatctgctacggcgccgagtccgtgaccctgacccgggggcagaacaccgtgaaggtcagcggcaagggcgggcactccgggagctccttcaagtgctgccacggcgaggagtgcagccagatcggcctgcacgccgcggcgccccacctcgacaaggtgaacgggatctccgagatggagaacagcaaggtgttcgacgacggcgccccgcagtgcgggatcaagtgctggttcgtcaagtccggcgagtggatcagcggcatcttctccgggaactggatcgtgctgatcgtgctgtgcgtcttcctcctgttcagcctggtgctcctgtccatcctgtgccccgtccgcaagcacaagaagtcctga

SEQ ID NO: 11749 - RNA, 3408 nt, synthetic construct
  misc_feature 1..3408: note = derived and/or modified CDS sequence (opt1) from HTNV(CGRn15)__EU363814.1__GP
  source 1..3408: mol_type = other RNA
atggagatctggaagtggctggtgatggccagcctcgtctggcccgccctggcgctgcgcaacgtgcacgacatgaagatcgagtgcccgcacaccgtgtccttcggcaagaacagcgtcatcgggtacgtggagctcccccccatgcccctggccgacaccatccagatggtgccggagtccagctgctccatggacaaccaccagagcctgtccacggtcaccaagtacacccaggtgagctggcggggcaaggccgaccaggcccagtccagccagacctccagcgagacggtgtccgtcgaggtggacctcaaggggacctgcgtgctgaagcacaagctggtcgaggagagctaccgctcccggaagagcctcacctgctacgacctgtcctgcaacagcacctactgcaagcccacgctgtacatgatcgtgcccatccacgcctgcaacatgatgaagtcctgcatcatcgcgctcggcccccaccgcgtgcaggtcgtgtacgagcggacctactgcatgaccggggtgctgctggagggcaagtgcttcgtcccggaccagagcgtggtgagcatcgtccgccacggcatcttcgacatcgcctccgtgcacatcgcctgcttcttcgtggccatcaccgggaacacgtacaagctcttcgagcaggtcaagaagagcttcggcaccacctgcaacgacaccgagaacaaggtgcaggggtactacatctgcatcctgggcgggaactccccccccatctacgtccccacgctggacgacttccggagcatggaggcgttctccggcatcttcaagagcccgcacggcgaggaccacgacctcgccggggaggagatcgcctcctacagcatcgtgggccccgccaacgccaaggtgccccactccgcgagctccgacaccctgagcctgatcgccttctccgggatccccagctactccagcctctccatcctgaccagctccaccgaggccaagcacgtcttcagcccgggcctgttcccccagctcaaccacacgaagtgcgacaagaccgccatccccctgacctggaccggcatcatcgacctgcccgggtactacgaggccgtgcacccgtgcacggtgttctgcgtcctcagcggccccggggcgtcctgcgaggccttcagcgagggcgggatcttcaacatcacctcccccatgtgcctggtgagcaagcagaaccgcttccggctgaccgagcagcaggtgaacttcgtctgccagcgcgtggacatggacatcgtggtctactgcaacggccagcggaaggtgatcctcaccaagacgctggtgatcggccagtgcatctacaccatcacctccctgttcagcctcctgcccggggtcgcccactccatcgccgtggagctgtgcgtgccgggcttccacgggtgggccaccgcggccctcctgatcacgttctgcttcggctgggtcctgatccccgccctcaccttcatcgtgctgaccgtgctgaagttcatcgccaacatcttccacaccagcaaccaggagaaccgcctcaagatggtcctgaagaagatcaaggaggagttcgagcggacgaaggggtccatggtgtgcgacatctgcaagtacgagtgcgagacctacaaggagctgaaggcccacggcgtgagctgcccccagtcccagtgcccctactgcttcacccactgcgagccgaccgagagcgcgttccaggcccactaccgcgtctgccaggtgacccaccggttccgcgacgacctcaagaagacggtgaccccccagaacttcacccccggctgctaccggaccctgaacctgttccgctacaagtcccggtgctacatcttcacgatgtggatctgcctcctggtcctggagagcatcctgtgggccgcctccgcgagcgagatcccgctctcccccacctggaacgacaacgcccacggggtgggcagcatccccatgcacaccgacctggagctggacttcagcctcacctccagctccaagtacacgtaccgccggaagctgaccaaccccctggaggagagccaggccgtgaacttccacgtcgagatcgaggagcaggccatcggggtggacgtgcacgccctcggccactggttcgacgggcgcctgaacctgaagacctccttccactgctacggcgcgtgcaccaagtacgagtacccgtggcacacggccaagtgccactacgagcgcgactaccagtacgagaccagctggggctccaaccccagcgactgccccggggtcggcaccgggtgcaccgcctgcggcctctacctggaccagctgaagcccgtgggctccgcctacaagatcatcacgatccggtacagccgccgggtgtgcgtccagttcggggaggagaacctctgcaaggtgatcgacatgaacgactgcttcgtgtcccgccacgtcaaggtgtgcatcatcggcaccgtgagcaagttctcccagggggacaccctgctgttcttcggcccgctcgaggggggcggcctgatcttcaagcactggtgcaccagcacgtgccagttcggggaccccggcgacatcatgtccccccgggacaaggggttcctgtgccccgagttcccgggcagcttccgcaagaagtgcaacttcgccaccacccccgtctgcgagtacgacgggaacatggtgtccggctacaagaaggtgatggcgaccatcgacagcttccagtccagcaacacgagcaccatgcacttcaccgacgagcggatcgagtggaaggaccccgacggcatgctccgcgaccacatcaacatcctggtcaccaaggacatcgacttcgacaacctgggggagaacccctgcaagatcggcctccagacgtccagcatcgagggggcctggggctccggggtgggcttcaccctgacctgcctgatcagcctcaccgagtgcccgacgttcctgacctccatcaaggcctgcgacaaggccatctgctacggcgccgagagcgtgaccctgacccgggggcagaacacggtcaaggtgtccggcaaggggggccacagcgggtccaccttcaagtgctgccacggcgaggactgcagccagtccggcctccacgcggccgccccccacctggacaaggtgaacgggatcagcgagatcgagaactccaaggtctacgacgacggcgccccccagtgcggggtgaagtgctggttcgtcaagagcggcgagtggatctccggcatcttcagcgggaactggatcgtgctgatcgtgctctgcgtcttcctgctgttctccctcgtgctgctgagcatcctctgccccgtgcgcaagcacaagaagtcctga

SEQ ID NO: 11750 - RNA, 3408 nt, synthetic construct
  misc_feature 1..3408: note = derived and/or modified CDS sequence (opt1) from HTNV(CGRn2616)__EU363816.1__GP
  source 1..3408: mol_type = other RNA
atggagatctggaagtggctggtgatggccagcctcgtctggcccgccctggcgctgcgcaacgtgcacgacatgaagatcgagtgcccgcacaccgtgtccttcggcaagaacagcgtcatcgggtacgtggagctcccccccatgcccctggccgacaccatccagatggtgccggagtccagctgctccatggacaaccaccagagcctgtccacggtcaccaagcacacccaggtgagctggcggggcaaggccgaccaggcccagtccagccagacctccttcgagacggtgagcgtcgaggtggacctcaaggggacctgcgtgctgaagcacaagctggtcgaggagtcctaccgcagccggaagtccctcacctgctacgacctgagctgcaactccacctactgcaagcccacgctgtacatgatcgtgcccatccacgcctgcaacatgatgaagagctgcatcatcgcgctcggcccccaccgcgtgcaggtcgtgtacgagcggacctactgcatgaccggggtgctgctggagggcaagtgcttcgtcccggaccagtccgtggtgagcatcgtccgccacggcatcttcgacatcgccagcgtgcacatcgcctgcttcttcgtggccatcaccgggaacacgtacaagctcttcgagcaggtcaagaagtccttcggcaccacctgcaacgacaccgagaacaaggtgcaggggtactacatctgcatcctgggcgggaacagcccccccatctacgtccccacgctggacgacttccggtccatggaggcgttcagcggcatcttcaagtccccgcacggcgaggaccacgacctcgccggggaggagatcgccagctactccatcgtgggccccgccaacgccaaggtgccccacagcgcgtccagcgacaccctgtccctgatcgccttcagcgggatcccctcctacagctccctcagcatcctgacctccagcaccgaggccaagcacgtcttctccccgggcctgttcccccagctcaaccacacgaagtgcgacaagaccgccatccccctgacctggaccggcatcatcgacctgcccgggtactacgaggccgtgcacccgtgcacggtgttctgcgtcctcagcggccccggggcgagctgcgaggccttctccgagggcgggatcttcaacatcaccagccccatgtgcctggtgtccaagcagaaccgcttccggctgaccgagcagcaggtgaacttcgtctgccagcgcgtggacatggacatcgtggtctactgcaacggccagcggaaggtgatcctcaccaagacgctggtgatcggccagtgcatctacaccatcaccagcctgttctccctcctgcccggggtcgcccacagcatcgccgtggagctgtgcgtgccgggcttccacgggtgggccaccgcggccctcctgatcacgttctgcttcggctgggtcctgatccccgccctcaccttcatcgtgctgaccgtgctgaagttcatcgccaacatcttccacacctccaaccaggagaaccgcctcaagatggtcctgaagaagatcaaggaggagttcgagcggacgaaggggagcatggtgtgcgacatctgcaagtacgagtgcgagaccaacaaggagctgaaggcccacggcgtgtcctgcccccagagccagtgcccctactgcttcacccactgcgagccgaccgagtccgcgttccaggcccactaccgcgtctgccaggtgacccaccggttccgcgacgacctcaagaagacggtgaccccccagaacttcacccccggctgctaccggaccctgaacctgttccgctacaagagccggtgctacatcttcacgatgtggatctgcctcctggtcctggagtccatcctgtgggccgccagcgcgtccgagatcccgctcagccccacctggaacgacaacgcccacggggtgggctccatccccatgcacaccgacctggagctggacttcagcctcaccagctccagcaagtacacgtaccgccggaagctgaccaaccccctggaggagtcccaggccgtgaacttccacgtcgagatcgaggagcaggccatcggggtggacgtgcacgccctcggccactggttcgacgggcgcctgaacctgaagaccagcttccactgctacggcgcgtgcaccaagtacgagtacccgtggcacacggccaagtgccactacgagcgcgactaccagtacgagacctcctggggctgcaaccccagcgactgccccggggtcggcaccgggtgcaccgcctgcggcctctacctggaccagctgaagcccgtgggctccgcctacaagatcatcacgatccggtacagccgccgggtgtgcgtccagttcggggaggagaacctctgcatcgtgatcgacatgaacgactgcttcgtgtcccgccacgtcaaggtgtgcatcatcggcaccgtgagcaagttctcccagggggacaccctgctgttcttcggcccgctcgaggggggcggcctgatcttcaagcactggtgcaccagcacgtgccagttcggggaccccggcgacatcatgtccccccgggacaaggggttcctgtgccccgagttcccgggcagcttccgcaagaagtgcaacttcgccaccacccccgtctgcgagtacgggggcaacatggtgtccggctacaagaaggtgatggcgaccatcgacagcttccagtccttcaacacgagcaccatgcacttcaccgacgagcggatcgagtggaaggaccccgacgggatgctccgcgaccacatcaacatcctggtcaccaaggacatcgacttcgacaacctgggcgagaacccctgcaagatcgggctccagacgtccagcatcgagggcgcctgggggagcggcgtgggcttcaccctgacctgcctgatctccctcaccgagtgcccgacgttcctgaccagcatcaaggcctgcgacaaggccatctgctacggggccgagtccgtgaccctgacccggggccagaacacggtcaaggtgagcgggaagggcgggcactccggcagcaccttcaagtgctgccacggcgaggactgctcccagagcgggctccacgcggccgccccccacctggacaaggtgaacggcatctccgagatcgagaacagcaaggtctacgacgacggggccccccagtgcggcatcaagtgctggttcgtgaagtccggcgagtggatcagcgggatcttctccggcaactggatcgtcctgatcgtgctctgcgtgttcctgctgttcagcctcgtcctgctgtccatcctctgccccgtgcgcaagcacaagaagagctga

SEQ ID NO: 11751 - RNA, 3408 nt, synthetic construct
  misc_feature 1..3408: note = derived and/or modified CDS sequence (opt1) from HTNV(CGRn2618)__EU363817.1__GP
  source 1..3408: mol_type = other RNA
atggagatctggaagtggctggtgatggccagcctcgtctggcccgccctggcgctgcgcaacgtgcacgacatgaagatcgagtgcccgcacaccgtgtccttcggcaagaacagcgtcatcgggtacgtggagctcccccccatgcccctggccgacaccatccagatggtgccggagtccagctgctccatggacaaccaccagagcctgtccacggtcaccaagtacacccaggtgagctggcggggcaaggccgaccaggcccagtccagccagacccccttcgagacggtgtccgtcgaggtggacctcaagcgcacctgcgtgctgaagcacaagctggtcgaggagagctaccggtcccgcaagagcctcacctgctacgacctgtcctgcaacagcacctactgcaagcccacgctgtacatgatcgtgcccatccacgcctgcaacatgatgaagtcctgcatcatcgcgctcgggccgcaccgggtgcaggtcgtgtacgagcgcacctactgcatgaccggcgtgctgctggaggggaagtgcttcgtccccgaccagagcgtggtgtccatcgtccggcacggcatcttcgacatcgccagcgtgcacatcgcctgcttcttcgtggccatcaccggcaacacgtacaagctcttcgagcaggtcaagaagagcttcgggaccacctgcaacgacaccgagaacaaggtgcagggctactacatctgcatcctggggggcaactccccccccatctacgtcccgacgctggacgacttccgcagcatggaggcgttctccgggatcttcaagagcccccacggcgaggaccacgacctcgccggcgaggagatcgcctcctacagcatcgtggggcccgccaacgccaaggtgccccactccgcgagctccgacaccctgagcctgatcgccttctccggcatcccgagctactccagcctctccatcctgaccagctccaccgaggccaagcacgtcttcagccccgggctgttcccccagctcaaccacacgaagtgcgacaagaccgccatccccctgacctggaccggcatcatcgacctgccgggctactacgaggccgtgcacccctgcacggtgttctgcgtcctctccgggcccggcgcgagctgcgaggccttcagcgaggggggcatcttcaacatcacctcccccatgtgcctggtgagcaagcagaaccggttccgcctgaccgagcagcaggtgaacttcgtctgccagcgggtggacatggacatcgtggtctactgcaacgggcagcgcaaggtgatcctcaccaagacgctggtgatcggccagtgcatctacaccatcacctccctgttcagcctcctgccgggcgtcgcccactccatcgccgtggagctgtgcgtgcccgggttccacggctgggccaccgcggccctcctgatcacgttctgcttcgggtgggtcctgatccccgccctcaccttcatcgtgctgaccgtgctgaagttcatcgccaacatcttccacaccagcaaccaggagaaccggctcaagatggtcctgaagaagatcaaggaggagttcgagcgcacgaagggctccatggtgtgcgacatctgcaagtacgagtgcgagacctacaaggagctgaaggcccacggggtgagctgcccccagtcccagtgcccgtactgcttcacccactgcgagcccaccgagagcgcgttccaggcccactaccgggtctgccaggtgacccaccgcttccgggacgacctcaagaagacggtgaccccccagaacttcaccccgggctgctaccgcaccctgaacctgttccggtacaagtcccgctgctacatcctcacgatgtggaacctgctgctgatccccggctaccggctctgggccgccagcgcgtccgagatccccctgagccccacctggaacgacaacgcccacggggtcggctccatcccgatgcacaccgacctggagctcgacttcagcctgacctccagcagcaagtacacgtaccgccgcaagctgaccaaccccctcgaggagtcccaggccgtgaacttccacgtggagatcgaggagcaggccatcggggtcgacgtgcacgccctgggccactggttcgacgggcggctgaacctcaagaccagcttccactgctacggcgcgtgcaccaagtacgagtacccctggcacacggccaagtgccactacgagcgcgactaccagtacgagacctcctggggctgcaaccccagcgactgcccgggggtgggcaccgggtgcaccgcctgcggcctgtacctggaccagctcaagcccgtcggctccgcctacaagatcatcacgatccggtacagccgccgggtgtgcgtgcagttcggggaggagaacctgtgcatcgtcatcgacatgaacgactgcttcgtgtcccgccacgtgaaggtctgcatcatcggcaccgtgagcaagttctcccagggggacaccctgctcttcttcggccccctggaggggggcggcctgatcttcaagcactggtgcaccagcacgtgccagttcggggaccccggcgacatcatgtccccgcgggacaaggggttcctctgccccgagttccccggcagcttccgcaagaagtgcaacttcgccaccacccccgtgtgcgagtacgggggcaacatggtctccggctacaagaaggtgatggcgaccatcgacagcttccagtccttcaacacgagcaccatgcacttcaccgacgagcggatcgagtggaaggacccggacgggatgctgcgcgaccacatcaacatcctggtgaccaaggacatcgacttcgacaacctcggcgagaacccctgcaagatcgggctgcagacgtccagcatcgagggcgcctgggggtccggcgtcggcttcaccctgacctgcctcatcagcctgaccgagtgccccacgttcctgaccagcatcaaggcctgcgacaaggccatctgctacggggccgagtccgtgaccctcacccggggccagaacacggtgaaggtcagcgggaagggcgggcactccggcagcaccttcaagtgctgccacggcgaggactgctcccagagcgggctgcacgcggccgccccccacctggacaaggtgaacggcatctccgagatcgagaacagcaaggtgtacgacgacggggccccgcagtgcggcatcaagtgctggttcgtcaagtccggcgagtggatcagcgggatcttctccggcaactggatcgtgctcatcgtcctgtgcgtgttcctgctcttcagcctggtgctgctctccatcctgtgccccgtccgcaagcacaagaagagctga

SEQ ID NO: 11752 - RNA, 3408 nt, synthetic construct
  misc_feature 1..3408: note = derived and/or modified CDS sequence (opt1) from HTNV(CGRn45)__EU092225.1__GP
  source 1..3408: mol_type = other RNA
atggagatctggaagtggctggtgatggccagcctcgtctggcccgccctggcgctgcgcaacgtgcacgacatgaagatcgagtgcccccacaccgtgagcttcggcaagaacagcgtcatcgggtacgtggagctcccgcccatgcccctggccgacaccatccagatggtgcccgagtccagctgctccatggacaaccaccagagcctgtccacggtcaccaagtacacccaggtgagctggcggggcaaggccgaccaggcccagtccagccagacctccttcgaggccgtgagcgtcgaggtggacctcaaggggacgtgcgtgctgaagcacaagctggtcgaggagtcctaccgcagccggaagtccctgacctgctacgacctcagctgcaactccacctactgcaagcccaccctgtacatgatcgtgcccatccacgcgtgcaacatgatgaagtcctgcatcatcgccctcggcccccaccgcgtgcaggtcgtgtacgagcggacgtactgcatgaccggggtgctgctggagggcaagtgcttcgtcccggaccagtccgtggtgagcatcgtccgccacggcatcttcgacatcgccagcgtgcacatcgcctgcttcttcgtggcgatcaccgggaacacctacaagctgttcgagcaggtcaagaagtccttcggcacgacctgcaacgacaccgagaacaaggtgcaggggtactacatctgcatcctcggcgggaacagcccgcccatctacgtccccaccctggacgacttccggtccatggaggccttcagcggcatcttcaagagcccccacggcgaggaccacgacctcgccggggaggagatcgcctcctactccatcgtgggccccgccaacgcgaaggtgccccacagcgcctccagcgacacgctgtccctgatcgccttcagcgggatcccctcctacagctccctcagcatcctgacctccagcaccgaggccaagcacgtcttctccccgggcctgttcccccagctcaaccacaccaagtgcgacaagacggccatccccctgacctggaccggcatcatcgacctgcccgggtactacgaggcggtgcacccgtgcaccgtgttctgcgtcctcagcggccccggggccagctgcgaggccttctccgagggcgggatcttcaacatcacgagccccatgtgcctggtgtccaagcagaaccgcttccggctgaccgagcagcaggtcaacttcgtgtgccagcgcgtggacatggacatcgtggtctactgcaacggccagcggaaggtgatcctcaccaagaccctggtgatcggccagtgcatctacacgatcaccagcctgttctccctcctgcccggggtcgcccacagcatcgccgtggagctgtgcgtgccgggcttccacgggtgggcgaccgccgccctcctgatcaccttctgcttcggctgggtcctgatccccgccctcacgttcatcgtgctgaccgtgctgaagttcatcgccaacatcttccacacctccaaccaggagaaccgcctcaagatggtcctgaagaagatcaaggaggagttcgagcggaccaaggggagcatggtgtgcgacatctgcaagtacgagtgcgagacgtacaaggagctgaaggcgcacggcgtgtcctgcccccagagccagtgcccctactgcttcacccactgcgagccgaccgagtccgccttccaggcccactaccgcgtctgccaggtgacccaccggttccgcgacgacctcaagaagaccgtgacgccccagaacttcacccccggctgctaccggaccctgaacctgttccgctacaagagccggtgctacatcttcaccatgtggatctgcctcctggtcctggagtccatcctgtgggccgcgagcgcctccgagatcccgctcagccccacgtggaacgacaacgcccacggggtgggctccatccccatgcacaccgacctggagctggacttcagcctcaccagctccagcaagtacacctaccgccggaagctgacgaaccccctggaggagtcccaggccgtgaacttccacgtcgagatcgaggagcaggccatcggggtggacgtgcacgcgctcggccactggttcgacgggcgcctgaacctgaagaccagcttccactgctacggcgcctgcaccaagtacgagtacccgtggcacaccgccaagtgccactacgagcgcgaccaccagtacgagacgtcctggggctgcaaccccagcgactgccccggggtcggcaccgggtgcaccgcctgcggcctctacctggaccagctgaagcccgtgggctccgcctacaagatcatcaccatccggtacagccgccgggtgtgcgtccagttcggggaggagaacctctgcaaggtgatcgaccgcaacgactgcttcgtgtcccggcacgtcaaggtgtgcatcatcggcacggtgagcaagttctcccagggggacaccctgctgttcttcggcccgctcgagggcgggggcctgatcttcaagcactggtgcaccagcacgtgccagttcggggaccccggcgacatcatgagcccccgcgacaaggggttcctgtgccccgagttcccgggcagcttccggaagaagtgcaacttcgcgaccacccccgtctgcgagtacgacgggaacatggtgtccggctacaagaaggtgatggccaccatcgacagcttccagtccttcaacaccagcacgatgcacttcaccgacgagcgcatcgagtggaaggaccccgacggcatgctccgggaccacatcaacatcctggtcaccaaggacatcgacttcgacaacctgggggagaacccctgcaagatcggcctccagacctccagcatcgagggggcctggggcagcggggtgggcttcacgctgacctgcctgatctccctcaccgagtgcccgaccttcctgacgagcatcaaggcctgcgacaaggccatctgctacggcgcggagtccgtgaccctgacccgcgggcagaacaccgtcaaggtgagcggcaagggcgggcactccgggagcacgttcaagtgctgccacggcgaggactgctcccagagcggcctccacgccgccgccccgcacctggacaaggtgaacgggatctccgagatcgagaacagcaaggtctacgacgacggcgcgccccagtgcgggatcaagtgctggttcgtgaagtccggcgagtggatcagcggcatcttctccgggaactggatcgtcctgatcgtgctctgcgtgttcctgctgttcagcctcgtcctgctgtccatcctctgccccgtgcggaagcacaagaagtcctga

SEQ ID NO: 11753 - RNA, 3408 nt, synthetic construct
  misc_feature 1..3408: note = derived and/or modified CDS sequence (opt1) from HTNV(CGRn53)__EF990921.1__GP
  source 1..3408: mol_type = other RNA
atgggcatctggaagtggctggtgatggccagcctcgtctggcccgcctacaccctgcgcaacgtgtacgacatgaagatcgagtgcccgcacaccgtgtccttcggggagaacagcgtcatcggctacgtggagctgccccccatccccctcgcggacacgacccagatggtgccggagtccagctgctccatggacaaccaccagagcctgaacaccatcaccaagtacacgcaggtctcctggcgggggaaggccggccaggcccaggccagccagaactccttcgaggccgtgagcgcggaggtggacctgaaggggacctgcgtcctcaagcacaagatgctggaggagtcctaccgcagccggaagtccatcgcctgctacgacctgagctgcaactccacctactgcaagcccaccctctacatgatcgtgcccatccacgcctgcaacatgatgaagagctgcctgatcgccctgggcccccaccgcgtgcaggtcgtgtacgagcggacgtactgcatgaccggcgtgctcatcgaggggaagtgcttcgtcccggaccagtccgtggtgagcatcatcaagcacggcatcttcgacatcgcgtccgtccacatcgtgtgcttcttcgtggccgtcaaggggaacacctacaagatcttcgagcagatcaagaagagcttcgagagcacctgcaacgacacgaagaacaaggtgcagggctactacatctgcatcgtggggggcaactccgcccccatctacgtccccaccctggacgacttccgcagcatggaggccttctccggcatcttccggagcccccacggggaggaccacgacctggccggcgaggagatcgcgtcctacagcatcgtggggccggccaacgccaaggtcccccactccgccagctccgacaccctcagcctgaccgcctactccggcatccccagctactccagcctgtccatcctcgcgggcagcgccgaggccaagcacgtgttctcccccgggttcttcccgcagctgaaccacacgaagtgcgacaagaccgccatccccctgatgtggaccggcatgatcgacctccccgggtactacgaggccatccacccctgcaccgtgttctgcgtcctgagcggcccgggggcgtcctgcgaggccttcagcgagggcggcatcttcaacatcacgagccccatgtgcctggtgtccaagcagaaccgcttccggctcaccgagcagcaggtgaacttcgtctgccagcgcgtggacatggacatcatcgtgtactgcaacgggcagcggaaggtcatcctgaccaagaccctggtgatcggccagtgcatctacacgatcaccagcctcttctccctgctgcccggggtggcccacagcatcgccgtcgagctctgcgtgcccggcttccacgggtgggccaccgcggccctgctggtgaccttctgcttcggctgggtcctcatcccggccatgacgttcatcgtgctgaccatcctgaagttcatcgccaacatcttccacacctccaaccaggagaacaagctcaagagcgtgctgcgcaagatcaaggaggagttcgagaagaccaagggctccatggtctgcgacgtgtgcaagtacgagtgcgagacgtacaaggagctgaaggcgcacggggtgagctgcccccagtcccagtgcccctactgcttcacccactgcgagcccaccgaggccgccttccaggcccactaccgggtctgccaggtgacccaccgcttccgggacgacctcaagaagacggtgaccccgcagaacttcacccccggctgctaccgcaccctgaacctgttccggtacaagagccgctgctacatcctcaccatgtggaacctgctgctcgtccccgggtaccgggcctgggcggcctccgccagcgagatcccgctgaaccccgtgtggaacgacaacgcccacggcgtggggtccgtccccatgcacacggacctggagctcgacttcagcctgacctccagctccaagtacacctaccgccggaagctgaccaaccccctggaggagagccaggccatcaacctccacatcgagatcgaggagcagacgatcggcgtggacgtgcacgcgctgggccactggttcgtcgggcgcctgaacctcaagaccagcttccactgctacggcgcctgcaccaagtacgagtacccgtggcacaccgccaagtgccactacgagcgcgactaccagtacgagacgtcctgggggtgcaaccccagcgactgccccggcgtgggcaccgggtgcaccgcctgcggcctgtacctggaccagctcaagcccgtggggtccgcctacaagatcatcaccatccggtacagccgccgggtctgcgtgcagttcggcgaggagaacctgtgcaagatcatcgacatgaacgactgcttcgtgtcccgccacgtcaaggtgtgcatcatcgggacggtgagcaagttctcccagggcgacaccctgctcttcttcggcccgctggaggggggcgggctgatcttcaagcactggtgcaccagcacctgccagttcggcgaccccggggacatcatgtccccccgggacaagggcttcctctgccccgagttcccgggcagcttccgcaagaagtgcaacttcgcgacgacccccctgtgcgagtacgacgggaacatggtctccggctacaagaaggtgatggccaccatcgacagcttccagtccttcaacaccagcacgatgcacttcaccgacgagcggatcgagtggaaggaccccgacgggatgctgcgcgaccacatcaacatcctcgtgaccaaggacatcgacttcgagaacctgggcgagaacccctgcaagatcgggctgcagacctccagcatcgagggcgcctggggctccggggtcggcttcacgctcacctgcctggtgagcctgaccgagtgcccgaccttcctcacgtccatcaaggcctgcgacaaggcgatctgctacggggccgagagcgtgaccctgacccggggccagaacaccgtcaaggtgagcgggaagggcggccactccgggagcacgttcaagtgctgccacggcgaggagtgctcccagatcgggctgcacgccgccgccccccacctcgacaaggtgaacggcatcagcgagatcgagaacaacaaggtctacgacgacggcgcgccccagtgcgggatcaagtgctggttcgtgaagtccggcgagtggatcagcgggatcttctccggcaactggatcgtgctgatcgtcctgtgcgtgttcctcctgttcagcctgatcctcctgtccatcctgtgccccgtccgcaagcacaagaagagctga

SEQ ID NO: 11754 - RNA, 3408 nt, synthetic construct
  misc_feature 1..3408: note = derived and/or modified CDS sequence (opt1) from HTNV(CGRn93MP8)__EF990919.1__GP
  source 1..3408: mol_type = other RNA
atgggcatctggaagtggctggtgaaggccagcctcgtctggcccgcctacaccctgcgcaacgtgtacgacatgaagatcgagtgcccgcacaccgtgtccttcggggagaacagcgtcatcggctacgtggagctgccgcccatccccctcgccgacacgacccacatggtgcccgagtccagctgctccatggacaaccaccagagcctgaacaccatcaccaagtacacgcaggtctcctggcgggggaaggccgaccaggcccaggccagccagaactccttcgaggccgtgagcgcggaggtggacctgaaggggacctgcgtcctcaagcacaagatgctggaggagtcctaccgcagccggaagtccatcgcctgctacgacctgagctgcaactccacctactgcaagcccaccctctacatgatcgtgcccatccacgcctgcaacatgatgaagtcctgcctgatcgccctggggccccaccgcgtgcaggtcgtgtacgagcggacgtactgcatgaccggcttcctcatcgagggcaagtgcttcgtgccggaccgcagcgtcgtgagcatcatcaagcacgggatcttcgacatcgcgtccgtgcacatcgtctgcttcttcgtggccgtgaagggcaacacctacaagatcttcgagcagatcaagaagtccttcgagagcacgtgcaacgacaccaagaacaaggtccaggggtactacatctgcatcgtgggcgggaacagcgcccccatctacgtgcccaccctggacgacttccggagcatggaggccttctccggcatcttccgcagcccccacggcgaggaccacgacctggccggggaggagatcgcgtcctacagcatcgtcggcccggccaacgccaaggtgccccactccgccagctccgacaccctcagcctgaccgcctactccgggatccccagctactccagcctgtccatcctcgcgggcagcgccgaggccaagcacgtcttctcccccggcttcctgccgcagctgaaccacacgaagtgcgacaagaccgccatccccctcatgtggaccgggatgatcgacctgcccggctactacgaggccatccacccctgcaccgtgttctgcgtgctgagcgggccgggcgcgtcctgcgaggccttcagcgagggcggcatcttcaacatcacgagccccatgtgcctcgtctccaagcagaaccggttccgcctgaccgagcagcaggtcaacttcgtgtgccagcgggtggacatggacatcatcgtgtactgcaacggccagcgcaaggtgatcctgaccaagaccctcgtcatcgggcagtgcatctacacgatcaccagcctgttctccctgctccccggcgtggcccacagcatcgccgtggagctgtgcgtccccgggttccacggctgggccaccgcggccctgctcgtgaccttctgcttcgggtgggtgctgatcccggccatgacgttcatcgtcctgaccatcctcaagttcatcgccaacatcttccacacctccaaccaggagaacaagctcaagagcgtgctgcggaagatcaaggaggagttcgagaagaccaagggctccatggtgtgcgacgtctgcaagtacgagtgcgagacgtacaaggagctgaaggcgcacggcgtgagctgcccccagtcccagtgcccctactgcttcacccactgcgagcccaccgaggccgccttccaggcccactaccgcgtgtgccaggtcacccaccggttccgcgacgacctgaagaagacggtgaccccgcagaacttcacccccgggtgctaccggaccctgaacctcttccgctacaagagccggtgctacatcttcaccatgtgggtgttcctgctggtcctcgagtccatcctgtgggccgcgagcgcctccgagatccccctgaacccggtgtggaacgacaacgcccacggcgtggggagcgtccccatgcacacggacctcgagctggacttctccctgaccagctccagcaagtacacctaccgccggaagctgaccaaccccctcgaggagagccaggccatcaacctgcacatcgagatcgaggagcagacgatcggcgtggacgtgcacgccctggggcactggttcgacggccgcctcaacctgaagacctccttccactgctacggcgcgtgcaccaagtacgagtacccctggcacaccgccaagtgccactacgagcgcgactaccagtacgagacgagctgggggtgcaacccgtccgactgccccggcgtcgggaccggctgcaccgcctgcggcctgtacctcgaccagctgaagcccgtggggagcgcctacaagatcatcaccatccggtactcccgccgggtgtgcgtccagttcggcgaggagaacctgtgcaagatcatcgacatgaacgactgcttcgtgagccgccacgtgaaggtctgcatcatcgggacggtgtccaagttcagccagggcgacaccctcctgttcttcgggcccctggagggcggcgggctcatcttcaagcactggtgcacctccacgtgccagttcggcgacccgggggacatcatgagcccccgggacaagggcttcctgtgccccgagttccccgggtccttccgcaagaagtgcaacttcgccaccaccccgctgtgcgagtacgacggcaacatggtgagcggctacaagaaggtcatggcgaccatcgactccttccagagcttcaacacctccacgatgcacttcaccgacgagcggatcgagtggaaggaccccgacgggatgctccgcgaccacatcaacatcctggtgaccaaggacatcgacttcgagaacctgggcgagaacccctgcaagatcgggctccagaccagctccatcgagggcgcctgggggagcggcgtgggcttcacgctgacctgcctggtctccctcaccgagtgccccaccttcctgacgagcatcaaggcctgcgacaaggccatctgctacggggcggagagcgtgaccctgacccggggccagaacaccgtgaaggtctccgggaagggcgggcacagcggctccacgttcaagtgctgccacggcgaggagtgcagccagatcgggctccacgccgccgccccgcacctggacaaggtgaacggcatctccgagatcgagaacaacaaggtgtacgacgacggggcgccccagtgcggcatcaagtgctggttcgtcaagagcggcgagtggatctccgggatcttcagcggcaactggatcgtgctgatcgtgctctgcgtcttcctgctgttctccctcatcctgctgagcatcctctgccccgtgcgcaagcacgagaagtcctga

SEQ ID NO: 11755 - RNA, 3408 nt, synthetic construct
  misc_feature 1..3408: note = derived and/or modified CDS sequence (opt1) from HTNV(CGRn93P8)__EF990918.1__GP
  source 1..3408: mol_type = other RNA
atgggcatctggaagtggctggtgatggccagcctcgtctggcccgcctacaccctgcgcaacgtgtacgacatgaagatcgagtgcccgcacaccgtgtccttcggggagaacagcgtcatcggctacgtggagctgccgcccatccccctcgccgacacgacccagatggtgcccgagtccagctgctccatggacaaccaccagagcctgaacaccatcaccaagtacacgcaggtctcctggcgggggaaggccgaccaggcccaggccagccagaactccttcgaggccgtgagcgcggaggtggacctgaaggggacctgcgtcctcaagcacaagatgctggaggagtcctaccgcagccggaagtccatcgcctgctacgacctgagctgcaactccacctactgcaagcccaccctctacatgatcgtgcccatccacgcctgcaacatgatgaagtcctgcctgatcgccctggggccccaccgcgtgcaggtcgtgtacgagcggacgtactgcatgaccggcgtgctcatcgagggcaagtgcttcgtcccggaccgcagcgtggtgagcatcatcaagcacgggatcttcgacatcgcgtccgtccacatcgtgtgcttcttcgtggccgtcaagggcaacaactacaagatcttcgagcagatcaagaagtccttcgagagcacgtgcaacgacaccaagaacaaggtgcaggggtactacatctgcatcgtgggcgggaacagcgcccccatctacgtccccaccctggacgacttccggagcatggaggccttctccggcatcttccgcagcccccacggcgaggaccacgacctggccggggaggagatcgcgtcctacagcatcgtgggcccggccaacgccaaggtcccccactccgccagctccgacaccctcagcctgaccgcctactccgggatccccagctactccagcctgtccatcctcgcgggcagcgccgaggccaagcacgtgttctcccccggcttcttcccgcagctgaaccacaccaagtgcgacaagacggccatccccctgatgtggaccgggatgatcgacctccccggctactacgaggccatccacccctgcaccgtgttctgcgtcctgagcgggccgggcgcgtcctgcgaggccttcagcgagggcggcatcttcaacatcaccagccccatgtgcctggtgtccaagcagaaccggttccgcctcacggagcagcaggtcaacttcgtgtgccagcgggtggacatggacatcatcgtgtactgcaacggccagcgcaaggtcatcctgaccaagaccctggtgatcgggcagtgcatctacaccatcacgagcctcttctccctgctgcccggcgtggcccacagcatcgccgtcgagctctgcgtgcccgggttccacggctgggccaccgcggccctgctggtgaccttctgcttcgggtgggtcctcatcccggccatgaccttcatcgtgctgacgatcctgaagttcatcgccaacatcttccacacctccaaccaggagaacaagctcaagagcgtgctgcggaagatcaaggaggagttcgagaagaccaagggctccatggtctgcgacgtgtgcaagtacgagtgcgagacctacaaggagctgaaggcgcacggcgtgagctgcccccagtcccagtgcccctactgcttcacgcactgcgagcccaccgaggccgccttccaggcccactaccgcgtctgccaggtgacccaccggttccgcgacgacctcaagaagaccgtgacgccgcagaacttcacccccgtctgctaccggaccctgaacctgttccgctacaagagccggtgctacatcttcaccatgtgggtgttcctcctggtgctggagtccatcctctgggccgcgagcgcctccgagatccccctgaacccggtctggaacgacaacgcccacggggtgggcagcgtgcccatgcacaccgacctggagctcgacttctccctgacgagctccagcaagtacacctaccgccggaagctgaccaaccccctggaggagagccaggccatcaacctccacatcgagatcgaggagcagaccatcggggtcgacgtgcacgccctgggccactggttcgacgggcgcctgaacctcaagacgtccttccactgctacggcgcgtgcaccaagtacgagtacccctggcacaccgccaagtgccactacgagcgcgactaccagtacgagaccagctggggctgcaacccgtccgactgccccggggtgggcacggggtgcaccatctgcggcctgtacctggaccagctcaagcccgtcggcagcgcctacaagatcatcaccatccggtactcccgccgggtgtgcgtgcagttcggggaggagaacctgtgcaaggtcatcgacatgaacgactgcttcgtgagccgccacgtgaaggtctgcatcatcggcaccgtgtccaagttcagccagggggacacgctgctgttcttcggccccctggagggcgggggcctgatcttcaagcactggtgcacctccacgtgccagttcggggacccgggcgacatcatgagcccccgggacaaggggttcctctgccccgagttccccggctccttccgcaagaagtgcaacttcgccaccaccccggtgtgcgagtacgacgggaacatggtcagcggctacaagaaggtgatggccaccatcgactccttccagagcttcaacacctccaccatgcacttcacggacgagcggatcgagtggaaggaccccgacggcatgctgcgcgaccacatcaacatcctggtgaccaaggacatcgacttcgacaacctcggggagaacccctgcaagatcggcctgcagaccagctccatcgagggggcgtggggcagcggggtcggcttcaccctgacgtgcctcatctccctgaccgagtgccccaccttcctgaccagcatcaaggcctgcgacaaggccatctgctacggcgccgagagcgtgacgctcacccgggggcagaacaccgtgaaggtctccggcaagggcgggcacagcgggtccaccttcaagtgctgccacggcgaggactgcagccagtccggcctgcacgcggccgccccgcacctggacaaggtgaacgggatcagcgagatcgagaactccaaggtgtacgacgacggcgcgccccagtgcgggatcaagtgctggttcgtcaagagcggcgagtggatctccggcatcttcagcgggaactggatcgtgctcatcgtcctgtgcgtgttcctcctcttctccctggtgctgctcagcatcctgtgccccgtccgcaagcacaagaagtcctga

SEQ ID NO: 11756 - RNA, 3408 nt, synthetic construct
  misc_feature 1..3408: note = derived and/or modified CDS sequence (opt1) from HTNV(CGRni1)__EU363815.1__GP
  source 1..3408: mol_type = other RNA
atgggcatctggaagtggctggtgatggccagcctcgtctggcccgccttcgccctgcgcaacctgtacgacatgaagatcgagtgcccgcacaccgtgtccttcggggagaacagcgtgaccggctacgtcgagctcccgcccatgcccctggccgacacgacccagatggtgcccgagtccagctgctccatggacaaccaccagagcctgaacaccatcaccaagtacacgcagatcatctggcgggggaaggccgaccagtcccagagctcccagaacagcttcgagaccgtgtccaccgaggtcgacctcaaggggacctgcgtgctgaagcacaagatgatcgaggagagctaccgctcccgcaagagcatcacgtgctacgacctgtcctgcaacagcacctactgcaagcccaccctctacatgatcgtgcccatccacgcctgcaacatgatgaagtcctgcctgatcgccctggggccctaccgcgtccaggtggtgtacgagcggacctactgcatgacgggcgtcctcatcgagggcaagtgcttcgtgccggaccagagcgtggtctccatcatcaagcacgggatcttcgacatcgccagcgtgcacatcgtgtgcttctacgtcgccgtgaagggcaacacctacaagatcttcgagcaggtcaagaagaccttcgagagcaactgcaacgacaccgagaacaaggtccaggggtactacatctgcatcatcggcgggaactccagccccgtgtacgtgcccacgctggacgacttccgctccatggaggccttcagcggcatcatccggagcccccacggcgaggaccacgacctggccggggaggaggtcgcgtcctactccatcgtgggcccggccaacgccaaggtcccccacagcgcctccagcgacaccctcgggctgatcgcctactccagcatcccctcctacagctccctgagcatcctcacctccagcaccgaggcgaagcacgtgttctcccccggcctgttcccgcagctgaaccacacgaagtgcgacaagaccgccatccccctcacctggaccggcatgatcgacctgcccgggtactacgaggccatccacccctgcacggtgttctgcgtgctgagcggcccgggcgccagctgcgaggccttctccgagggcgggatcttcaacatcgcgagccccatgtgcctcgtgtccaagcagaaccggttccggctgaccgagcagcaggtcaacttcgtgtgccagcgcgtggacgtggacatcatcgtctactgcaacggccagcggaaggtgatcctgaccaagaccctcgtgatcggccagtgcatctacacgatcaccagcctgttctccctgctccccggggtcgcccacagcatcgccgtggagctgtgcgtgcccggcttccacgggtgggccaccgccgcgctgctcgtcaccttctgcttcggctgggtgctgatcccggccatcacgttcatcatcctgaccatcctcaagttcatcgccaacatcttccacacctccaaccaggagaaccgcctcaagagcgtgctgcggaagatcaaggaggagttcgagcgcaccatggggtccatggtctgcgacatctgcaagtacgagtgcgagacgtacaaggagctgaaggcccacggcgtgagctgcccccagtcccagtgcccctactgcttcacccactgcgagcccaccgaggccgcgttccaggcccactacaaggtgtgccaggtcacccaccggttccgcgacgacctgaagaagaccgtgacgcggcagaacttcaccccgggctgctaccgcaccctgaacctcttccggtacaagagccgctgctacatcttcaccatgtgggtgttcctgatcgtcctggagtccatcctctgggccgccagcgcgtccgagatccccctgaaccccgtgtggaacgacaacgcccacggggtgggcagcatcccgatgcacacggacctggagctcgacttctccctgaccagcagctccaagtacacctaccggcgcaagctgaccaaccccctggaggagagccaggccatcgacctccacgtcgagatcgaggagcagacgatcggggtggacgtgcacgccctgggccactggttcgacgggcgcctgaacctcaagacctccttccactgctacggcgcctgcaccaagtacgagtacccctggcacaccgcgaagtgccactacgagcgggactaccagtacgagacgagctggggctgcaacccctccgactgcccgggggtcggcaccgggtgcaccgcctgcggcctgtacctggaccagctcaagcccgtgggcagcgcctacaagatcatcaccatccgctactcccggcgcgtgtgcgtccagttcggggaggagaacctgtgcaagatcatcgacatgaacgactgcttcgtgagccggcacgtgaaggtctgcatcatcggcacggtgtccaagttcagccagggggacaccctcctgttcttcggccccctggagggcgggggcctgatcttcaagcactggtgcaccagcacgtgccagttcggggaccccggcgacatcatgagcccgcgcgacaaggggttcctctgccccgagttccccggctccttccggaagaagtgcaacttcgccaccacccccgtgtgcgagtacgacgggaacatggtcagcggctacaagaaggtgatggccaccatcgactccttccagagcttcaacacctccacgatgcacttcaccgacgagcgcatcgagtggaaggacccggacggcatgctgcgggaccacatcaacatcctggtgaccaaggacatcgacttcgacaacctcggggagaacccctgcaagatcggcctgcagaccagctccatcgagggggcgtggggcagcggggtcggcttcacgctgacctgcctcatcagcctgaccgagtgctccaccttcctgacgagcatcaaggcctgcgacaaggccatctgctacggcgccgagtccgtgaccctcacccgcgggcagaacaccgtgaaggtcagcggcaagggcgggcactccgggagctccttcaagtgctgccacggcgaggagtgcagccagatcggcctgcacgccgcggcgccccacctggacaaggtgaacgggatctccgagatggagaacagcaaggtgttcgacgacggcgcgccccagtgcgggatcaagtgctggttcgtcaagtccggcgagtggatcagcggcatcttctccgggaactggatcgtgctcatcgtgctgtgcgtcttcctcctgttcagcctggtgctgctctccatcctgtgcccggtccggaagcacaagaagtcctga

SEQ ID NO: 11757 - RNA, 3408 nt, synthetic construct
  misc_feature 1..3408: note = derived and/or modified CDS sequence (opt1) from HTNV(Aa10-434)__KU207160.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcgggggcaacagcgtgatcgggtacgtggagctcccccccatgcccctggccgacacggcgcagctggtcccggagtccagctgctccatggacaaccaccagagcctcaacaccatcaccaagtacacccaggtgtcctggcggggcaaggccgaccagagccagtccagccagatctccttcgagacggtgagcaccgaggtcgacctgaaggggacctgcgtgctgaagcacaagatggtggaggagtcctaccgcagccggaagtccatcacctgctacgacctcagctgcaactccacgtactgcaagcccaccctgtacatgatcgtccccatccacgcctgcaacatgatgaagagctgcctgatcgccctcggcccctaccgcgtgcaggtggtctacgagcggacctactgcatgaccggcgtgctgatcgaggggaagtgcttcgtgccggaccagtccgtcgtgagcatcatcaagcacggcatcttcgacatcgccagcgtgcacatcgtctgcttcttcgtggcggtgaaggggaacacgtacaagatcttcgagcaggtcaagaagtccttcgagagcacctgcaacgacaccgagaacaaggtgcagggctactacatctgcatcgtcgggggcaactccgcccccatctacgtgcccaccctggacgacttccgcagcatggaggccttcacgggcatcttccggtccccccacggggaggaccacgacctcgccggcgaggagaccgcgacctacagcatcgtggggccggccaacgccaaggtcccccactccgccagctccgacaccctgagcctgatcgccttctccggcatccccagctactccagcctctccatcctgacgagctccaccgaggcgaagcacgtgttcagccccggcctgttcccgaagctcaaccacaccaactgcgacaagggggccatccccctgatgtggaccggcatgatcgacctgcccgggtactacgaggccatccacccctgcacggtgttctgcgtcctctccggcccgggggccagctgcgaggccttcagcgagggcggcatcttcaacatcacctcccccatgtgcctggtgagcaagcagaaccgcttccggctgaccgagcagcaggtgaacttcgtctgccagcgcgtggacgtggacatcgtcgtgtactgcaacgggcagcggaaggtgatcctcaccaagacgctggtcatcggccagtgcatctacaccatcacctccctgttcagcctcctgcccggggtggcgcactccatcgccgtggagctgtgcgtccccggcttccacgggtgggccaccgccgccctcctggtgacgttctgcttcggctgggtgctgatcccggcgatcaccttcatcatcctcaccatcctgaagttcatcgccaacatcttccacaccagcaaccaggagaaccgcctgaagtccgtcctccggaagatcaaggaggagttcgagaagacgaagggcagcatggtgtgcgacatctgcaagtacgagtgcgagacctacaaggagctgaaggcccacggggtgtcctgcccccagagccagtgcccctactgcttcacccactgcgagcccaccgaggccgccttccaggcgcactacaaggtctgccaggtgacccaccgcttccgggacgacctgaagaagacggtgaccccgcagaacttcacccccggctgctaccgcaccctcaacctgttccggtacaagtcccgctgctacatcttcacgatgtggatcttcctgctcgtcctggagagcatcctgtgggccgcctccgccagcgagacccccctcaccccggtgtggaacgacaacgcgcacggggtgggctccgtccccatgcacaccgacctggagctggacttcagcctgacgtccagcagcaagtacacctaccggcgcaagctcaccaaccccctggaggaggcccagtccatcgacctgcacatcgagatcgaggagcagaccatcggggtggacgtgcacgccctcggccactggttcgacggccggctgaacctgaagacgagcttccactgctacggggcctgcaccaagtacgagtacccctggcacaccgccaagtgccactacgagcgcgactaccagtacgagacctcctggggctgcaacccgagcgactgccccggggtcggcacgggctgcaccgcgtgcgggctctacctggaccgcctgaagcccgtgggctccgcctacaagatcatcaccatccggtacagccgccgggtgtgcgtccagttcggggaggagaacctctgcaagatcatcgacatgaacgactgcttcgtgtcccgccacgtgaaggtctgcatcatcggcaccatcagcaagttctcccagggggacacgctgctgttcttcggccccctcgagggcgggggcctgatcttcaagcactggtgcaccagcacctgccagttcggggacccgggcgacatcatgtccccccgggacaaggggttcctgtgccccgagttccccggcagcttccgcaagaagtgcaacttcgccaccacgccgatctgcgagtacgacggcaacatggtgtccgggtacaagaaggtgatggccaccatcgacagcttccagtccttcaacaccagcaccatgcacttcacggacgagcggatcgagtggaaggaccccgacggcatgctccgcgaccacatcaacatcctggtcaccaaggacatcgacttcgacaacctgggggagaacccctgcaagatcggcctccaggcctccagcatcgagggggcgtggggctccggcgtggggttcaccctgacctgcctggtgagcctcacggagtgccccaccttcctgaccagcatcaaggcctgcgacaaggccatctgctacggcgccgagtccgtcaccctgacgcgggggcagaacaccgtgaaggtgagcggcaaggggggccactccggcagcaccttcaagtgctgccacggggaggactgctcccagatcggcctccacgccgcggccccgcacctggacaaggtcaacgggatcagcgagatggagaactccaaggtgtacgacgacggcgccccccagtgcggcatcaagtgctggttcgtgaagagcggggagtggatctccggcatcttcagcgggaactggatcgtcctgatcgtgctctgcgtcttcctgctgttctccctcgtgctgctgagcatcctctgccccgtgcgcaagcacaagaagtcctga

SEQ ID NO: 11758 - RNA, 3408 nt, synthetic construct
  misc_feature 1..3408: note = derived and/or modified CDS sequence (opt1) from HTNV(Aa10-518)__KU207161.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcggggagaacagcgtgatcggctacgtggagctcccccccatgcccctggccgacacggcgcagctggtcccggagtccagctgctccatggacaaccaccagagcctcaacaccatcaccaagtacacccaggtgtcctggcgggggaaggccgaccagagccagtccagccagaactccttcgagacggtgagcaccgaggtcgacctgaagggcacctgcgtgctgaagcacaagatggtggaggagtcctaccgcagccggaagtccatcacctgctacgacctcagctgcaactccacgtactgcaagcccaccctgtacatgatcgtccccatccacgcctgcaacatgatgaagagctgcctgatcgccctcgggccctaccgcgtgcaggtggtctacgagcggacctactgcatgaccggcgtgctgatcgagggcaagtgcttcgtgccggaccagtccgtcgtgagcatcatcaagcacgggatcttcgacatcgccagcgtgcacatcgtctgcttcttcgtggcggtgaagggcaacacgtacaagatcttcgagcaggtcaagaagtccttcgagagcacctgcaacgacaccaagaacaaggtgcaggggtactacatctgcatcgtcggcgggaactccgcccccatctacgtgcccaccctggacgacttccgcagcatggaggccttcacgggcatcttccggtccccccacggcgaggaccacgacctcgccggggaggagaccgcgacctacagcatcgtgggcccggccaacgccaaggtcccccactccgccagctccgacaccctgagcctgatcgccttctccgggatccccagctactccagcctctccatcctgacgagctccaccgaggcgaagcacgtgttcagccccggcctgttcccgaagctcaaccacaccaactgcgacaagggcgccatccccctgatgtggaccgggatgatcgacctgcccggctactacgaggccatccacccctgcacggtgttctgcgtcctctccgggccgggcgccagctgcgaggccttcagcgaggggggcatcttcaacatcacctcccccatgtgcctggtgagcaagcagaaccgcttccggctgaccgagcagcaggtgaacttcgtctgccagcgcgtggacgtggacatcgtcgtgtactgcaacggccagcggaaggtgatcctcaccaagacgctggtcatcgggcagtgcatctacaccatcacctccctgttcagcctcctgcccggcgtggcgcactccatcgccgtggagctgtgcgtccccgggttccacggctgggccaccgccgccctcctggtgacgttctgcttcgggtgggtgctgatcccggcgatcaccttcatcatcctcaccatcctgaagttcatcgccaacatcttccacaccagcaaccaggagaaccgcctgaagtccgtcctccggaagatcaaggaggagttcgagaagacgaagggcagcatggtgtgcgacatctgcaagtacgagtgcgagacctacaaggagctgaaggcccacggcgtgtcctgcccccagagccagtgcccctactgcttcacccactgcgagcccaccgaggccgccttccaggcgcactacaaggtctgccaggtgacccaccgcttccgggacgacctgaagaagacggtgaccccgcagaacttcacccccgggtgctaccgcaccctcaacctgttccggtacaagtcccgctgctacatcttcacgatgtggatcttcctgctcgtcctggagagcatcctgtgggccgcctccgccagcgagacccccctcaccccggtgtggaacgacaacgcgcacggcgtggggtccgtccccatgcacaccgacctggagctggacttcagcctgacgtccagcagcaagtacacctaccggcgcaagctcaccaaccccctggaggaggcccagtccatcgacctgcacatcgagatcgaggagcagaccatcggcgtggacgtgcacgccctcgggcactggttcgacggccggctgaacctgaagacgagcttccactgctacggcgcctgcaccaagtacgagtacccctggcacaccgccaagtgccactacgagcgcgactaccagtacgagacctcctgggggtgcaacccgagcgactgccccggcgtcgggacgggctgcaccgcgtgcggcctctacctggaccgcctgaagcccgtggggtccgcctacaagatcatcaccatccggtacagccgccgggtgtgcgtccagttcggcgaggagaacctctgcaagatcgtggacatgaacgactgcttcgtgtcccgccacgtcaaggtgtgcatcatcgggaccgtgagcaagttctcccagggcgacacgctgctgttcttcgggcccctcgagggcggcgggctgatcttcaagcactggtgcaccagcacctgccagttcggcgacccgggggacatcatgtccccccgggacaagggcttcctgtgccccgagttccccgggagcttccgcaagaagtgcaacttcgccaccacgccgatctgcgagtacgacggcaacatggtctccggctacaagaaggtgatggccaccatcgacagcttccagtccttcaacaccagcaccatgcacttcacggacgagcggatcgagtggaaggaccccgacgggatgctccgcgaccacatcaacatcctggtgaccaaggacatcgacttcgacaacctgggcgagaacccctgcaagatcgggctccagacctccagcatcgagggcgcctgggggtccggcgtcggcttcaccctgacgtgcctggtgagcctcaccgagtgccccaccttcctgaccagcatcaaggcgtgcgacaaggccatctgctacggggccgagtccgtgacgctgacccggggccagaacaccgtcaaggtgagcgggaagggcgggcactccggcagcaccttcaagtgctgccacggcgaggactgctcccagatcgggctccacgccgccgcgccgcacctggacaaggtgaacggcatcagcgagatggagaactccaaggtctacgacgacggggccccccagtgcggcatcaagtgctggttcgtgaagagcggcgagtggatctccgggatcttcagcggcaactggatcgtcctgatcgtgctctgcgtgttcctgctgttctccctcgtcctgctgagcatcctctgccccgtgcgcaagcacaagaagtcctga

SEQ ID NO: 11759 - RNA, 3408 nt, synthetic construct
  misc_feature 1..3408: note = derived and/or modified CDS sequence (opt1) from HTNV(Aa13_3)__KX687227.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcggggagaacagcgtgatcggctacgtggagctcccgcccatgcccctggtcgacacggtgcagctggtgcccgagtccagctgctccatggacaaccaccagagcctcaacaccatcaccaagtacacccaggtctcctggcgggggaaggccgaccagagccagtccagccagaactccttcgagacggtgagcaccgaggtggacctgaaggggacctgcgtcctgaagcacaagatggtggaggagtcctaccgcagccggaagtccatcacgtgctacgacctcagctgcaactccacctactgcaagcccaccctgtacatgatcgtgcccatccacgcctgcaacatgatgaagtcctgcctgatcgccctcgggccctaccgcgtccaggtggtgtacgagcggacctactgcatgaccggcgtcctgatcgagggcaagtgcttcgtgccggaccagtccgtggtcagcatcatcaagcacgggatcttcgacatcgccagcgtgcacatcgtgtgcttcttcgtcgccgtgaagggcaacacgtacaagatcttcgagcaggtcaagaagtccttcgagagcacgtgcaacgacaccgagaacaaggtgcaggggtactacatctgcatcgtgggcgggaactccgcccccatctacgtccccaccctggacgacttccgcagcatggaggcgttcaccggcatcttccggagcccccacggcgaggaccacgacctcgccggggaggagaccgccacctacagcatcgtgggcccggccaacgcgaaggtgccccactccgccagctccgacaccctgagcctgatcgccttctccgggatccccagctactccagcctctccatcctgacgagctccaccgaggccaagcacgtcttcagccccggcctgttcccgaagctcaaccacaccaactgcgacaagggcgccatccccctgatgtggaccgggatgatcgacctgcccggctactacgaggcgatccacccctgcacggtgttctgcgtgctctccgggccgggcgccagctgcgaggccttcagcgagggcggcatcttcaacatcacctcccccatgtgcctggtcagcaagcagaaccgcttccggctgaccgagcagcaggtcaacttcgtgtgccagcgcgtggacgtggacatcgtggtctactgcaacggccagcggaaggtgatcctcaccaagacgctggtgatcgggcagtgcatctacaccatcacctccctgttcagcctcctgcccggcgtcgcccactccatcgccgtggagctgtgcgtgcccgggttccacggctgggcgaccgccgccctcctggtcacgttctgcttcgggtgggtgctgatcccggccatcaccttcatcatcctcaccatcctgaagttcatcgccaacatcttccacaccagcaaccaggagaaccgcctgaagtccgtgctccggaagatcaaggaggagttcgagaagacgaagggcagcatggtctgcgacatctgcaagtacgagtgcgagacctacaaggagctgaaggcgcacggcgtgtcctgcccccagagccagtgcccctactgcttcacccactgcgagcccaccgaggccgccttccaggcccactacaaggtgtgccaggtcacccaccgcttccgggacgacctgaagaagacggtgaccccgcagaacttcacccccgggtgctaccgcaccctcaacctgttccggtacaagtcccgctgctacatcttcacgatgtggatcttcctgctcgtgctggagagcatcctgtgggccgcgtccgccagcgagacgcccctcaccccggtctggaacgacaacgcccacggcgtggggtccgtgcccatgcacaccgacctggagctggacttcagcctgacctccagcagcaagtacacctaccggcgcaagctcaccaaccccctggaggaggcccagtccatcgacctgcacatcgagatcgaggagcagaccatcggcgtcgacgtgcacgcgctcgggcactggttcgacggccggctgaacctgaagacgagcttccactgctacggcgcctgcaccaagtacgagtacccctggcacaccgccaagtgccactacgagcgcgactaccagtacgagacctcctgggggtgcaacccgagcgactgccccggcgtggggacgggctgcaccgcctgcggcctctacctggaccgcctgaagcccgtcgggtccgcctacaagatcatcaccatccggtacagccgccgggtgtgcgtgcagttcggcgaggagaacctctgcaagatcatcgacatgaacgactgcttcgtctcccgccacgtgaaggtgtgcatcatcgggaccgtcagcaagttctcccagggcgacacgctgctgttcttcgggcccctcgagggcggcgggctgatcttcaagcactggtgcaccagcacgtgccagttcggcgacccgggggacatcatgagcccccgggacaagggcttcctgtgccccgagttccccgggtccttccgcaagaagtgcaacttcgcgaccaccccgatctgcgagtacgacggcaacatggtgtccggctacaagaaggtgatggccaccatcgacagcttccagtccttcaacaccagcaccatgcacttcacggacgagcggatcgagtggaaggaccccgacgggatgctccgcgaccacatcaacatcctggtcaccaaggacatcgacttcgacaacctgggcgagaacccctgcaagatcgggctccagacctccagcatcgagggcgcctgggggtccggcgtgggcttcaccctgacgtgcctggtgagcctcaccgagtgccccaccttcctgaccagcatcaaggcctgcgacaaggccatctgctacggggcggagtccgtcacgctgacccggggccagaacaccgtgaaggtgagcgggaagggcgggcactccggcagcaccttcaagtgctgccacggcgaggactgctcccagatcgggctccacgccgccgccccgcacctggacaaggtcaacggcatcagcgagatggagaactccaaggtgtacgacgacggggcgccccagtgcggcatcaagtgctggttcgtcaagagcggcgagtggatctccgggatcttcagcggcaactggatcgtgctgatcgtgctctgcgtcttcctgctgttctccctcgtgctgctgagcatcctctgccccgtgcgcaagcacaagaagtcctga
